United States Patent 7,745,391 (HUMAN THROMBOSPONDIN POLYPEPTIDE) - sequence listing, part 212

SEQ ID NO: 524046 - DNA, 947 bp, Homo sapiens
gtatatttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaacttttatgtttgacttctttcacttagcataatgttttcagagtgcatcactgttgtaacatgtatcagtaccctttttgtgactgaatattattccaccgaatggatataccacattttacttatccattcaaccgttgatgtacatttgagttgattccaaattttggctattaagaatgctgctctgaacattgatgtgcaagttttttttttttggtatgtccttttgtttccaatttcctgtggatatttttctaagaattagaatggctggatcatacagtaattctgcttaaacttttgaggagctgccaggctgtttcccaaagtggctacaactttttgcttttccaccagctgtgtttgagggtcccattttctcctcattctgacaactttattactccctttttaaattttagtcatcatagtgtgggtgacgaacgtgtccttcctgggggtttgattggcattccttagtgactgatgtgtggagcctcttccctgtgtttttgactttatatatttggggagtattctgtcctttccttgtcctttcccttgttcttgtcctttcctggccccttcactggggtcttcgcggaggacgcagggttttttttctggctagcgtctttttttggttaaacaaaagggggcgatttctcggcggcctcccctgttaggctctgggtaatggcggcctgagggttggacgcgtgcccacgatattgggctcgtg

SEQ ID NO: 524047 - DNA, 729 bp, Homo sapiens
  misc_feature (237)..(239): n is a, c, g, or t
  misc_feature (241)..(243): n is a, c, g, or t
  misc_feature (246)..(247): n is a, c, g, or t
  misc_feature (254)..(254): n is a, c, g, or t
  misc_feature (256)..(256): n is a, c, g, or t
  misc_feature (258)..(258): n is a, c, g, or t
  misc_feature (386)..(387): n is a, c, g, or t
gaaaacaaccgcccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccctgccttgaacgagctcaacgcggggatggaagtggtgaagaagttcattcagagcatgcannncnnnacnnggcctcncncncccccgggtcctgcccaacctggtggccgtgtgcctggctgccatctactcctgctatgaagagttcatcaacagccgcgacaattccccaagcctgaaggaaatccggaacggctgccagcagcgtnngcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctgggccagtttg

SEQ ID NO: 524048 - DNA, 141 bp, Homo sapiens
cccggttcaggtgttacttcatgctttgtgcaatagttttatagccgagcagccctgaatgaattaaaacccacagcggtcacacatgaaatggttcactcctgcgtggatgagcatatgctgctccaggtactgaatacg

SEQ ID NO: 524049 - DNA, 400 bp, Homo sapiens
  misc_feature (99)..(99): n is a, c, g, or t
  misc_feature (117)..(117): n is a, c, g, or t
  misc_feature (123)..(124): n is a, c, g, or t
  misc_feature (132)..(133): n is a, c, g, or t
  misc_feature (135)..(135): n is a, c, g, or t
  misc_feature (150)..(150): n is a, c, g, or t
  misc_feature (153)..(154): n is a, c, g, or t
  misc_feature (165)..(165): n is a, c, g, or t
  misc_feature (201)..(202): n is a, c, g, or t
  misc_feature (282)..(282): n is a, c, g, or t
  misc_feature (285)..(285): n is a, c, g, or t
  misc_feature (294)..(294): n is a, c, g, or t
  misc_feature (302)..(302): n is a, c, g, or t
  misc_feature (319)..(320): n is a, c, g, or t
  misc_feature (337)..(337): n is a, c, g, or t
  misc_feature (340)..(340): n is a, c, g, or t
  misc_feature (350)..(350): n is a, c, g, or t
gtcctcgtggaagtgacatcgtctttaaaccctgcgtggcaatccctgacgcaccgccgtgatgcccagggaagacagggcgacctggatcatatctanctcattgtttcaattctngacaanntggcacanncnatcgttctccgagtngtnnatgcaaccatnccagctcgagactgaaacatctgaaatgtgctctannggatgtgtgtgtccagagactctgaatcagcttgctgcatagtgcactgtgcgtgctgtgcatgccttatcctgtgcacnacntgtctggcnagactctntcagttagttacataanntcagccatgatctatgngtnatgtcaatgnacatggacagacgtgtgatgtattccctctctggtgctccgtgtcaggtt

SEQ ID NO: 524050 - DNA, 1069 bp, Homo sapiens
ttgtagctgctggggtgtctacttgtcagagcgtgcgtccgtgctgtcgtgtgcttatttctagctgccgtttcactgtgttgtttccttggtcttttcccaaccggtgtggtcttcggttcgcggttttctgaccacgctccgtggggcgcgtacgctctgggtactcccggtttgccttcacagagggtctgtcccgctgccattggtccttgtccccttggatcctgtcagcccagtggcacttcgggtctcttgtttttgcacttgggcacaaatttcttgccccagttctggccactatggaaaatggcaagcatggtggcaccctgttatggcccagatgtatgagaacttttgtggaggaagtggatatctcgtggacacaatgggatctcccccgtgggcacaggggggagcctcgatatgccctgccccgcttcgctgagtgcacgagttgctcgactttattcctacctggtgcccctccctgtcccagaccctgaggccgggttcaagcgtgccaatggatctggttcaagaggagtttttgcagagattagatttctacccacacagctggctgccaacccgggccttggtggaaaaggcaccttgcccagcgattccaaggtggaacccacaatggagagaattttggaaactggcgagaaaggtgcaatgtccctggaaggagcatctctaccaccctggaaatttgggctgtcccctccacagtggccacttttctttgttatctaccacctgagccacggctggacacgtggcgaatatcacgtgtgtgccccaggaggccccacctcacttcccaagccggctgcccctgccacgaggccactggcggggttttcgggacgaggccctggagccacggtcacgtgggagtccctggctgcattttctgtccacatgcacagccggcgttcaattggccggtcaccccgcaacccgcaagaagggtgccttgaggcactggcccgtgccacaccttggcccagcgctcatacctcccaccaatttcctagtttaattaaaccttccatttcca

SEQ ID NO: 524051 - DNA, 488 bp, Homo sapiens
  misc_feature (303)..(303): n is a, c, g, or t
gccttacaccacgccttaacctgcagtcgcctagaaaacttgctctcaaacttcagggttttttcttccttcaaattttggaccaaagtctcatttctgtgttttgcctgcctctgatgctgggacccggaaggcgggcgctcctgtctttgtgctctttctaccgcccccgcgtactgtcccgggggctctactaggatcccctttccgtaaaagcgtgtaacaagggtgtaaatatttataattttttatacctgttgggaaaacccaagggcggggggccggttttttatggtgacacanatgtatattttgctaacagcaattgccagctcaatatcgttgaccgcggggcccaagggaccccaagcacattccgttgccttaccccatgggttgttaccgggataggaccgtttaaaaacgtttgagaaactacttcttggtttagcccttgtttctttgggaccctgttaaaggaggttggt

SEQ ID NO: 524052 - DNA, 951 bp, Homo sapiens
  misc_feature (482)..(482): n is a, c, g, or t
  misc_feature (489)..(489): n is a, c, g, or t
  misc_feature (542)..(542): n is a, c, g, or t
agcggcaggggaggtgctagacagagtccagtgttctagaagaggcggtgtctagagcctaattttacttggctaagttctggtagctatgaccaggaatttgtgaacacgttagtttaacgtacgtgctaaatatgtttctgatagtaaaatgagcattaagatttcttcgctactggtatagaactttcttgtagacctaatcaggtgaatcaagtattgttctgatcaggtgccactgggcttcctgtagttctatctgcaagtgttacaatcacaactaatttgtggagataatgaggtcgaatacctctgctgatagtgctgtaattttgagagactctgagtactcaggtggcaagagtagttggtggcaatgtacctagagagttaatggaaatgaaaattggataggctgtcaataggaataaagaaataataaccttcttctcgaggagtgacagggggtagtccccgtgacncattcangtgcgcggcgcgtaggagtcggcgtttgcagtaggggtgggggggaccggggngttacggggggctatctaagggtgacccgcatttgaagaggagggggtccacccatctaactagagcgccggcgtggaggattacatcgagctggggcgtcaagaaaaaagtttggggtatcgcgccgtggggggcctgtgaaaccatttggggtgtgcacctcccgtgggtctcccaagaaagctttcgcctagctactagataggtgtgaaaagagcacacgaaatttccagagcccttggcccccaaggaaggaaattttcccttccggggaaagccagtccagagccagtttgggggcggaatcctccacagcgaattcaaaaaggtttccccaaaagagccttggtcccccaagttttgtggttctggaagggaatccaaaggtaatttggggcgctggaacga

SEQ ID NO: 524053 - DNA, 348 bp, Homo sapiens
  misc_feature (23)..(23): n is a, c, g, or t
cgatctagaggatcccgtatatnggtgagcatcctcaccgaccgtcccccagctttttatttttttttcgtgagaagggattctcactctccagccggggcagtagagggagacccggcctcataaaaaaacgaaacagaagtcggacgccttcagaagcctcaatctaaactcagctccacggcttgttggccagggggccttaggaaaggggctgacctcccgttaccacaggtgctctctcatcgtgggacgaggcggaggctctagggcctccttccagggtctccccagggttaagggcggggcggccggtaaaaggctcaccaatataggggtaccgagctc

SEQ ID NO: 524054 - DNA, 152 bp, Homo sapiens
aaactggttttggggcagggatgggtggacagctgggggtttccaaagagaagatcggaagtcatctgcatcccactccagcaggctgtggtcctcccagctgctccctgccgctgtgcgactcgcccgtttcaattcctcatccttggaag

SEQ ID NO: 524055 - DNA, 155 bp, Homo sapiens
ggtgacctagaggtatccaatctctcattgcgatccgatggataacttcgaggaattgctcaaagtgctgggggtgaactgtgatgctgaggaagattgctgtggctgcagcgtcaagcccagcagtggagatcaacaggagggagacactttct

SEQ ID NO: 524056 - DNA, 927 bp, Homo sapiens
gaacacgggacggagtatgacacgctgcccttccgacacagtctccctcagtgactcggactctgacctcagcttgcccggtggtgctgagagtggaagcactgtccccgatggggctgcctggggaggaggattcaggtcctgatgagccgccctcactccccgtcaggcctcctcccagatcacggtgtcagctcattccatctgaggaggcatgagctccaccttctcccagcgcaggcgtgacatctttgactgcctggagggggcggccagacgggctccatcctctgtggcccacagcagcatgaatgacaacggaggcttctaagcggtcatctagcgccctcaggccggtctccagtgaaaggcctggagcagggcccgatcggagaccctggctcaccaagggtgacctccggtccccgaatacgtgtgacacacactccgagcgcctggaccaaggtagccagcctgtgaagatgtgacccgaggtcagcagagtcagaggcaatcaggtccaccgtcccctggaccttcctggagctcccagagcctggactgaccccactgactgtgtgttcatccttcaatccaggatccctccagtgtggtggcaggggagggtcatcttcaccaaacagtccgaaggggtcgaagcaggacgacgagaggacgagcgtcctgggggaaggtgggagcagccaggcaaggggcggcttgggaatcctggcacaagaacaggggcgagggccctgtggagctggcccaatctggcgggccgggagcccagaggctgaggaagtgggcaccccaaggaggcccgcgggacgctgaggcccgcccggagcggcccggggccgggcaggctcccgccggaaaggggtcccggacacgaaggggtaacactcgaaacagcccgtcatg

SEQ ID NO: 524057 - DNA, 143 bp, Homo sapiens
tcacatcctcggtccttcgtgctgccatccatcatgctcctcaccacccatcttacttggctgaaggctctctgaggctatgccgggcaacacatctgatccttccactggacggcctagtgctgcttatccttaatttctca

SEQ ID NO: 524058 - DNA, 260 bp, Homo sapiens
gtaatgccttttcactgactgaaaaaattactccctcaacaatgggactaatactggaagacatgagcagaagaaacctatactaccactgggtcccagccctatagcaaggctagctctattacacaggggaaaacaggatgcattcaagtagttatgtacaacccgtagccatattccaatatgcagtaaatcacaagatgttcaggtcgaactgacactcatggaacacaacaatgcatttcatctaaccaacatta

SEQ ID NO: 524059 - DNA, 146 bp, Homo sapiens
tgaaccccatatatgcttttctattcattataatacctagccagatcacatggtcttgtagcgaatacttatcaagtttcccttgaattgatgtgtcgagcttctaccttagaaatccgtaacattctagtgtactagctactatg

SEQ ID NO: 524060 - DNA, 981 bp, Homo sapiens
tgccatgaggaggcaagaaccacaatggggggaccgctctttgagaagttgttgtccccccccgggggtgacagacagacaaagaacctgggcaataattatgatggcggcaccttcacacaacaccagtgatttcttcgggaatgtgggcggcaccctttcttgatgatgtggattatagaaccgaatatcatcgctgtgctgcgttggataaatgggctcccctctgggtggatgcgcgatggctgcacaaaagtctacgagttcccccttcttcagataactaccctggctccctcaactagaggtaatgaatgctttttcctactgcctccttttgtggtcccacccaatttttgacaacaactttctgccccctttgtaattgggcaccacacgttaccccccctcccccaagagagtgctggcacacaacaccggcctttaagagcgttaataatttcctctagggccaactttcttcacagcacattctcggttcacaagttgggaggaacccccccggccccctcgtcttcgacccgttgtggtttgaaatgtcttcatacgccccacgagacctcttcggacaaaccacttcacggcccacatgatatatggggtcaccacaccttctggctattggagcccccaaccccagagccactcttgctgtcaacacaaccacctgcacaacctggccaaccacaaccacggaacacctatgtcccacacccttgtgaagaagaacccaggggtacaaccaaggagttttcctcccacagtgagagggagaccctggagagccctaatccaagcggaagggcgctggctggcccccactgggtctgctggccatcccgaccctggccgatagaccaccctgtatggactattccctggccaaacctggggagataggcccagaaggaaaatttgacgaattaagaccccccctgccccatagccctgagtggtcca

SEQ ID NO: 524061 - DNA, 698 bp, Homo sapiens
gggtgcatggtaagtcctgctcgtgtagacctctctctgctgagcacgcgctgggcacgaaaggctaccactcaccgcactgagcatcaacaaggaagatttataagattggccagggctaccttatcaaggacggcaagcgtgatcaggaacaagtgcctccactgactatgacctatctgacaagagcatcaaccctctggtgtggcttcgatccactagtggtgtaaggtgaccaagtgagcttatgtcatgctgagaaggctgtgtggtgggaaccaagaagcgggtgctcaccctccgcaagtcctgtgctggtgcagacgaatgcggcgggctctggagaatgattgaccgttaagttcattgatcacctacctccaagtttggccatgggccgcttccagaccagtggcagggagaacgacaagcattcagtggggaccgactgaagcaaagcagccgaatcgctaatggaagaacggagcttaatgccaggaacagagttttgcagctttggtgtgggtctcaactaaacagttattttccactgaaataccatagacactaaaaatgccgggtgcgccaatctaaggagggggggccggatacaagggggttcccgaaaagtggcccaggtgatcaaacaggttgatcaccgtgaaacacaactttgtggttcccagggggacaaatag

SEQ ID NO: 524062 - DNA, 1021 bp, Homo sapiens
ttctttaatctattcgttggtgcttcttaaacatgtatagcacaaaccaacttcagttaccattccccgcaaaaaacccctaactttactctgaactttttttgtttttgcattccatagaggttctgtcttcagatcatatctctaggtaatgtcatataacgtaccacactactatttatataactcagctgattgacgactctaggaaaaagcactctctaaagaatattcgcttcccttcagaactacacgactcgacaatcttataacgcatggtgcctacagcatctatgtatgttctcttctaccaagtaccacaagattttacatgtaggagcagccaaggattataaaaccacttccctaaaggcaacattaatgcaaaagtaccccagatggcaatacaaagtatcccctgagtaacaacatatattccattctgtgagtacggatatagagcacattatctaacccaattcacgtagttcacaaaacaccatactaaatatctagagttcctgaataagaacaggatgacctggagactggagccactataaagttatgtacttctgacctaccaccctggaattatgcagtgagtgaacgaacctgctccacctacatatcacgcactgagccacatcccacacattgagcgtacggaccacttacacacactgcttcgcaaccaccctacaaacccccactgcaacatccacaacaccttccctcactattgccactaactgtctaaacacagtatgaggaaacgcagtgataccccaaataaagagcagcttgaaaaaaaatgaatatgatgcatcacccaaaactactcatagtgtcgtgaaaacaacatcaacaaaactacaaatgaaacaacacaacggatatcccacataacttaccctaataagcttcccccactagcatatacaacagtaaatacaaagacccaaacacagcgaccaagctgtcatctaataagagattaatgcaaagcgacatactatcc

SEQ ID NO: 524063 - DNA, 181 bp, Homo sapiens
tgttcttcagagactgacgtctgcactccagagaacaaagtaatgaaaatcaacgctatttatactaaaataaaaaggctgttaccactgtgcccatcgttgtttctctactgaatttgtttcacagtcggccttcctatctcaccttctcattttgcctttagttttttttcacctgata

SEQ ID NO: 524064 - DNA, 470 bp, Homo sapiens
  misc_feature (4)..(4): n is a, c, g, or t
  misc_feature (11)..(11): n is a, c, g, or t
  misc_feature (16)..(16): n is a, c, g, or t
  misc_feature (41)..(41): n is a, c, g, or t
ccancccccanggaangatatgtatccaaaatatctacatngatgctgtgatgaaaatagaaggcatgcatcttcaggggttttaagcttctcatttttttctttccttgatttctagccctcttctctatttctcatcatttcttttttctttactctctccctgtcaatatttattctgaggaaaggatctgagttaaaaacaaagtttcacttgtcttttaaactgtgtaaaaaattaactcttcctggaagatgagcatttcaaaatgagcaaagttttaactttcagtaaaattttgactactgtaaatagtccaggtagatttgggctggaaggtggataaaagttatggagtaataagtaacattatgtcatctagactaggccttaaatcaaactttttttgtgtttttttagtgggtttgaacctttaataaaaataaaaaatgaatgcaaaaagaaaaaa

SEQ ID NO: 524065 - DNA, 460 bp, Homo sapiens
agcatagaaaagagttgcataacctgggtgatcagtgcagagatatgtcacaatgtcccctgtaggcaaagcctaggcaagagttacatcacctttctcattagttcagggatatgtgaaatctcccctgtaggaagagcctagagaagagttacatcgcctagctgatcattgctctgatatttcacaatacccctgtaggcagatcctagacaagagctgaatcacctaggtgatcagtgcagagatatttcacactgccccctttggacagagggtagacaagagttacataacctatgtgatcagtgcagaggtttgtcaaaattccctgcaggcattgcttatacaagtgttacatcacctaagggatcagtgcagagatatgtcacaaagctcctgtaggcagaacttagatgagttacatcacctaggtgatcagtgaacaggtatgtcacaa

SEQ ID NO: 524066 - DNA, 360 bp, Homo sapiens
  misc_feature (9)..(9): n is a, c, g, or t
  misc_feature (21)..(21): n is a, c, g, or t
  misc_feature (23)..(23): n is a, c, g, or t
  misc_feature (105)..(105): n is a, c, g, or t
  misc_feature (219)..(219): n is a, c, g, or t
  misc_feature (227)..(227): n is a, c, g, or t
  misc_feature (254)..(254): n is a, c, g, or t
  misc_feature (284)..(284): n is a, c, g, or t
  misc_feature (327)..(327): n is a, c, g, or t
gaactcggntgcaatatcagntnggaactcaaaccatttctagactctacgcccaaaggaagacagacttttgagtggaagcgatacaaattacctgtggagcanaaaacgatctcctgttggcactcaggcttcctcctgctctaggtgagacctcgggacctgggtgggcctggccttcaatgccttagaggtcagacatggggcattgaagggccncttggctnagctggggccaactcactctgccttcnaagagcagctgactcatggtctgggctganggcctgcatctgcatagactttcagattcctttccttcagctnagacactaccctctgctgatgcaggggcctgcc

SEQ ID NO: 524067 - DNA, 230 bp, Homo sapiens
ctttgggggtcttcgctctatttgtctttaaggaaaattaattcaactttttttttgttctgtccgagatttttatgagatatctctcacttgtcttccacttcgaaccggttaaagctcatagctgtcagctctgactgaggaggacagaagcccctgggtctttctttgaacggaatcagatgcttgaggtctgcctccctcatggagtgcgtggcgcttctcttcct

SEQ ID NO: 524068 - DNA, 582 bp, Homo sapiens
ggggccgccgacacccgcctcccaccatggctctgaagagaattcacatggaatggactgatctgacacgggaccctccagtacagtgatcagcaggtcctgttggagatgatatgttccattggtaagctacaataatggcgccatatgacagtccctatcagggtggtgtatttctcttgacaattcatttcccaacagattacctgttcaaaccacctaagggtgcatttacaacacgaatttatcatatcaaatattatacatgtatggcagcatatgtcttgatattctacgatcacagcggtctccatgactaactatttgataagtactcttgtgcatctgttgtctgatgtgtgatcccaatgcagatgatcctttagtgcctgagattgctcggatctaccatatagagagaagtacagcagattagctcgagaatggactcagaagtatgcgatgtaactaatgatgttattgcataacctctacagatgagaggtgaactctgaggacctaattcaatatgttgtgatgttcttattgagatggtcaccagtcactgacgctcagtttccc

SEQ ID NO: 524069 - DNA, 783 bp, Homo sapiens
gagtatactcagcttctctcccatcccaggctgtgtggagccaggtcccccacactcctcctatggcgctcttagcaacagcaatgcccatccaggccccttccctccctctactggggcccagtccacggccacccaccagtctcaacacatcaccatcaccaccagcaacagcaacagcagcagcagcagcagcagcagcagcagcagcagcagcagcagcagcagcagcagcagcagcagcatcacggaaactctgggccccctcctcctggagcatttccccacccactggagggcggtagctcccaccacgcacaccttacgccatgtctccctccctggggtctctggagggccctaaccacgcaagggcgcagcacacgctgcccccacctcacagcgcgaggtgtactacagacaacgcgaggccgccagagtggtcctccagtctcttcctcttccaaattcttcctcttccacttctcaagggtcctaccccatgttcacacctcctccccttaccagggtcctcaaggggcgcacctacccctttaccagccggtgcctactggtcaccacctctttccggctacccttaccacggtcaagtcgcaccgtgtgcttcctcgcccagccaggtacaaagacggccttccccatgctggggcccccaccgtaccggcacccgagagccccgtctccccggggcgccctacaaagaccaggcacccaacccggataccaaccccgggggtccgcctccccttccttccgaacggg

SEQ ID NO: 524070 - DNA, 843 bp, Homo sapiens
tggcagaaaaaggtttggttttattggcaattatttaaagcgcgtcccaagggggaggggaaggggggggtctcgtggtattaaggtggaaacattgttgtggagctggagactcttttgggaaaaaaagcaaaaacacaaattcctttcagtcagcaggccccggcagagcagcaaaggccctcgccccggggtgtgccgggcgctcgctcgcttctctctcgtgtctctctcgtggtgtctctctctctctctctcgtgtctctgtctcgtgactcttctctcacattcttcgtgggctctcttttcccccttatctttgcgtgccaggaggcccccgagataccgtgggtgggcgggggccaggagtgggggcctcaccggggcgtggggcgtgatttcggggcaagggcgaggaccaccctccaggtccacgtgaggctgggggagctcggggcaggctgaggcccagggcccgtgcgggaggggtcccagggtcccgagacaggcaggaaggggctcaaaagttgctgaagattttcacgcttccgtgtccagtccatctgttggcgcgcgcttgtaaactcgctgggctcgagccttctcctgggcctcgggccgccgtgggggcccaggtggaggccgttctcctcagtgtccttgtccggaaccaggcaggtcactccgggacgaacacgcagagccccattgacgctgggcagggcgtgtccccttgcggaaccggtaaaaggacaaggaacctctcagtgcccacacgggggtgtgaacccaagacctttaaggtgacctgtttccgggcccaaccagaacgggaccaacacg

SEQ ID NO: 524071 - DNA, 114 bp, Homo sapiens
  misc_feature (90)..(90): n is a, c, g, or t
  misc_feature (105)..(105): n is a, c, g, or t
ctactctacttttgtctcatgaattgcctattctaggtaaatttatataattataataagtggagcccacttatatggcatcccactatntgtcctttggtgtgntgggcgata

SEQ ID NO: 524072 - DNA, 436 bp, Homo sapiens
cacgagggtcgatgccgacgggaaagcgcttgatcgagaggcgatggtcgaaggcactgacgcgcccgtcctgcaggatgcgccccgagacgctgtcctccaggaactggatgaggtttgcgacatccgcctgcgtctgcaacccgatgaggtcgtaagcggtgagggcacgtgccagctcgcgatactctggaatggcgagaaacgtctgcgaaggcggcacggggatgtgcagatagaatccaatcggattgtccacgcccgcccgtctcagctctgccgcaagcggaatgaggtggtagtcgtgaatccaaatgatgtcgtcgggctggatgagggggcggagcgcgcgggcgaaacgctcgttcacaccgatgtatcgagcgtagaaaccggcatcgaattgcgcgagatccagccggttatgaaataccgg

SEQ ID NO: 524073 - DNA, 325 bp, Homo sapiens
gcgtcgaccacgggaaggctgttaatgtacactgaaaattgtgtggcagcaaaatgagatactctcagccgcacagtttatctaggggcacctgtataaaacaggcctcatgtagcattaaatctcattttatgtgatcagggtttatctttaaatgggccactcaggattcatgctataagacttttttactgagtttcaagagaaggtccttccacccttcacccaaacccttataatgcaatttatcataaaatttgcctagattttggccaaattagcactgtatatgtcatgtgcatctggtatatataaaggaccaaaa

SEQ ID NO: 524074 - DNA, 330 bp, Homo sapiens
  misc_feature (41)..(41): n is a, c, g, or t
aggatctcgaatcagagcatacccctaggatcaagttgtantttcgaaatgtgtaagatgtttaacttgtagatacttaaaaagtatgaactactataaaatctgatatatctaatttaaatatagggcgggctgtgtggctcatgcccagcactttggaaggccgagacgagtggatggtttgagttcaggagttcgagaccagcctgagtaacgtggcaaaaccccgtctctaagaaaaataacaaaaatcagccagttgtcgtggcacatgcctgtagtcccagctactaaggaggctgacctggagaattgcttgaacctgggagg

SEQ ID NO: 524075 - DNA, 1454 bp, Homo sapiens
aagttgtttaaatgtattcgtcggatatctatacgtattgcctcgtatccgtcttcatgacaatggaacgccgatgccatgagcttgagtgccatcacttctacgtgtgcaagcagcatgctgtgccgcagatggatgactgaagagcgaacctgagggtgacaggtgactgacaacagaccattctacgactctatccttgtgtctcgctgtggcgtaccccaatcccagcccaggtgtatgctcgttgcggtcctcattggacgcgcttgttaacgccaaggtattgagagccatactgtccgtttgaatccaaatggtccaccctacaactgcaattgaatacggtgccacaacggacagtcatgtcatgtgtggatgctgatataactctcctcgagagtcgacatgacaatactgtgtgaaggcggtcctcgcgagaggtgcttgattgccaccgcaggcgacgtcacgtggagagcacctcatagtgcccaggcttgcaccgaaggtattatgccggcgctgactccccatttgtctatctgattaatgtcattcccgagtcatcgaccgtgtgtgaaccgtgtcatgccacagacctgggcccaaagggcttcctagtctgccataagatcggtctcatgtgtaacgtgctgtgggagcagaaagacattgtcagagtggatgacgccacagatggtgaacctgtggtaagcaggcggatgaccgttcgatggtttggtgtaccaacaccccctgtgagactgcaaggcatggttttggcagggcacgagcacgccaggcaaaattgattggcaggcctagcgaatggctcattggacccagaggatcggggcggcaggggaatatggccttggagaccccttggacttgccattgcaaccctatggaactgcacttcccaagacacacggattattcccactttcaaagttaaaccaggaagctttgcatctccccgagggtagacgccgggatcggcgggcgttgagaaggccccttctctgtgtggtcccccggggacgccacccctttaaggcagtccgcgttggacattatcccaactgagtggggggagaaacgcctcagccccctgggttggccccagttgttgttccagatggcgtacagaacatacaaaatcttggtttaacattccagggaatacttcccacttggatggcccccaattcccacccggttttgaaccctggacgccaggtttgggacgttttatcacgaacgggggcacttgtaccccccgatacaaacagagtagtgtacaaggttggcattaggatggaaagggagatatcggcaagtttcaacatgtcgaaattcactttgggctatcagtcttacgcggtggggtatgagtgtaactaaaaaatttttgaaggaaaaacaaatagaagagagtagaacaagat

SEQ ID NO: 524076 - DNA, 174 bp, Homo sapiens
gctctatcctggcagcacacagtgaggcgacgccctgttgaaatgaagcattgacggctcctgtctgaagctgtctccatcagtccagccacctggtgtcactggtatctgcgaacatttcctgatactccatattttgtgttcaaaaaatgtatttggaggctgtgctgcctg

SEQ ID NO: 524077 - DNA, 156 bp, Homo sapiens
tgctctgagccctaggattcatctttcttttcaccgtagggccctgactggcattgtattagcaactcatcactagacatcgtactacaaggcaagtactacggtgtagccacttccactatgtccctcaataggagctgtattgccactaaggag

SEQ ID NO: 524078 - DNA, 829 bp, Homo sapiens
  misc_feature (7)..(7): n is a, c, g, or t
  misc_feature (76)..(76): n is a, c, g, or t
  misc_feature (78)..(78): n is a, c, g, or t
  misc_feature (155)..(155): n is a, c, g, or t
  misc_feature (160)..(160): n is a, c, g, or t
  misc_feature (164)..(164): n is a, c, g, or t
  misc_feature (224)..(224): n is a, c, g, or t
  misc_feature (269)..(271): n is a, c, g, or t
  misc_feature (281)..(281): n is a, c, g, or t
  misc_feature (288)..(288): n is a, c, g, or t
  misc_feature (296)..(296): n is a, c, g, or t
  misc_feature (406)..(406): n is a, c, g, or t
  misc_feature (431)..(431): n is a, c, g, or t
  misc_feature (471)..(471): n is a, c, g, or t
  misc_feature (478)..(478): n is a, c, g, or t
  misc_feature (500)..(500): n is a, c, g, or t
  misc_feature (539)..(539): n is a, c, g, or t
  misc_feature (574)..(574): n is a, c, g, or t
  misc_feature (584)..(584): n is a, c, g, or t
  misc_feature (589)..(589): n is a, c, g, or t
  misc_feature (592)..(592): n is a, c, g, or t
  misc_feature (601)..(601): n is a, c, g, or t
  misc_feature (642)..(642): n is a, c, g, or t
  misc_feature (657)..(657): n is a, c, g, or t
  misc_feature (669)..(669): n is a, c, g, or t
  misc_feature (685)..(685): n is a, c, g, or t
  misc_feature (687)..(687): n is a, c, g, or t
  misc_feature (692)..(692): n is a, c, g, or t
  misc_feature (697)..(697): n is a, c, g, or t
  misc_feature (708)..(708): n is a, c, g, or t
  misc_feature (728)..(728): n is a, c, g, or t
  misc_feature (781)..(781): n is a, c, g, or t
  misc_feature (783)..(783): n is a, c, g, or t
  misc_feature (820)..(820): n is a, c, g, or t
acagagncaataaagaaatagccattaacccagtaaaccaagtgtactgaagtagaaaaaatgcaacaagaaaaananctaaattagaaagaccaacactttagaaaaagagtaaaacactttcactctactcccctttaagaccctaaaacaanatctnacantctggatctggaaaaaaaaaaaaaaaaaaaaatataaatatactaaaatatttgtcaggngggaaaaaataaaatgacactggccagtacagtctttggctattnnngccgggggcnggggganagtcagtnctcagaacaaattagtcagcttcagtctcgtcagcagggtctttgggttctttgttcttccgcacttcttcaatgtgcttatccttctctcgcaaacgttccagtttggnagccatattgtgcctctcggttctntttattagcttccattttgtgggtgagtttctcttctgcnattttantgaagttgttgttctcttctantgccttctgaagcacttctttctcgtgctctcgtttctnagccagctgcttcaagacctcagcttcatgggacntgcgtctttnttctncancttctaatntcttctgaatttcctccagggaaagatccttcttctttggnggggaaagggggaantctggaacagantcttttgaacgagggntnagaancagcncaaaagcctgncctgaggcacgcttctccantactttcacctggatatcagaagaagccaaggagaatagaagacaagcgacangnagtgtattctgcacaatcaactgggataaggaaagtnctgctcagt

SEQ ID NO: 524079 - DNA, 361 bp, Homo sapiens
  misc_feature (250)..(250): n is a, c, g, or t
  misc_feature (262)..(262): n is a, c, g, or t
  misc_feature (359)..(359): n is a, c, g, or t
cgcgtaatacctggatgccctatcgcaaaattgttacacgtttgacatggatcagcacacaggctggtgtctctcaaacaggtcaaccagataaggcctcacttgcctccctgtaaagcaccgcattactgcgctctggaatcgcagatctgttttaaagtcctgagcaatttctcgcactcagacgctggaagggaagtttccgaatcagaagttcagtggacttctgataacgtcttatttcacggancgccacagtacnagacctgtaacgatgaggtttcttcaccacctccagtagaggtcgcactcttgcgagcgacttttgacagcgttgcctgtagttgcacgaggtcgtncc

SEQ ID NO: 524080 - DNA, 528 bp, Homo sapiens
agctgctagacgactccgttagccgcgttgagacacaaattggtaaaggcatcatgtgacactcgcctggtagccatagagaccatgctgaacacaaaagtccagcagtctggaatatccccagcgacatttaataacatacgtgccacggacggacatacatcgagaagcagaaccgtggtagaatagtacctgatgcacagttctaataaggtgcagtgatcgacgcggtctcattacagctcaggcagtcctcgaagcgaaattgcagagcgctcaaaatttactgcgccatctcatgcggggaagactaccagcaagtcaattgctacatcactggtcacattaggaccaacactttaaaaccatctatggcaaaaattaatgggcctcataaactgacacgtccaattcatctgataagcgccatgcatttcgtacctcgacaactcggcccgacgaacttgaaagcagcgctcgtgccacggtaacatactcccctttccaccttgtctattccttcacttg

SEQ ID NO: 524081 - DNA, 245 bp, Homo sapiens
gtcctcagctggggagacagaaactccatctccaaaaaaaaaaccaagaaagatatcagcgtacccatagtaatacaaaattccaatgtaactcccatcaaaatcccaagggtatatcctggcagattttccaaattatatatatgatttctaaattatggtgagggatttctggcaagttaatccaggtcacggttacttaataacaatcgggctctttttaaaaatttttactttaaaatata

SEQ ID NO: 524082 - DNA, 1064 bp, Homo sapiens
  misc_feature (885)..(885): n is a, c, g, or t
atcttgtagaatggagacctgcggatgaggtgtggttccggctcattcagggtagaaagggtggaaaatccgcttgggggtatttgggccgaatttcaagatccgggtaatgtcagacttgcctgcggatgagccctgtcaccggttcccttcagagatgccaagacaaggggcctgttggggacgaaaccggacctcatttctcaggtactgctggcgactaccggccaattgccaatttgccgtctccgtaactcaattgaagaaagtgtttgtctttcgcaaatacagggaagcgctccttttgtgttttctctcgctgtttgttgaggctttcctgtccaggagtggtttctggggagggccaccccatccgaagtccccacctttatgtagacctttgggtgctttaatttgggctggtgagaactcttctatagtcctggaggacagttctgagcttataggccaatgaggtcttcatatacaacagggcctattcctttagtgattggcctagtcccaccaactgtaacatccagaatacatcaggacagtagagctcgcaatacaggagagcatgtgagaattgaatggtctcagaacctgggtagttctggcacatcagtgataggaacaaggcatatcgttcatgtgtcttatatgtgtgaacacgactgtctggaatgtgttgtctctacagagttttcctggcatggagtgtagacccccacactctcccaagttctgtctttcgcctacagcgtccgtaaaaatctataagggggaccattcccagggtggtacctgtggttgatatatgaacagtccttgtcccacacagatctccacagagtttcaaagcccagtgttgaatgagtctcntgtttgaaatttagattagacaccaccaattgggaagggcaaagagcagacagcctcaacagtggtggagccaaccatgaacttctcaggaatgtgacctgtgcttccttaaggcagtttctgttatgtgtatccttctaagaccctgcatttcttaatcaccgacggatcacgtgtta

SEQ ID NO: 524083 - DNA, 140 bp, Homo sapiens
agttgttacctcacagtcagcctgggataggaaaaaatattaagagcactttgtcttgccgggcgcgagtggcatcacgcctgttaccccagcactttgtggaggccatggtgtggagggtcacttgcagcctagtttgt

SEQ ID NO: 524084 - DNA, 747 bp, Homo sapiens
  misc_feature (22)..(22): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (157)..(157): n is a, c, g, or t
  misc_feature (192)..(192): n is a, c, g, or t
  misc_feature (249)..(249): n is a, c, g, or t
  misc_feature (261)..(261): n is a, c, g, or t
  misc_feature (274)..(274): n is a, c, g, or t
  misc_feature (282)..(283): n is a, c, g, or t
  misc_feature (301)..(301): n is a, c, g, or t
  misc_feature (365)..(365): n is a, c, g, or t
  misc_feature (395)..(395): n is a, c, g, or t
  misc_feature (402)..(402): n is a, c, g, or t
  misc_feature (412)..(414): n is a, c, g, or t
  misc_feature (471)..(471): n is a, c, g, or t
  misc_feature (499)..(499): n is a, c, g, or t
  misc_feature (512)..(512): n is a, c, g, or t
  misc_feature (531)..(531): n is a, c, g, or t
  misc_feature (609)..(610): n is a, c, g, or t
  misc_feature (641)..(641): n is a, c, g, or t
  misc_feature (644)..(644): n is a, c, g, or t
  misc_feature (738)..(738): n is a, c, g, or t
ttttagttcaacataaaatganaaaaaaaaaatatttctgacattttcaaagaacagaaataggaaagtatgttcatatacattcaacgtatactgcacatattggttacnanaaaanaaacgcaatgagttttttttaaagtgtagtttgcaaganggcacggttagtaggctcactggctttcatctgtngttgctggagggtgcagtctgctctcccatacatacagtaccatgtaaacacatcangctgagcgcgtngaggtggtagganaggttggnngcataagagttggaacangcgcagataagtcaacagctttttagggctttcttggtaagcccccttctggtgagtagttggngaccccaccaagtggaggggggactggggnccatggnaacatgggtnnnctcccacgaagggctcttgcactgctgaattcctctcttgggatcttgggtccatgngccgagctgcctgtttcagtggtgaagntcaaggtgtatgntgtttccgtcagtaacatnaggttggccatgccggtgcacccgcttttcctctgtgcaaatttctaggatgaaagactagagaggggtactcggtgnnctctttgctctccttttcccagtaaaaaaanagnggtggaatattcaagttttttcaaaggtctctctcttgtttttgtagatcagaagtgagataacccagaccctctctcagtcccagccagcagngaagacttt

SEQ ID NO: 524085 - DNA, 1042 bp, Homo sapiens
  misc_feature (390)..(390): n is a, c, g, or t
ggctgacgccattgtacaccgtcagcccgatctgtacccaggccgcatcattagaacagcggtagtcgcgtccacaccggccttgtgatgttcgttaccgcgcatcttggaggattctgaaccgaatacacgcgaggcgttggcagactcatttcagtgtgtggtcaatacatattcacttattttgtactctgcagaagtgcacagattacctatccaactgatctattacaagagcgtgtgagcaactcatgaaagttcgcataggccaaaacactgctgaagtcgagcgtatcgtctgcgtcctcgtctacactagtgcttgtgaggtgactagtggcaatgcgtccgcatgctcaactcgcagacactgtgagatctcactgatgncgtgacatgcgcagtcctttcctcactctccagtcctactccaatacattacatgagcacaacgtaccactcgtgataggagtttggcaaaaaagtgtatctgaccggtgacagagaactggccaggtgatgcaaacgactttcaaacccacctaagtactgaacatcactgacgaacaggctagttatactactcgctagatgcacttgtcattagccctccagtctaccttcacatcaatcaagcccatcgaagactggcttgtccgttctactaacttgggctggttttccgtgagactacagaccctcagttcagccgctaaattgcatttctacttcactattcttattgatgcactccgacatttaccccatagaggacagtaccttcgctttaaaactcaagattacaaaatcgtgtactcccctataagcttatcacacagattcttccatgttcctcaatgtctgttcaccctttgaagccttctgcacaaaacaaaggtctccgtacttacttgccagtgagacctggttctttcaccattacagattaacccatttagtcagttgcattccttgaccttcctaacgcgcaaggtcttccatttcttggagttgaagcaatctccactactataatgtgaca

SEQ ID NO: 524086 - DNA, 146 bp, Homo sapiens
ggctatagcggctaggacgctgtggctgggtcggattcgcgtgttctcagtgaagtcgtcctaaggcctctggaggtccagatcactgcttggggccggaagtctgtctgcccttccctacccatctgaagagctgtggtttgggc

SEQ ID NO: 524087 - DNA, 403 bp, Homo sapiens
  misc_feature (41)..(41): n is a, c, g, or t
  misc_feature (101)..(101): n is a, c, g, or t
  misc_feature (116)..(116): n is a, c, g, or t
  misc_feature (277)..(277): n is a, c, g, or t
  misc_feature (297)..(297): n is a, c, g, or t
  misc_feature (388)..(388): n is a, c, g, or t
  misc_feature (394)..(394): n is a, c, g, or t
ccaaacaggaggaagcaggtgaaaaaactcatcacagcgantgatattcgtgaagcacacgcgcgcggcgaacaggcaatgtccgtggttctgcgcgccanattattaccccggangcccgtgaagtagcggatctactgggttttaccatcaccgaatgtgatgaatcgatcccggtaacgcgtccgtgcccgacagcgtgccagccgacaaaaccgaaagccagcgcatccggaaaccatcattgcccagctgccggaagcagtttaccgaaagnctggtcgcacagtgatgganaaagtgatgaaggaaaacagtcgctggagcagggcgcaatgcagccgagcttcaaatcggtgaccggcaaaggcggcatcaaagtgatttntggcantagcgtcaa

SEQ ID NO: 524088 - DNA, 105 bp, Homo sapiens
ccggggttggttggatggtttttgtttgtttgtttcgagactttctccggctctgccgccgggggctgcagagcaatgtcgcgatctcacctcactgcggccttc

SEQ ID NO: 524089 - DNA, 694 bp, Homo sapiens
gtggtcttcagagattctccccgcattattatgtagtttgttcagaagctgttgctactgcgtctctctgtctgcagtggggcacttgtacctgaggtcctcgccttgggtcctgacattctgtagtttctgtgaagaacgtggcttgtcctgtgggctccttgatgctgttgctggactagctgccactgaggctcctgacgacatgcttgccccattaaccttgcataagggtcatgggagcccagtgggcccccacagaaaaagcaattgcgcttgacgggagacccccttatccacaggtaacgggcttgtccccaagatggcacgccaaaataccaaatgggcggtgccacgtgttttctccatggggcacacacctctcaggcctctgagtacgccagaactggcattcacactacatcaagtaaacccccagtttctcaaagcaactttgcaccacgtgttgcaaacagcagcagggctaccaaggggcgtatatttctacccccataaaaggttggcacagggtattaaccctcactgtgcacatgcatgatcaagcccccaagggcatggcaagccaaagagttggtgcatggcaagggctaactcttcgtgctcccttcctaagggacccaggtagacagtagctggtgcacagacgatgctagtggtagatactactgggatg

SEQ ID NO: 524090 - DNA, 198 bp, Homo sapiens
cgcggacggacaggtcagatagcagaggcataccatgtgacatggtttggctgtgtccccacccaaatctcatcttgtagtacccattatgccacacgggatatagtgtgggggatcacttcctatagactcgctgtgcacaggtgtgcgcttgtgactgtggcgcggtgttacacaacggaaaaaactcttaaccgg

SEQ ID NO: 524091 - DNA, 777 bp, Homo sapiens
gtagacccttgtctcagaaaaaaaaaaaaagaaaaactggcagatgggggactcttacgagggatagatgggaaaggtcctaaagtaaaacacacttgggatctgggcaatatatatattcaatggtactattctggaccaaagggggcttaatcagatagctggagaatgatttaatggtgaacgaaatctggtcaatggcattaatctcacataatagatcgggggaatacctattataaattctctcaacaaatcctggtatttggatttacaaaatgggatggggaggttccagggagagcagtgggaagcctggtgtgctcacctggttaggaaccgagagtgggcaacagcagtgggggaggagtggctccggactccctggcacctggtctcgatgggcagagcccacaggctagggctggacagacgtggggatgacaggaaagagaagcctctacatctcttcccacagcatggtagtggcgattatcatggcaagacagtccaaggcagggttcccagggacaatgggtggtaacgacagcgctatgggaccaagagaaccgtctaaaaaaaaccgggaaaattggacatacgagggattttgcgccctgtgtgagctaaagatcttcacgcaagggctggtgcgcagttggacacgcatggtcctgggtagctgggggctcgctggggcaagagccggggacgcccaggatccagcgcactggggccactggcgcctgggggaccctgggtcatctaaggcgtgtg

SEQ ID NO: 524092 - DNA, 119 bp, Homo sapiens
tgggagaccattaagcatctgcaggaacgcgctggagttgaaaagatcttaattcaggacggtatctcacaatacgaatgtggactaacctctccgcatcattggggatccttacaaag

SEQ ID NO: 524093 - DNA, 233 bp, Homo sapiens
atccaaagaattcggcacgaggctagaaataactttggcaaggagagccaaagctaagaccccccgaacccagacgagctacctaagaacagctaaaagagcacacccgtctatgtagcaaattagtgggaggattattaggtagaggcgccaaacctaccgagcctggtgtatagctggtgtgtccaggtatagatctctaaagtttcactctctaaaatttgccccacaga

SEQ ID NO: 524094 - DNA, 323 bp, Homo sapiens
atcatgccactgcactccagcctgggtgacagagggagactccgtctcaaaaaaaaaaagagaaaaataagcctctagggcaggatccttccagcctcttctggcttttgggggctccaggtgtaccttggcttgtggctccatcactctagcctgagtggagtgagatcctatttcaaaaaaacaaaatgtgcttaaccacaactatcagaacaaattcagtgagagtataaccctgtcaaaatgagaaaagtttttttaaaaagtgactaaatgtggagtaaatttctgtagggatggaaaggagggtaatatacataaaa

SEQ ID NO: 524095 - DNA, 454 bp, Homo sapiens
tctgccatatgaagatgcagtaagaggatggccatcttgggcagggcacactggctcacacctgtaatcccagcattttgggaggccaggatgggaggatagcttgagctcaggagtttgagaacagcgtgggcagcatgctgaaatcctgtctctactcaaaaaaaacaaaatagccaggtgtagtggtgcacacctgtggtcccagctactcgagagagtaaggcaggagaattgcctcagcctgggagatcaaggctccagtgagctgtgattgcaccagtgcactccagccaggtgacagaacaagcccttgtcaaaaaacaaaacaaaacaacccatctgcaaaccaggaagagagtcctccagactttggagctgctggcaccttgatcttggacttctcagcctctagcacttgtgagaaataaatgtgtgttgtttaagccaaaaa

SEQ ID NO: 524096 - DNA, 857 bp, Homo sapiens
ggtgagtgttgctgctatgagagagacaacaaaaaacagccacaatagacgattctgccttcaaaggttggcttgccacctgaagcagccactgcccaggggtgcaaagaagagacagcagcgcccagcttggaggtgctaactccagaggccagatcagcacatgggcacgaaggagccgcctgggaagggaccatggcacgagcacatccctgggttggcttgtgcgtactggggaccctggtggggctctcagatactccaggccccaagagctgaccagagagtcactactgggctcagggcaaagctgtgctgccagatgttggtgagccaggaacattcctcgtgaaggactgtgaccagatagaaaggctgactcagtgtgatccttggcataccgggggtctccattctctcctgacaaccacacccggccccatctgtgagagctgtcggactgtaactctggtcttctcgtacgaaattgcaccatcattggcattgctgagttgtgcctgtcgaatggctggcagtgccagggacaaaggaggtgccccgagttgtgatcctcttccaaacccttcggctgaaccgcatcggagtcgtctcagggcccatgagccacgacccatcaagcgacccatttacctataatttcagtgacgaagcatggagggcacggcacaagtgggaacatgcaagactagttgttaattaaggcacgatgcttgccgggaatctatttagccacgggtcaccccaaagatccttaggaagacccacataaatagagatcgagaggatctctctggaagtcttggtatcccctggcgggacatgtcctcctcacgaaa

SEQ ID NO: 524097 - DNA, 336 bp, Homo sapiens
taggagcgttgatgtccttcggatgtttgtctcctccaaatctcatgttgaaatttgatccccagtggcagacttggggcctggtgggagatgtttgaatcatgggggtggatccctcatgaatggctctgtgctgtccccacggtaataagtgagttctcactctattcgttcactagagaactgattgttaaaacaagagcctggcactttcctcccctctccctcttgctccctctcttgccatgtgatgtctgctccccttctctttctgccatgattggaagcttcctgaagtcctcaccagaatcaggtgctaatgccatccttcttgta

SEQ ID NO: 524098 - DNA, 1324 bp, Homo sapiens
cccctgttttgtttgagaccgacttttcttggggcggcgcggtatagtttctctcgccgccgccaagtttggtcctgcccttttccctctctccctccggggtggatcccccccccctcctttggttccctgcgaggcggcgcgctccccctcccctgtttgggctccgctgctccccctcccccccagggggttggccccccacactccctcctccacacccagcctctccgtcggcggccgcccacctgcttgttgtcgtggggagaatgtagttgtttttgtgctgctccgggcggcgcccctctggtttcgtcgcagcccccggtgaggcccccacccgcttgttgtgtgttgttgtctcacatcgtgtgtggtgtccccgcgtatttcttcttgggggaggggcgccccccctgttattagaaggcccccccccccgcggtgattttctctggcgccgccaccacccccccccagaggcccccccttattagaggagagaggcccacgcgtcgcaacgtcgtgcgcgcaagatgtctcgcgccccacgccccaccgacaggggaccaccacgtgtgaaaatgtgtgtggtggtgttccacacgacgaagaggcccaactcgcgacgagggagaccccccccccgagaagagcgcgacgtctcactcgtcgtagggcgcgcgtgttttgtagacccacagagttttcccccgcgcctcacccttctctctctcgctctcgcacactctcgtctctcggccccgcctctctttctctctccccggcgcgcacacgcggccacaccctcatcacacttctatcactcttgtagactatccgcgagagaatttgggggcgcccgccgcgagaagaaagagagaagagctctatcacacctcttggagagttattccgcgctatccctcggagaggagcccgcggagacctctccacgctggagacacaccgcgcgccctctctcctctctatactccacccccctgctttctctcgccgccactctgtcttgagtgtcccccctcgcgcccacgcgtgtgagagagggccctcgccccctcgcgagaagactctcgcgagagggagaggccccaccaagccccgcgggcactatccccctctcttcccacggaaaccacagcggaagggggcaccggaaggtttttcctctctcaagccccacccctcgggggccccggggcgcaagggctcgccccctccctcccctcccccctgggggcccttttttggtaaacccattttccttttgggaaatatttatgaattaatagttttatatgaa

SEQ ID NO: 524099 - DNA, 375 bp, Homo sapiens
gaactttcgaagctcacaagagactgctaagaccattaattttaattgacaaaggacggtcggagactaaatgaccccctatcctcatgctgtattaacgcagcagtagcagcttcttcttttatcttttctctttatttgctactccttcattctcaggcctctctacgagctagcatgaaacatagaactcttagcctgtatccttatcctactcgggatttttcctttttctccagtagaagggaaaagcccatgatcttcaagcagggaatccccattgagtagctgcattcctagaaattgaagtttcagatctacacgaacactttttctgtccctaccgttctctcacagtaaagcgacaaatcaggc

SEQ ID NO: 524100 - DNA, 472 bp, Homo sapiens
  misc_feature (1)..(1): n is a, c, g, or t
  misc_feature (38)..(38): n is a, c, g, or t
  misc_feature (49)..(49): n is a, c, g, or t
  misc_feature (60)..(60): n is a, c, g, or t
  misc_feature (458)..(458): n is a, c, g, or t
ntccacctgtgatatttgccagtttggtgcagaatgtnacgaagatgcnggaggatgtcnggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataatgttcataccaaaattcatttcaaagaatgattttagtctttgtgcaaaaatgaaaagtgaagaaaactccttattaggcagctattccatttccaaaatgcagtgcttatttacaatggatagtagagtctactgtagcatttgtgtcgattataggattttgaggggctctcagcaaccgtccagatctgtctctatacaatgggactgtattgtcacaatgccataaacacaggagccatnttcacaggtagcag

SEQ ID NO: 524101 - DNA, 344 bp, Homo sapiens
  misc_feature (1)..(1): n is a, c, g, or t
  misc_feature (38)..(38): n is a, c, g, or t
  misc_feature (49)..(49): n is a, c, g, or t
  misc_feature (60)..(60): n is a, c, g, or t
ntccacctgtgatatttgccagtttggtgcagaatgtnacgaagatgcnggaggatgtcnggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaagagaaagcaagaggaaagtgtttgctactgagtaatcctgcattaataaaaaaataaaaataaacagaga

SEQ ID NO: 524102 - DNA, 941 bp, Homo sapiens
  misc_feature (1)..(1): n is a, c, g, or t
  misc_feature (38)..(38): n is a, c, g, or t
  misc_feature (49)..(49): n is a, c, g, or t
  misc_feature (60)..(60): n is a, c, g, or t
ntccacctgtgatatttgccagtttggtgcagaatgtnacgaagatgcnggaggatgtcnggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaa

SEQ ID NO: 524103 - DNA, 452 bp, Homo sapiens
gcaacggagtatgcggtttgcctgctagtctggggcagcggcgctgacgagcggctcccaggtcgaccgtgatccgcgtgtaccgcgactgcgtactgcagtgcgaagagcagaatcgctctgggggcgctctgaatcacttccgctcccgccatccaatctacactcatgtctagcaggctgcacctttcgtgactactgtaactctgacgtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgttaccgcaccttcgtgccagcctcctcccccatgttccacacctgtgttgccttcgcctgggtgtccctcaatgcatggttc

SEQ ID NO: 524104 - DNA, 116 bp, Homo sapiens
  misc_feature (86)..(86): n is a, c, g, or t
tcatcgaaaccctgaaattaactgctaaagtaatttctttcaagtaggaaaatttacgccatcaacctttgtggcacaaattaggntgaaaagtaggtttaaaaatgggtgctgaa

SEQ ID NO: 524105 - DNA, 218 bp, Homo sapiens
ggtcgacttggcacactagctggggcaagtgctcagacatgctagttttgctgtcgtacctcaaactgcaaaagtttgtgcataataagtgcttaaactttatcataggtacctatgaacttataagaaaaaacatagtatatataggattcggtaccatctgcagtttcaggcatccactggggggtcttagaatgtacatacccccaaggtcgacg

SEQ ID NO: 524106 - DNA, 203 bp, Homo sapiens
ctagactactatctataaactagccatacacccccttatgagcgggcgcagtgataataggctaatcgctactaagattaaaaatgccctagacaccacatacattaccacaaggacacacctacaaccccttatccccatactagttattatcgaaaccatcagcctactcattcaaccaatagccctggacgtacgcctaa

SEQ ID NO: 524107 - DNA, 300 bp, Homo sapiens
  misc_feature (24)..(24): n is a, c, g, or t
  misc_feature (68)..(68): n is a, c, g, or t
  misc_feature (70)..(70): n is a, c, g, or t
  misc_feature (150)..(150): n is a, c, g, or t
  misc_feature (183)..(183): n is a, c, g, or t
tttacaggagtaagaagtcctctnttgcatggtgagatggggaacatttaattcaatagaaatatttnanaccgggtatggtggctcaagcctgtagtcccagcgctttgggaggctgagttgggtggttcacctgacatcaggggtttnagactagcctggccaacatagcaataccctgtntcaaagatacaaaaattacccaggcttggtggtgtgtgtctgtggtcccagctactcaggaggctgaggcgggagaatcgcttgggcctgggcggcaaaggtttccagttacccggg

SEQ ID NO: 524108 - DNA, 235 bp, Homo sapiens
gtaaacgaggcagagtacccgaaggggagagttagacgttagaatggagactcacatgaactatgttcatacagacgttgagcgtatataagtgtagatcgtctctttaataaagagatcatgggcgactgcaatttctaactcatacatcatggctacaaaccttatttgtttactgtttctcttccaaggaccatcagtcatcctttaaaattcatttcaagagtacaaccgg

SEQ ID NO: 524109 - DNA, 156 bp, Homo sapiens
ggaggccgcacgatgcctggagttactgtaaaaggacgtgaaccagcaggagtttcgtcagagctctggcagccttccttcaaaggtccgggaggctgaaggttccgcaatggtgggataccctcaagctggccagcacaaggagctttctaccta

SEQ ID NO: 524110 - DNA, 828 bp, Homo sapiens
gagtgactgtggcattaccttgaggaatgatctgataggttccaacttttctgcttagttctgggcatgtgtgttgggagtcgcggcacagtctggcagatgtcgagagaacatagcagtcggttgatttaggtcgtgtaagtaggaagaggacgagttttgaagagttcccgtgtccgaagagtgtggttgtgggttgatgatgtaagtatgaagatgcttacatgtctggtgagtgataattcggtatgatgacataatgtggaggatgacttctcttaatcagttaggagcggaactaaatagaggtggttattgggatggagatttcataacgcatccatgcatgaagtcgttagaatgtaggagtcttaatatattgtacactgtcttctatatcatttcttaggtgcaagatgatacactgtgatgggatcatctaagtaaaaggtgtgaatatcatgattctgcttgggtattcatgaagtgttatgtgttccacataagttgaatgtgtagagatagtcgattcactgagtgtggagcttcatgaaaaacattcatatgatgttcaggcttacagacccttgtgagtcatgtatcccataatttaattgttcgctggacagaggacctcgattgtttatagtggtggtgttgccctaaccagtaagaatacatcgggactaccttcggacaatatgacatttcttttggtgtttagcctggcactaacagaatcctagcgccagaaggtaattactagtgggcctcttttaattaaacaacggccataggtggacacttaatgcgaaatctagcctttaa

SEQ ID NO: 524111 - DNA, 757 bp, Homo sapiens
tgtacatataaggtatttttagagaagagaaacaggccgttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactggctgttactcgcttctgggctggctaaccatggtttccaaccccaatttaacggaagcaagtgtgtgggagtatcaggcagagtcgtgttctatatgttatgtgagtgtatgaaatcatttctcattttatcacaattccttcaactcagcttactcgcgtggctgcctgttcatattctgaacagcagccaccgtgctgtggccttaggtatcggaaaaagcatagcacgcacttcccttggtttttcccttcccagagccgaccgcagctgtgtcaagccctctcattaccggctcctgaacctttacttactggactttgagctctgtgactccgtcggtactcgcaggaattaactaacttaccacatggttcaatccacttgagcgccatagctctgagctcctctgtgtgacc

SEQ ID NO: 524112 - DNA, 1274 bp, Homo sapiens
gtctcccacgagatctggaggtcagaaagtcgtgctccaggttgttagtggaatagtgtggacttgcatacgacgtattcgcttggtagaggtatcaaaaaatgcagatccccctcatgcgcaagcaggaggtaacgtgcgactaccggacgtcagatgactccaagcgcccgcatacaagccccggccaaggcaagacgtccagggcctccacgcctaacagagcagtgcgcacacgcctagcatgcaggagcaatggtgcttgggtggtagcggccatgcctgcatgacatggacccttgcatggcgcctttggcacaagcatgaccgtgcaaagcgcagcatgcgaggggcactgcacaccgtcgccggccaattgcacccatggacaacacaaaagccccctgtgcaagggaggttacataaccggggcgtgcctggtccccgcaggggctacgggtcccagtggagcaaaaaagttcctcaggcgtcctgtcgtcggcaggacgacaacgtactgtaggagcgcgaccgtggggtcacacgcgtgggaaacgggcaactcggtgccaagaaaggcaatgggtccataggacatggaatgagttggggcctaggaagacgttagccacacggacacggaccccgggggaatagggtcaaccgagctggcgcctttggaaccgagaagcaaggggccctaccccgggggggcgaagcaggaacgtaacccaaagaaacgcgcgggcgttcgctgggtagagttcgaggaacggaacacgacttggcgggaaccacctcccttatgatagggcccacttagggaggcacaggaatatcgccatgggcattgggaactggttaacacacagccccgggaaagggccacggaaaccgccggtcagggaggagacgaaatcggccgtcagagaaacaaggcccgggcacgggcaaggcatctcacctaggggacaacccaaagtgaaaacacactgtggagtggtcgaacacgaaccttcgcacaaagagtgcggaccgagccacagcccgttgcaacttccagagggaagagatagacaccacgcactgggttgaggccaccgagaacaaaggcatctcgtgatatcgcgggcctacaccacacagacggaacatatacagtccggtggggtaccctacggaaggacaaacttggaacgcaccgagggtcaccacaacggggtcgcgaagagacacggtgagtagtaaacccggttggacagaggcgcacaaag

SEQ ID NO: 524113 - DNA, 496 bp, Homo sapiens
cattatcagtcttaaaagttatctggaggctctaaggtgttgttttccaacccaaggtactctaaattttggattggcacggtaagatgattgctaagaaagtccatatatagatttccttttcaaaataagtattttgtaatctggcatagtatgtaatgagaattgtcaggaactagaaacagggaattttcaatttttaaaagcagaagaaaaatgttatctttttggggattccaatccccctcactaaacttatccccaaaggttttctttcggtcagttgtacaacatttttagtttctccacaagtaacatcataatttttactttaaaacaccaagtcatacattttacattgtagaagcagtagcagcagtactatactcagtatttaaatatgtcccagtatagaagcataacttcaattaatttgctgacactaacttcttaaaaacttacaaatattcaaaacaaagggaaaaaattttagata

SEQ ID NO: 524114 - DNA, 187 bp, Homo sapiens
  misc_feature (120)..(120): n is a, c, g, or t
gggcagcagaggaaaaaaaagttttctagtttcgtgatttttgttgattttttttgtgagttaaatcttcattacctaaagctgggagggacccaaaaaagccaaattgtgagcccgttntatgcgtcaatttgaaagtttggctcagggttctctagaacagatataaccattagcaataggttga

SEQ ID NO: 524115 - DNA, 172 bp, Homo sapiens
tgtggttatcgcagccccacagagccgcgcgaccccacgtaccccacgccagcgccagccatggaggcatacacgaagaaaatgcagatactgaagtaggacaagggagaatgccatacgaccggcgcgcagacaggccggaggcggacataagacaagcccgctagaggga

SEQ ID NO: 524116 - DNA, 1750 bp, Homo sapiens
  misc_feature (1564)..(1564): n is a, c, g, or t
ccatcgggagtgagtagaatttctttttccgcggggtgtgggaatcctcttgtagagatcaagagagattgtggcgctggttatataagtatatattaagatgctccccctacttaatggccggcccccacactagggtgtggggcgcgacagcaagtatccaagaataagaaaaagtagtagcttttgtttgtgaagtattgtgtagagagcgcactactttcttcgtcgaagggagtagtggttgttattagcgttgcattcacacacaccaagcaggaagaaaagttgtgtgtgtcgctctctttattgacactgttgtgggggtcctaacattatatgaggaaggatatttttccttgggcggtgaaatacagggaagaatgttgttgttgttgtgtgtgagaaaatacacagacgttgctgcccccgccccatttgtgggtgtggtgtgttttgttttgttgtggtccaccaacaccaacaaaaaagtgtggggggaaatataatattttattaaggggggaacaccaccagggggaagaataaacagttgtgtggaagaataggggcgctcgagatagattatttccccccgcattttgtggtgtgtcttggtggtcgccaccgccccgcgagcaattaattaggaggaacgagtgatgttgtctgtttctccaccggcgggtatatctttagttgcgggaaaacaaccatgttgttgtccgtcgcccctccaccacaaagatggtttataaagatcgttatcatccagcaccacgttcgtgttggagaaataaaaggccaccccttcttgtgatcttcttccttggggagacattttgtcctctttattaggggagaatagcggctcatcaacatcttggggggagagacacctctccttatacaactcttttggtggagaaaaatttttgtgtgtgttggcaccacaattagcctcttctgagctttcttgttctgcgtctctccgcaacacacacaggagaataggggtttgttctactacagttgggacgaaccctcacaggctctttgtgtcggcacacccacccacagcgtattatggagagccacacagccacctctttaaagaggagagattttgtgcgttctcagaacacacaaacactgggctgtctgtctcgcggggctagtgttgagagagatagagatggtgacaccctgccgtgtgagaaaatagtgatacagcttgggggagacctctcagagcggtgtctcagagatagattctttatagagttgtatttatatggcgcacacagtgtgtctctctgtgtgaaatgtttctcacacgcgcggtgccagcgcgggtgtgtgttgccccacacctctcagtgtatatgtattctctagacgctatagacgggggcacacaatgttgcgtgtgtatcattctctgtgtggagatagctgtaagaggagaatgagatgggcttctgggagatggaatagtggccagagttttataaaataaacattctcattgttgtgggcacctgccataaattagacctgtttntgggacacccagattggattcccttggagagtttctaaaaataaagagctgctcgccagtctcaccatccaccaataattccagtggtgaaattttgcttgttacctgtccagtccccttccttttctgtttagaatccagaataaagttgtatttccaataattctataacacagaggaaaataa

SEQ ID NO: 524117 - DNA, 381 bp, Homo sapiens
  misc_feature (353)..(353): n is a, c, g, or t
ggcaaggtccatgaaccacacgcagacacaatccagtcccgaataatggcacagcaaatgtgtatcaagataacccgcgatcattaacagatacgaacttcgtcttgaagggggtgggaccccaagttgcctgaggtagagcatgcgcttagccaaggaagcacgaacaaagatagggcctacataggaaggatgcaggccaagaatggccaaggactcatgagttgcagcgtgccgatggctactcaaagggccctcgtaagagcccgcagaaggcaggcttaaagcccaagagtcccaaagggtgtcagctcgtcaagctcgatcgacttgtctacattgccacaccgccnaagcattggggaagctgtgtctcggtgg

SEQ ID NO: 524118 - DNA, 199 bp, Homo sapiens
  misc_feature (73)..(73): n is a, c, g, or t
ccctggaaaagggggaataatttaggttaaatgcaggcttacccacttttttggggtcccaggcgcccctacntagttcattttgcatccaaaaaaagtattagggacccaaaagtggaatttagggtagctaggatggccggaaaattaaaagggcaatgcccaaaaaaaaataggccccaaaaaggaataaatatta

SEQ ID NO: 524119 - DNA, 886 bp, Homo sapiens
ctgaggaaggcattgctggtgcgggctttcctctgcttgacgtcccctcggatttggagtgtccgttatcctgcctgcctttgcgtcgagtcccttctcgctctctttcctccacccattctctgatcctgcctgcctttgctgtcccctaggccttgtgagtggatctgcccgtgctggctgtggggtattgggaggttatagggatagggcgtagaatgcgtgcctgggagtcattcgcgctggagtgtgggcgtggcgggtgcaggacctccctggagatcccgacgcaggggttgtcataggaggccaggcattgcgtctctggtggatttggcttggggggaggacgcgtcgaatgggtacgcgaacaatggactgtttctgtagccatggagtacacttacctataagtatccttgggggaccaatgtaatctagtgtagcaataacagcaatatgctatcgcaaccgatccaaaaattaagaaaactaaagacaaaatgtaaaaatagaaactatatagcaacaagctaaagggaaacatgcttgtaggacattttaaccttccgcgtgagatgccataatactgcatacttcattttctccccccatagaaggagacacaaatggaggcacacactcacttagtataccatcatcccccaagccgtacaccgcatcgaacctgagtcgaaaaaatgaaaaactcaatacgaggtgagcacgtgtgaagttcctgggcgtatcaaacagcctaagtggtttcctgtcaatgacgtgaaacatgtttccctactttgaacttccaccccaatgcaaatccacttaaatccctccggccaagtgaaaaggcatgggtgggcccaaaccgcgaaaagccgta

SEQ ID NO: 524120 - DNA, 555 bp, Homo sapiens
cgcacactcgatgaagacgcacgagatccccctcggtatccttcacacctcctgtctttccacatcagagctctgaacttgagaggtgtcaaacagtctgtaagagcagcctaaagtggggagatgccagttagcccgaaccaccccactatgagtgactatgagacacctaactcttccctcttctgtcaaccatagacactccctggactctgtacctgctccatcaaccaagagcaagcatgtcagcacacccccacctagccgtacatgaacacaggctctgtccaacatccctcacccaagtacaggggtgttgggcgagtggcccctgcggatcagcgaagtgttaatgcagaaggcccgaggacacaagcgtttggctatgaggctctgctcagggagagcaaaggctatagactggcacaggtttagaatcaagtaccatgtataggtttctgtctcacatcacatgattccactaggggctgcagaacagattcccctcaaaggggtctctgctgattacagccacattcttactagtggctcatc

SEQ ID NO: 524121 - DNA, 126 bp, Homo sapiens
  misc_feature (46)..(46): n is a, c, g, or t
gatatgctgttcagcatcacagcataattctgcttcaagctcaggnatgggaatccttctattatagcataacattgcctaccaatatcttcacaaagtggagttgaaccatcaagctgcaacaac

SEQ ID NO: 524122 - DNA, 249 bp, Homo sapiens
gctgcgcctactactacataccaagcagtcaccaaattagatgaaactcagtttacaaaaaaaaaaaaaaaaaaaaccaccacaaggggagctcggtgtagtacctttggggggtgggcccgaaaagattgtccatttctttttcctggggtagcactctgggtctttcaagttaattcactaatatcccataccccctttgcatgagaggtgactaagttagggcaacccagtgctttaagccattca

SEQ ID NO: 524123 - DNA, 773 bp, Homo sapiens
aatctagcctctttcttgtcccacatatacattctaccccttgaataaaaaagttcaatgacgccgggcgtggaggctcatgcctgtaatcccagcacttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagcaatcacttgaacccaggaggcggaggctgcagtgagctgagatcacgccattgcactcaagcctggcgacagagcgagactccgtctcaaaaaaaaaagttcaactgactgggagtaacccaaaaagaaatgtcgtggaacattgaaaagtacttctcatgtgtccttgcagaacatgatgtctgctaagtgccagggtttcacaatttacattttcctgacctacaatgtggtaccattttttcacaatggttcgtaccacgaacatatagaggtgtctcttcaggacactagaatgtcatgcactggcggggacctgaaaccaactcgttggaaggtgaaccattgcgttctccagaagagggctgctgggatgatgagcccctcacaatcgacacaggtatacagctgtcgcccaggctctggacatcaccctaaccggatgcaaacgcggctagggcatacggtgcgagccccacactacacagacgcgaatcagacgtcccgcaaccacacaaaca

SEQ ID NO: 524124 - DNA, 135 bp, Homo sapiens
tatgagggtgccgtagctactagccctgctggctgcatgaggctatcatgtattccactgcactccagtcctatattgacaaggtgagactgctgtctcaaaacaaaaaaaaataataaaacagaaaaacaaaat

SEQ ID NO: 524125 - DNA, 110 bp, Homo sapiens
ctctgtttgtaattaatttgaatgcttccagagcttccttttataccctccctgttgtaattccatggggagttcacagctcttccgaatcttggcagtgtccctttgct

SEQ ID NO: 524126 - DNA, 236 bp, Homo sapiens
ctgtataggaccaggaccagctctagcactggcatctccatcatcatcatcaccaacacaaccaccttcaccaccagctctactgtcatctccatcatcatcaccagcacaaccacaaccaccttaacaaacactaccaccaccacgacctgctaattttcttatttttatagagacggggttttgccctgtagcacatactggtctcaaactcctgcgctcaagcgatccgcaat

SEQ ID NO: 524127 - DNA, 973 bp, Homo sapiens
  misc_feature (7)..(7): n is a, c, g, or t
  misc_feature (10)..(11): n is a, c, g, or t
  misc_feature (17)..(17): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (37)..(37): n is a, c, g, or t
  misc_feature (39)..(39): n is a, c, g, or t
  misc_feature (42)..(42): n is a, c, g, or t
  misc_feature (44)..(44): n is a, c, g, or t
  misc_feature (51)..(51): n is a, c, g, or t
  misc_feature (55)..(57): n is a, c, g, or t
  misc_feature (59)..(59): n is a, c, g, or t
  misc_feature (63)..(63): n is a, c, g, or t
  misc_feature (68)..(68): n is a, c, g, or t
  misc_feature (72)..(72): n is a, c, g, or t
  misc_feature (76)..(77): n is a, c, g, or t
  misc_feature (88)..(89): n is a, c, g, or t
  misc_feature (98)..(98): n is a, c, g, or t
  misc_feature (107)..(107): n is a, c, g, or t
  misc_feature (112)..(112): n is a, c, g, or t
  misc_feature (123)..(123): n is a, c, g, or t
  misc_feature (132)..(132): n is a, c, g, or t
  misc_feature (138)..(139): n is a, c, g, or t
  misc_feature (148)..(148): n is a, c, g, or t
  misc_feature (156)..(156): n is a, c, g, or t
  misc_feature (168)..(168): n is a, c, g, or t
  misc_feature (178)..(179): n is a, c, g, or t
  misc_feature (186)..(186): n is a, c, g, or t
  misc_feature (189)..(191): n is a, c, g, or t
  misc_feature (211)..(211): n is a, c, g, or t
  misc_feature (214)..(214): n is a, c, g, or t
  misc_feature (224)..(224): n is a, c, g, or t
  misc_feature (240)..(240): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (259)..(259): n is a, c, g, or t
  misc_feature (261)..(263): n is a, c, g, or t
  misc_feature (268)..(268): n is a, c, g, or t
  misc_feature (273)..(273): n is a, c, g, or t
  misc_feature (280)..(280): n is a, c, g, or t
  misc_feature (282)..(282): n is a, c, g, or t
  misc_feature (285)..(286): n is a, c, g, or t
  misc_feature (288)..(289): n is a, c, g, or t
  misc_feature (292)..(292): n is a, c, g, or t
  misc_feature (295)..(295): n is a, c, g, or t
  misc_feature (302)..(302): n is a, c, g, or t
  misc_feature (310)..(310): n is a, c, g, or t
  misc_feature (315)..(315): n is a, c, g, or t
  misc_feature (319)..(319): n is a, c, g, or t
  misc_feature (322)..(322): n is a, c, g, or t
  misc_feature (326)..(327): n is a, c, g, or t
  misc_feature (330)..(331): n is a, c, g, or t
  misc_feature (334)..(334): n is a, c, g, or t
  misc_feature (340)..(340): n is a, c, g, or t
  misc_feature (342)..(343): n is a, c, g, or t
  misc_feature (347)..(347): n is a, c, g, or t
  misc_feature (350)..(350): n is a, c, g, or t
  misc_feature (355)..(356): n is a, c, g, or t
  misc_feature (358)..(358): n is a, c, g, or t
  misc_feature (368)..(368): n is a, c, g, or t
  misc_feature (371)..(371): n is a, c, g, or t
  misc_feature (378)..(378): n is a, c, g, or t
  misc_feature (385)..(386): n is a, c, g, or t
  misc_feature (388)..(388): n is a, c, g, or t
  misc_feature (390)..(390): n is a, c, g, or t
  misc_feature (396)..(397): n is a, c, g, or t
  misc_feature (401)..(403): n is a, c, g, or t
  misc_feature (405)..(405): n is a, c, g, or t
  misc_feature (416)..(416): n is a, c, g, or t
  misc_feature (424)..(424): n is a, c, g, or t
  misc_feature (430)..(431): n is a, c, g, or t
  misc_feature (434)..(434): n is a, c, g, or t
  misc_feature (436)..(436): n is a, c, g, or t
  misc_feature (442)..(442): n is a, c, g, or t
  misc_feature (450)..(450): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (491)..(491): n is a, c, g, or t
  misc_feature (495)..(495): n is a, c, g, or t
  misc_feature (497)..(497): n is a, c, g, or t
  misc_feature (518)..(518): n is a, c, g, or t
  misc_feature (542)..(542): n is a, c, g, or t
  misc_feature (550)..(550): n is a, c, g, or t
  misc_feature (552)..(552): n is a, c, g, or t
  misc_feature (926)..(926): n is a, c, g, or t
gggattngtnngagacncgcactcggnancngggggngngtncnggggagntctnnngngtgngaagngcgngggnnggggggggggnngggcatgtnaaggggggnagggntgggctattcntaggaatcnggggtnnatcggcacnccactgtnttaggggacacnggaatttggnnggggttnggnnngggaacagtgtcccgagggnatngtggccatcnccaccgaacaccctanggatttnggnatnagagangnnnggtgntgtgntgcaatnanggnngnnttngcngtggagnagcacagncaggnaatnggngagnnagnnggngggggncnngggnatnagganngngagggaccanaangcctagnctggggnnangnaagcgnngagnnngnagcagaggggnggggaaangggggnngcngngggggnggaggagngggggcgggccgcgagggatggcngcngcagtnctcaatgngaancnccctgaatccatctttggggntcccaaggctggcaatgggcgagngggcctcngngatcgcgggtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattanatctctgggatcagactatcggacatagggtaattgtatctgatgtc

SEQ ID NO: 524128 - DNA, 332 bp, Homo sapiens
gcaggagcttacaggtatcccacccgaatacaggtacgtatcactgagtggtaaaaaactccagtcgacacaaaatagactacgaaaggggctttaacatatctgaacacacaatagctaagacccaaatatgggattagataccccagctatgcttagacctaaagcactcaatcagttaaatcaagcaaaactgctcgcgaagaacactacgagtccacagctttaagaactcaagaggacctgcgcggctgcttcactatcccgtctagaggtagcctgcttcatgtaaatcgcataacaccccgactcagacctcacacacctgtctt

SEQ ID NO: 524129 - DNA, 154 bp, Homo sapiens
tccctgcataacatagatttcttaaacctaattgaaaataaattcatttttttaaaaaacctcctacaggggttcctccttaattcaaaattttatcatggatactggattttctcgtacatacatagggctaaggtgggtttcttaccacatt

SEQ ID NO: 524130 - DNA, 503 bp, Homo sapiens
  misc_feature (17)..(17): n is a, c, g, or t
ctctgcgcggggagcanttggtgcgtgacgtgcgcatacccagatctacgaaggtaccaacggcattcaggccctggatctgatggggcgcaagatcgtcggcagcggcggtgcgttctataccatgttcgccgatgagatccgccagttcatcgccgcatcgggccctgagttggccgagttcaccaagcccctgggtgtggcagtaggtaacctggatgagctgacggcctgggtgctggaccgcgccaagagcaatcctaatgaaatcggcgcagcctcggtggaatacctgcatgccttcggctacatggcctatgcctatatgtgggcgcgcatggccaaggcggcgttgggcaaggaaggcgaagaggatttctacgccagcaaactgggaactgcgcgtttctacttcgcccgtctgttgccgcgtatccactcgttgagtgcgtcggtaaaagccggtagcgaatcactgttcctgatggatgaagccctgtttt

SEQ ID NO: 524131 - DNA, 102 bp, Homo sapiens
gacggttccgaatctcgccagtagtgcaggaggatatgccgcatgtttcaggtttctgagtagcaggcaatgcatccgtcaatcataggccatcgcccggat

SEQ ID NO: 524132 - DNA, 191 bp, Homo sapiens
ggggcttcagattttatgattacatcttgtcccctagaacataccccttcctcccaataactgcttttaaaacagatgcccaaagaagggcaaagcgaggaatgcctctttgttggggggagggcagggcggaaataactagtttcaaaccaactatctatctatgctttgcaaagactaaggcgtattat

SEQ ID NO: 524133 - DNA, 442 bp, Homo sapiens
  misc_feature (79)..(79): n is a, c, g, or t
  misc_feature (169)..(169): n is a, c, g, or t
  misc_feature (239)..(239): n is a, c, g, or t
  misc_feature (333)..(333): n is a, c, g, or t
tacggcacgaggggtagcgcaagtgggtctcaaccactatatatactctctgtgcccgtgcgcagctgttgaggacagnctgtcacagactgtgctctgtacactatgggcacacgactcctcccagatctgtgtcttgtgctcctgggattgggatttgaggtccagnggacccaacaggcccagcaagatgagatgcctagcccgacctttctcacccaggtgaaggaatctctctncaggtactgggagtcagcaaagacaggcgcccagaacctgtgccagaagacatacctggccgctgtagatgagaaactcaaggacttgtacagntctgtgctgaagggagaggagtaacaggcagaccccccattagtggacaaggggagagagccctacttccctgagaccccaggttcagactgagcttccccttcccggg

SEQ ID NO: 524134 - DNA, 370 bp, Homo sapiens
agtatgtcctcacgtaagatactgccaaactgtcttccaaagtggctgtaccatttcgcattcccatcagcaatgaattacgagttcttgtagctccatatacttgtcgagcatattgttgtggtcagatattttgtgagtttggtcattctaactcggtgtgtagtagtatctcattgttgtgttaatctgcagcttcctaatgacctatgatgtggaggagtatctttttatatgcttacttgccatctgtatgtgttctttggtgaagtgtcccattcaggtcttttgctcatcaatacattaggttgtctgtaatgttgttcttataatggtagagtttaaaaagttaccttgaatttttttggga

SEQ ID NO: 524135 - DNA, 983 bp, Homo sapiens
tacgccggtgcagcggggtgggcccgtgagtgccctggtggccctgggatggggaacctgcggtggcttccgctggaggtttcggcagtggcattctggtggccgtgggtcgctggcctgtggacgggggcctggggcctgatggcctgcggatgcatcgctggatgtgcaatggcctgaggataaggagtggatgcccgtcaccaacgttggtgcctgcttgtgtcaatggacattgaacgatcaagtccctggatggagatctatctcttctccctgcccattaacggaatcacgagatcatttgatttcttcctggtgaggcctctctcaaggatgacggttttgaacgattatgccatgtgcacgaatgcatgaccctgtgcctgtgccagctgcaccaagtgttcacaggcaatttgttagctattcggggactacaaatggcacactgtcaggatctgaggtagttaacgttgctccagaggagagtggccatccgacaatccagtagggagcccatcatccttggccaaagcttcatcccagtcagtcccactgttgcgcatgagcgctacatggaagaggacacaaggattcggcaaagccctcacacattgtccctttgcaaagcgtagaccagggcctgattgcaggaaatctgttgcgtggtactgacctcattcccttgcaccacagtgggcaccttggccaattcagtctccggaaccttgtgcctaaagaagcatgctccatgaatgggctggctatcgaatgacttgctacaccttcagacaggagcattgaatgcccaccctgggcaaaatcagccaggccacattagatagcattcttaagacttaaggatacctgagccccgacctcttgacaatgagagttgattcaccaagtttccctaataggagtaaatgacacactcgcagaacaaacagagtttcgggcaaggctcagggccactgtga

SEQ ID NO: 524136 - DNA, 265 bp, Homo sapiens
agcaactttgagggccttttttggagccaggggcaactgcatgggctcaaaaatggcctgcagcttttttaatggccatccctggggcaagtgtttatccacccgggccagggcaacagccccccccctagtacaattgatgctcccttagacaacctgggagacagcctgggtcagccccatcaactcagttgtcccccccaggggaattttgaatgtcttttgtttttgttttgttttgaaaaaaaaaaaacaggcccctgta

SEQ ID NO: 524137 - DNA, 103 bp, Homo sapiens
gatgagctgctccgcttaatcagtagggagcagaatgacaagacctattgtcaaccttgcttcaaataagctcttcccactgtaatgccaactgatcggggct

SEQ ID NO: 524138 - DNA, 201 bp, Homo sapiens
gcctcgctattagacacaccgtgcaggctatgggtgtcctcagaccacatgtacttctcaccaactggctgcaacttgggaggttcccaccatgcccttgaagttcgataactcactaaaacaattcacagaatgcagaacagcatgatactttctttctctttatattttttttttttttttttttttttttatgggggg

SEQ ID NO: 524139 - DNA, 103 bp, Homo sapiens
cacaaaaacaaaaacaaaaaagacacggctcaactgtattacatatatggccatccgttgagcccgaacgacgagcgcagcgagcttaggagcgaggaagcgg

SEQ ID NO: 524140 - DNA, 100 bp, Homo sapiens
ctattcatcggcaccattagctctagaggtccatgtcatacttgattatttatatcttaattcaatacgggtgtcattgggaggtgccgattaatagcga

SEQ ID NO: 524141 - DNA, 369 bp, Homo sapiens
agggggttttttaaacctttaggtgggaattttaatgaggccactgggtaattggaagaatggggtgaaatggccatgatttaaatcccttttagggcctgttaattggatggaaaggtttccaggtggttaaaacttccccaggtcagtttccttttaattcctgtttaattggggttaataggcttacggaagagcaccgtggttaaaaggctacggggagcttcctgtccggggttagaaggtacctagttaaaggttcatttttgagacccaattttaatatttccccattattgggaaggaaattcatatgtccttgaaccttttaggccaaacccaaccaggtaaggagggacctgttgcaaa

SEQ ID NO: 524142 - DNA, 1030 bp, Homo sapiens
tttccggttgtaaggcggcgacgtactcgcctgtgccccggggtaggtgcgccaccgggggaggaggaggaggagaaggttgagaggaagagacgccccctcttcccgagtacctctcaaggcccttatctcatggggccatgtcacgtgacaggacaggagagccaagttcctcctacttgggcttgccctgaatgaggcctgcgaccctatgtatgtgccctgagccctacctgtaccaggggcccctagaaccgaccctggtgggcctaaaagctgacagtctcaggggccatcgctaaggtttccagtttgcctagacaacagtgcccagggtcagatgcaacaagtccttccagcgcatcgtgcctcaattgctgcccctaggcatccagccccagtccctacgctggcagtccagtcccagtgtgacatttcctggtgctctccaggccccgtgccttagctgggggaacacgctttaagcgcacggtgctctgtgctccttgtccctcgcgggctaatggagccctacaaagtctaccccttggtgcgccagtgccttggcccctggccaggggtcttcagtgcgccctgccggggagcccacggcaggaggtgccctccggggtcgctggcgtgccaaagcttggcgatgaaccgggtattcctgcagcggcttcctgttgtctccttctggcttgctgttcccccggggtcctttgccgggagcacgggtctgttggtccattgactcgtgccgtctatggttgagccggcacctttccttgtcgggtgtttgttggccctgctttgactgtgacggcttggcctgctgcagtctgtccggtcaagtgtccgcgcggcgtttttggggctggctggttgtttccgtttggttccttcattcgccatcccttggatacttttcgtaaccggtcgcaatcggttaccttcgaggcccaccttgctctttttcgttccggggcgcgttttgtttcgccatggcatccgcgcttattttcgcggg

SEQ ID NO: 524143 - DNA, 684 bp, Homo sapiens
cattgggaatgatctgctgccaggtgcttttgagcccttaggattcatctcttcttgttcaccgcttagggtggcctggactggcctgtgggatttgcccaactcgtctacttgacctgcgttactgacacggacacgttcttaccttgtgagctcacttcccgctatgtcctcatccataggacctcgtatttgccctcataaagaggcttcattcactgatttcccctatttctcaggctacaacccttagaccccataccttaccgcccgatatccctattcactgatcatatattcatccggcggtaaatctgaactattgcttcgcccaccaaccactttttgcggcctatcccggaatgccccgacggtactcggactaccccgatgctataccacccaccatggaccatcctatcgatctgtaggcgtctattcattgtctctaacagccagtagatattgaataattttcatgatttgagaagcccctcgcttcggaaggcgaaaagtcctaatagtagaagaaccctccataaacctggagtgactatatggatgcccccccccctaccacacattcgcagaacccgtatacataaatttagaccaaaaaggaaggaatcgaacccccccaagctcggtttcaagcccaccccatggcctccctgactttttcca

SEQ ID NO: 524144 - DNA, 111 bp, Homo sapiens
atcaatacagacgggcagtgctgagtcgaacataacatcagtccctagcaatacaagaaacaccagtgactgcgttttacaatacagcagactcccttgaatatggtattt

SEQ ID NO: 524145 - DNA, 1049 bp, Homo sapiens
gtagcccctctttagaggagtcagccggccggggcacagccgggcagggaccacccacggcgagggaagccggacacgactgcccgaggggcccaacgctgatgagtcgcgctctcgcaaccgcagtcatcaaagggcgaccgagcccgtgctgtcctcacagccgcaactattgggactccgcctcaccgcctcatcgtacggtgaacgcccacgtgcaacactcgccccccatgcccggcctttgctccctggaacgcctggggccccaagcctcaggaccggccacaagcttgttctccagaggccttgacccgtcccttccttcccgttctcaccatcccatgcaaccctagcaccttctggggacacagctttctactctcgtggacaacctgaggcaatgtggagaataaccaggccatggagtttgaagtatgtatgccagtctgcctagtgaccacaggcttcagcgtccgcacccctgtctggctatgggcacacacgcacgtgggactcgggcaaagtgggaaccatcctatctctgtcgggagccccaacaaaagctgggaaatgctttgaggaaccaggcctttcccgcttcttatgcctggtcagcagggtagtgctctgccccatgccccacagccctcagtgtgtccacagccgtagtgcatatgcccctcgggggactgaacacacagtcctgtccagaggctgatacgaagcgatttgctccagatgaatgccaggtgggctccgcgttcactcccactctcccgaggggtgctggcctccccagggtttgccttcttacggatttagacgaggttcgaggctcacctatcagggcagctctcaggattgtcattcttcgctcttttgcctgtgggtttaacttttgtattttggtaatcacaagtttgatacaagatgctctttatcgaactctgttcggagatgcccattctacttttgaatttagctattactaagtgtcgtatcttggaagctcagcagtgcacaagcttacttcgtgtccgttggaa

SEQ ID NO: 524146 - DNA, 118 bp, Homo sapiens
gtgttataacactcacaacaaaactaactaatactaacatctcagacctcaggaaatagaaacctgtctgaactatccttgccctattactatccatcctcatcctagcaataatccc

SEQ ID NO: 524147 - DNA, 648 bp, Homo sapiens
  misc_feature (122)..(122): n is a, c, g, or t
agagaattgctactaaaagagagcacctgctcatatcgctacagatgagttctcctgggaagccaggaaaatctcagcaaatacaacaacataacgcattattagattgggggaatccatgnaatcacaggaagtaatagcctccctatttacaagtcgcccaatcaagtagaacatgtaatggaaaaagtctcatttgcaacagcaacaaaaggggataaaatacttggcaattaaaaggaacatgtaggatccacaaactttaaaatgctcctgaggaacacaaacaaacacttcagctggataactatgcccctattcttagaaagtatatcattcagatgtcagtccttaaataatgtataaatttaatgcactccgaataaaagtgccagtagggtggtggtggacacggaggttttaaaagctagacatgctgagtctgaagttcttgtggaatagttgaaacgaagtgtgactaaggacaataaggctgtgctggccttaccagacactaaagtatattctaatgtgacaacatgtaaagtattgtagttctggaatatgaatgtgccaacaaaccagagaaaaccatagacccaagtacttaatttagtatgcaacttaggtagcactgccgtatcagtg

SEQ ID NO: 524148 - DNA, 164 bp, Homo sapiens
ttcgtgtctagaggatcccgtgtgtcgagatagcagcagtggcatgagcctggggtggctcagctctgttggaggcggcagtccaccatcaagtacaccaccacctcctcctccagcaggaagagctataagcactaaagtgcgtctgctaagctctcgtgtcc

SEQ ID NO: 524149 - DNA, 780 bp, Homo sapiens
gctcatggcaagagttagctggagctgagtagcagctgcctgattgagatgactctcagtccccatggcaatcgcgtgctcctatgttacctagagacagagcacttgattccttgctgtcgcaagtatccaataggcatggatttagcccaattcctacactaggtcgaatgtgtacaaagtgtaaatgcatgtaggaaaaaccaaagctacaccgatcgttcggttaggacaggatctgtagcaactaataagttatgagttctgcttgatgtacatctcaacctctagcgtgtgaatgatcactaatatataattccatatatatatctaaccttctggtctgccttctctcaatatgcttacaaaggtcctcaaagtaaacctacgatgtctggctacctcccacgtgagtttcgccggatgcaactttattccatgaagtaggacctttcataaggtaactccagtggcggttgaaactgggttcatgcataaggacagcatagaagtcatgtccactttggctacgggtctccgacagtactggtcgcagcaccagctaacatttttcaagcctggcatctatcatacccaattagaaattaggtcgagaagcggctgtgttgcacgcagccaacgtggcccgttgatgcttagaggaaatgtgcttccttaccagtcacgttggcgggagtccactctgtacctttgggaatctcccaccatattggatggatagtacaagtggtagcgtgcactgcccactatggcacgctt

SEQ ID NO: 524150 - DNA, 219 bp, Homo sapiens
gcgctctcgtgcccaggcgctgccgctccttactcaccgccgaaccgtttagaacggggcagacaagctttagggggttcgtgggggggaccgacgcccaccggagccccgagcgggcaggcggtcgcgctctaaggagcagccagcacccctttctcatcagacacccccacatccaggaggacaatgacatcccgttgtacctgaagggcggcatcg

SEQ ID NO: 524151 - DNA, 576 bp, Homo sapiens
gcccattaggtgaaaaagcctgccttgtctcagataaaccttgggtctgtggaccttttaagttaatgctgaaatgagtaagactttggaagactgttgggaaggccgattggttttgaaatgggaggacatgaaattcggagggcgcaggggtgtgatatggtttgggtgtgtcctcacccaaatctcaactcgaattatatctcccagaattcacatgtattgtgggagagacccagggggaggtaattgaatcatggcagccagtcttttccgtgctattctcgtgatagtgaataagtctcacaagctctgatgggtttatcaggagtttctgcttttgctgcttcctcattttctcttgccaccgccatgtaataagtgccttttgcctcccgccataattctgaggcctccccagccatgtggaactgtaagtccaattaaacctttttttcttcccagcctcaggtatgaatcagcagcatgaaaatggatttgaatacagaagcctaatcaaatttgctgtccctcatgggtctatagatggttaataaaacattggggtaattaacc

SEQ ID NO: 524152 - DNA, 415 bp, Homo sapiens
  misc_feature (45)..(45): n is a, c, g, or t
tttcactatttcagattgatcatcttcccttaaatcaggtctctntggggcttcagaagagcttattttaagagtgtgtgtgtgtgtgtgtgtgtgtgtgtgtgtgtgtgtgtgtgtttgagacagagtctcgctctgtcacccaggctggcgtgcagtggcatgatctcagctcactgcaacctctgccttccaggcacaagcagttctcctgcctcagcctcctgagtagctgggattacagcacccaccaacacacctggctaattttctatttttagtaaagacagggttttgccatgttggcgaggctagtctcgaactcctggacctcaagtggatttcgcctgccttggcctcccaaagtgctgggatttagaggtgcggagcccctgtgcccggtcgagttgttttt

SEQ ID NO: 524153 - DNA, 1244 bp, Homo sapiens
gcggtgcaccccgtgggtcgcggaggagcgctcctcgcttctctccttcccccctgccgcactccgcctggaccctcccagacggacctggaggacatgatacatcggacacatcatccataatacgcccacaggaacaacgtagaacaagaaacaaataaccaaacagatcgaccaaaatacaaaaacagaaacaagtacagaaaaaaacaaaaaccaagaagaaaaaaagagagaacaaaaaacgaacagacagacacagcacacagcagagagacacgaaacaacaaaagagacaaacgaaaaagaaaacaaaacaaacacaacaaccaaggaacaacaagcaaaaccaaaaaaaaaaaaacagagacaacaacaaaaccacaagcaccaagaagcacagaaacacaaaaacacaagaacaaagaaaaacaaagaaaagacaccaaaacaaaagagaacaagagaggaaaaagaaggaagcagaacaaaaggaaaaagaaacaaaaaagaagcgcacgaagagggaagggaaaaagaaaagaggacacagacagcaagggagaggacggacgcacaaccagaaggaacaccgaggaagagcgacgagaagagagaacaaacaaaacgaaaagagaagcgaaaaaggaggagaagagaaagaaacggacgagaaaaccacgagacaaaaacaggagacacaaagaagaaccaaaccggacaagagaagaacaagcgaaaagagcaagaaaagcgaggacaaagaagagaagacaaacaaggaagagcagaagcgaagacacagaacagagagaagaagaaggcaaagacgggaacgagagagaaacgcagagaagcaaaagaaatacgtactgatactaatagaacgatatggagaagagggagacgaaaaggaagaggcaaaaaatagaaagaagaaagataacgaagataaaagagaaaaggaaaaggaggacgaaaggagtgtaaaaatgacgagggaaagagaaagagaggaaaaatggaaagaacagagaagaacagaaacacaacacgaaagcacaaacagcaaaaaggaaacaaccagacggcaaaaagcagcagggaacgaggagaggaagagacagccaagcgacacgaaaagaacgagacggaaaggaaaagaaaaggaggaaaagcaaaaaaaagaaaagaaagaaacaaaaacaaacagaagagacaaagaaaagaagaaaagaaaaaca

SEQ ID NO: 524154 - DNA, 245 bp, Homo sapiens
cagcaactgtacagtaatgaagaataccatgactgttggtacagattgggattaccgcccctgcttcctgctaaggtgtcagcagctttacccaccaatgatttggaccattaatacaaatggtcaccgccgtgacatggggcaaaatgcctcagaattgtctatggcgatggccaggatctcttggagattcttacacggcctaggacgtcccccagcgggtcccctgcatcacatattgacga

SEQ ID NO: 524155 - DNA, 199 bp, Homo sapiens
tacgagcggcgtacacctacatgatatgaagctactccctcccacaattctccatatttcttctaagagacagaactttcttttaagttcattcattcattaattatttatgtgtcaggtactgaactagattagatgttgggaataaaacaaggaacgaatgagactcacatggtctctcccctcctggagcttcaag

SEQ ID NO: 524156 - DNA, 1161 bp, Homo sapiens
ggagaatgtggagcggtggcaggggccagtacgagggcctgcggggcaggacctgggccaggcagtgcttgacgcatggccactcagtgtccatgcctggagaagacgctgccccagctgctggccaagtctgatgcatcctgtgagaacctgtggtggtgcacaactgccagcctggccctgtaccgccagcattggccgcgtgcgagagctcattgcccaggcccgtgggggctgccagtacaggtcaagggtgcccatgaagttcaactgggcgctcaggggtgcagcgtgcagcacccccaacgtggaatcttgccgaccttgcttgcctacactgccctcaagttctaccatgcaaggggccctagagcctgagcctggcgcagggctaccagagggatcgcatttagtgatgtaccatggggcgaggcgtcatgtgccaactggtgggactacatgggcgtgtgtcgtcttgccgttgacccacgaaggtgtgcaccgttggggtgctatcgacacttggcgccttgacgtgctgagtgccctttgccacgttcccgtaaccattccgattgacgcgacactctggggacggcacgttcgaccagcttcgtacagcaccttggacctagggacatcctccaggtttctggccaaccattgtccggctcaacagatgggacgaacgaccagcattgaatccaaggacaccccaaagggtgttgaccaacgggaggggcccccttgggggcagatcggaggcttggcatccaaacctttgacggtgaccaggaaccggaccatctcatcgacacgtttcttaaccggctctcgggggcagcgataaccacccagacgattcaccctttccaaccgccccccacagatcccgcccttgcctatccgactttatccccccgggctccttaccctcgtgatgatccattgtgcaattcggacgcaactgtagcacccacggcccttgaataattgcacagggacgggatagggatccagctaccttccgtaacccacaacttccagcgaagactagcggcaacctattccaagcgcattggaaaccaaccgggacattgatgagacaaggcgcaattgatgtcaccccggcaatccccacaagctccataacccaagggg

SEQ ID NO: 524157 - DNA, 477 bp, Homo sapiens
aatctcggctcactgcagcccctgcctcccgggtcaaaaaattcctctgcctcagcctcctgagtagctggaactacaggcacacgctgccatgcccggctaataattggtatattaagtacagagaggtttcaccgtgttgcccaggctggtctcgaacccctgaagctcaggtaatccacccaaattgctgggattaaaggtatgagccaccgcgcccagccccttggtaccttccattaacactgatgaggcacaagccataggatagaatggaatccactgagagctgtgagccaattgagggataatgggttaataaattgtggcttgaacctgtggacggtaaggtgtgacatttgattcctattagccttgtagaaacacctcagagatccacagaaagcaaactttgaccataaaaatataagactcacagggcaacgaattctcttagcagctaccttagagttgaga

SEQ ID NO: 524158 - DNA, 146 bp, Homo sapiens
tctagaggatctcaatcgccacgacaaggagctagatattcaactacataagggcaggtgggtgcaatgtcaaggctacaaaaacgaaacaaaaacaggacaaaaaaatggtggcagcaattttttttaaaaaccaatttggtcca

SEQ ID NO: 524159 - DNA, 639 bp, Homo sapiens
tgcggtggctcatgcctgtcatcccatcaatttcggaggctgaggtgggcagatcacctgaggtcaggagtttgagaccagctcggcaagatggtgaaaccctgtctctactaaaaatacaaaaatcagctgggcatagtggtgcatgcctgtaatcccagctactcgggaggctgaggcaggagaactgcttgaacccagcaggcggaggctgcagtgagtaaagatcacaagatcgtgccactgccctccagcctgggcaacagagcaagactccgtctcagctggtgggggcggggattaaccgggcgtggtggtgggcacctgtaatcccagctactcgggaggctgaggcaggagaatggcattgaaccctgggacggcaagagatctgcagtgagccgagatcacacaattgcactccagcctgggggacagaatgagtctccatctcgaaaaataaaacacaatgaacgaggcagacgtcgtggctacacgcctgtaatcccagcactttgggaggccacggcaggcagaacacttgaaggagttcaagaccagcgtggcccaacgtggtgaaaaccctgtactctaatcaaaaatacaaacaaattgtttcagcctctgtttctcataata

SEQ ID NO: 524160 - DNA, 131 bp, Homo sapiens
gatccacctgcctcggcctcccaaggtgctgggattgcaggtgtgagccactgtgctcggccttatttatattttatatattgttgatatggttgaatttatgtatgccattaaattatttgtttctattt

SEQ ID NO: 524161 - DNA, 281 bp, Homo sapiens
tccaatgcaacctttgcttgacaggcacagcgggtgtgccttagctcagaaggttcctgaggtgactgtttgcctctcctcctgctgctgcactcatccctggtgccctggtggggaaggcaggattcaaggctacagaaaggccagggccaggtgagaggaccctgctaacagcccacttccggtggagcactggtccactggaagtgcagagcattccaggctgtaaacactgcctctggcatgggtgactgcattcctttaaggacacacgtcgacgc

SEQ ID NO: 524162 - DNA, 149 bp, Homo sapiens
agatgaatagtacggcgcagtatgcaggaatacggctaggcagtgtcataggagccaagagtaggaaagcacaagacaacatacagcaaaccctaggcgcacctaaaccgcgggctagcataggatagcgcgggacggactaggagtaa

SEQ ID NO: 524163 - DNA, 436 bp, Homo sapiens
  misc_feature (8)..(8): n is a, c, g, or t
gcacaggntccccacctgaaccttcacttgagacctcgtccttggccatcctctacatctggattcatgatacagagaaacttgagtaatgatgacaatagcagtccagtgtgcatggatgctgacatggatgctgtctgccattcttaccactggatgggaagaaatgatagatgcaatccagccattgtgttctcgactctcagttccatcttctcaactgacattgtcttccaaagtccgtgccacaccacagcctggaacatctcccaaagtggtatcttgatgcaatggtagagctcatgtcacagtattgtatgtctcaggtttgaataactcaccagtgaagtcatcttgacctggacagaaattgaatcctcccgagaatcccaggagctgggtaggtgatccttccccagatgagccttcccttgaa

SEQ ID NO: 524164 - DNA, 342 bp, Homo sapiens
atgaagagggccaagctcctccatctgcaaggctaaaccaggggcacaagggtttaaaggtgctgcgagtggtgtttgcatttcttgttaactcacaccagaataaggcacccacttacttcactatgcagtgtatgcacaaaatacttggcagggtttaagatatgttgccagcggtgctagtatttcttgtttacttccaacaaacttgagtaccgaagacttttattagtatgcagtatatgcaaagtgattggcagagaaggaggtttcattggaagttccttgactggttaacacaaggggaccaagtagcgtcccagacacatttttcgtcgacgc

SEQ ID NO: 524165 - DNA, 429 bp, Homo sapiens
ggccgaggctggtggtcacgcctgtaatcccaggtctcagggaggctaagaggcgggagggactagctgtgaggcccaggagtgcgagaacctgccgtgggcaaatgatacgcgagagcccggttcgtccctgagactacaagagcacacgaaggactgcgtgagggaaaacgactgtggagaccacacctggggagacgcttgaaacagagcctgatgaaacaaaccacagatgtgaggagaggtcccagcgaggacacccccagcgacgcggtaacggcgaaccagtgtatcgcaaagagaaagcgcgtggacctcagaagagcgagcacccgggggcccccagaagacacaaagagccgcggtggaacatcaaccacgcacacaactgcaacaccccaccgcggacagtgaccaccgacaacgggt

SEQ ID NO: 524166 - DNA, 314 bp, Homo sapiens
agcgggctgagctggtcggctggctacgacgcgatctcggggggccaggatgcccccgacatcgccttcggtggaagttgtggggtggactgctcagtgtctacctcgacgtggatgatagtaggtcctcgatgctggtgggcggtgggcgctgcgatggccgggagtctgctgcgtggcttagctggttgcgcatgggcctacggggatgtcccgacgctggtggctttgccgtggacggtccatggctgggacttgtgtgggcgcccaagaagattgtgggaatggtcacccagggctgtggcggggaaggc

SEQ ID NO: 524167 - DNA, 1175 bp, Homo sapiens
agcggagcgggccggaggaagatggagcccaacgcaccgagggccgggcttgggcacctctctcgtggatgctgcatgcacattgaattgagcgcgcgtttgcgccaagtggaccccgcaccattagctgctgagtggacaacacctcaagcgtgcttgggagactctattcgctgtttcttccggatccctgaacggacctggggcctttgacgcatcacagttcacagaccgcagtgatgacacccaagcccgtgatcgtcctcaatcaaacgttatggaggtgactctccggtctagtggaccacatcctcacttcagttctgcctcctccttccgtgcaggaatgcatggccggcacgcaaaccatcagaacgctggagcacccatcaaggtgtcctcttacttgcacggacgcgagcggcagattgatgctgaggtagacatggcacaaggtttccccgaactagtttgtgatagaactcgcgtacgtatccggacgcgaatggcctagagagaaacggattgacagttcgctgaggcaactttctgaagctaatctggaccgtacggagaagcacatacaatcggggcctttgctcccaagtttgaactcaacttacagcagaccctaattgaaaccggtacctatcaacagagaccgctattgagagcaacaagtgatatataacaggtactccactccgtatgtgtcaatgcaaccatcatggcagtgataggcctgtactggtaacatgggactcttcctgaaatcctcagatacggtagtatgggcgctacacaggtgagattccatgctatcaagaattcatcacacatttcactatccagtatagtccagcatagagtgttgcatatcagtgtacgtaaatagagtgatgaggtctccagcaaactccatcccattgaactatgatgcaccccatttgtatgagtcatagacatagaggaattcaactccacagttgaaactgtgcgtgagtcacgtctaatcacgacccacctagaatatcatatccgctaataagttatccccactatgtaaaccctacaagccgtcgttacactcatataccctagaactaactatcacaaacaagattgtataggatagtatgcggtcaacatgaaaagtatactcacatacatattcc

SEQ ID NO: 524168 - DNA, 174 bp, Homo sapiens
tgagacgacggcatatgttcgaggtggctcctgtatcacgatgctttggattgttgccaacaaaattgtgatcatctaaactgagtccagctgcctaattctgaatatctatatatatatatcttttcaccataaaaaaacaccacaaaacaaaatcaacaaaccaaacaaaaa

SEQ ID NO: 524169 - DNA, 216 bp, Homo sapiens
tttcacagcgtgtttgtgttttattatttcagcatgttacaatgtgtaggcactcagtaaggatcatatcttcctaccatcctaacctgacagccatcgtatctctctgtgatgcctccagcttttacctgagagcccttttaggatggataactcacacagggggatccaagccaggtacgcctctagccccaggtgaaacccaagcaccccctg

SEQ ID NO: 524170 - DNA, 1581 bp, Homo sapiens
  misc_feature (527)..(527): n is a, c, g, or t
tgcgggttgcgggggtcgtccgcgctctccgcgggtgcgtgccgtcgtgttctagggtggttgctcgatcgttcgtgcgcttggtgtgcctctcgctgtgtggcgcgcctcgctggtgctctgtcttttcgtgtcgcttctctgctatcgactgtgcgattcgctgctgttgcgtgcgcggtgtcgtcgggtggggtggtgccgctggttcgagtgctcgcgtcgcgagtctgtgggtctgtgagtgggcggcctcggcgcgacgtcccgccggctagcgtgacggctggcggtgagtcgcggcgtgcttcttcagtcttggcttgtgctggtctgttggtgtggctggctggtgcgtggctgttggcttgtgatgtgctgttggtcatgcagaggagcgaacaagatggagaaggagggcatgatgtggtgattatagagacaagaggacaaaagtaaacgtgcagagtagccgtgtttgctgtggtgtcatgctgtggtgattgtgtctccaaacgtagtggcgngctgtggttgacggcccgcgctggtgccccgactatggtttgcgtcgagccgtgtaggctgagcccttcaccgcaggggggggcgtttgcaaaacaattacaacggggggggtagccgctacacaatattgcgccccctcgtttggagcccctcctgatggtcccgcgagagcgtgggtgtacggctgttgtgtggtccacttgggggcggaggtgacgcacagtgtgttgtttttttctcctggggaccgcggggttgtgaggtctggttgccacgcgccgccggtagtaacacgcttgtgcttattcattgtggggaggctcgctcctttccccggccgtggcttgctttttatctgcggcgccggctcggtgagttaccccgccgtccctgtttggtggggcacgaaacgtgttctatacgcttgttggcaatacgtggtgggagctgacaggggcaaaggtgttattttccatgagggcgagttgagcctaaatggggtgagctagtggttttccggggccctattcatcgcgtgcgcgggggggaatttctcacaagcagcttgtgtcttctaacaaggaacaacttctagtgtgtgcccgagacaaaatccgcggtccaccaaggtgcgaaatttcttcttacacgagaataacccagctgatcacgcgagcctggctgttgcgcgaggagcagaggttgcgccgaaagcagatctgatatgttttgtgatgtaaaaaggggcctgttccacacagttggttagctctcagttggctgtgccacgacgcagggctcgtgacaaaatattatgttggcccaacgcccacaactatgttgtcaagaaaaacaaagagtcttttaagagagaataaaaagtaacgttcttaatatatagtgatagattaattgaggagtttcgccgccccacttcaaggagataatatatggagaaatatggtctggtcacaccaggtgcatcacaagtggcttatgtgaaattaaaacagcgcacatatagctgtcgcatacatagtacagagaaatatt

SEQ ID NO: 524171 - DNA, 322 bp, Homo sapiens
tgtacctgaagtgtcgcgaaaatgctactatgactcttcctggaatacacccacctaccttgaaccagacaatggattggatatgtctacttctggatgcaaattttactgttgttcgcatgatgccacagacaccgaggttactgatcaatcttcccaagctcgtaaaaatgtgaaaaatctgtttattctgagctcaacaagattgaagaaagttttcgggagctacagaaatttaatcaagataaaaataatagaggattattttcatttgaagtgctggaacatttctgatcttatcaaacctttttaatagacattt

SEQ ID NO: 524172 - DNA, 2491 bp, Homo sapiens
ttcactcgacatttggaatatgtattataagggaaagcatagggtgttatgaaagcatgaaatagtgggatctaaccttgttgaaacaggcagagtgggactgggggttgccagggacaactttcttgagaaggtaagtttgagatgggtgttgatagagggtgagttttaagtaggccgagtcagcaccttggtcccccttcctttatattcatgtaccagcttgatctcctggggaaatgtgagaagtgttctggagaagcatggaggtttagagccaccgtgaacctcagagcacattatgtagcccaccctgtctgccctcactcttctcagtattgccaatgagggcagtggcgcccacgagctaatgtgacttcctcgtacccctcagctgatgagcaacagagctgggactacaggacatagccatctttgtccctattatgtgccagacatacgtctagcaccctgcgtacttgatattgaatctgcactagcaactctatgcagtacgtattattattacttcttgtttacagatgaggaaacagaggccccgggagggtaggcacccctgtaaaggtcatacggttcgggaaagagtcaggatttggattcagcctgactgcacagcccccacactcctaatcacagcattgtccttccccctgccagaaacttggtttgcagtatttctactgaaacgtgacattttacctgccctcatggaggtatgatctttttggagagaaaagatagcaacaattcaacacagacaccacaccaaaggttcttgagatggaacagaatgcaggccccagggactcaaagtcatttttcagcatgggaagacttggcaccgagtctgtatcacaggatgagcagggctgtgcagagaaaacccagaggactggagggtgggctttgggaggagcaagtcaatttatctcttgggcttcattttcctcattgggagcattgaggaagagtaagggtgggagggaggggtgggttggcaaatgttttcccaagtccctggggttggtgggtggagtttaagccaattgctgatggctttgccaccaggtggcaaagtttagactttgtctagaagaagtggggagccatgaggggttttgagcagtgggacatgaaagtattgctttgggaagttggaatccaggaggcttttatcttccagtcttgcttctctggagactgatgtcccaagagaacatgcctggccgcttagctccgtggagtttatgctctgggagaccctgatggggagatcctcatttcgactggtcacattaatactacttttcgagtgtgaaaggttgagtcaaggtttggacttctggcaggttctcgcctttggctggtgttccgcctttgagatggtcccactactttcactcagcgtccctaccccacacacatctccccctctacacagacactaagggctcctcatggggtttcattattggtttttagcggatgttcctctaactcggtgcatttcctcaagccaacgtctattccactatcatggggaaattaatatagaaatttcctcctttgtatcatcaatttcagaggatgtatgttcccggctgatggccctcccctctatttgcataacagcaggtaaacaatactgccacctagtgggagctcaaggtgtgaccttcggagctcctcctcctgaccccgggacattatttctattactgttaatatttaaactaatgggcagttctgagctcagtgctcttcccagtgagtggatccacgtggattttcacgtctccttctcattctcttaaaacttggagttacaagtgtcagagaagctgttttgtgtacgcagaacgattggaacaggtgcagggagttttacctactttactttgacttttgctcacagcagtccaggtaggtaactggattcccgttttatacgtgaggaaacccaggctcagtaagattaagtaacttggaactttactgagcacctaacgtgcccaactacgtcctggactacctaggtagtatggggattgtggcctgttttcctctaagaatgcgctgtccagacacagtggcaaggcgtagttagctcctggccaacttgtagaggagaggagagacccttgcacactgcagtagtgcagcaagactgcttggatggaagaagtgggtctggagctaggattcgaaaggtggcatgggaagagaatgtttggcggatgaaggcacagaggcggcgctagtgctagggatgtccgggggcgaggaaagacttgctgatcttgggctgtgccaggtgttgtgggttgaggggtctgggatacagagcctgcgagagctaggttgagagctccagggagtcactgcgactacttccttgctccatttgtgaactgagaagtaagactcgtttgatggacgaaatttaaataatgcagaaatatattaaagt

SEQ ID NO: 524173 - DNA, 419 bp, Homo sapiens
ggggcgtacgctctatgcagtgtgagttagactctcctgctgtgtgatcattgtgaccgagtgggagacagcatcaccggagatagtacattaccggtacttgaacctctatgataagtggagcaccggtgatgctcacatcactgtcggtggacattgagataacatggctgtttagggtatgtatgccggattgctgcctttcaatagatcccaatctggcggctgatgctatcatagcgatcagtgaagcattgaggggcaagtgactatcttgctgatggatcacgtgcgtagatgcgttataaggctaatgactgtacgcaagggatgacttgcatacattatcatactcctgatgacaggcgagaaccctgtgtaggtactgtttatctccatcatttactggactttagggg

SEQ ID NO: 524174 - DNA, 355 bp, Homo sapiens
  misc_feature (22)..(22): n is a, c, g, or t
  misc_feature (39)..(39): n is a, c, g, or t
  misc_feature (74)..(74): n is a, c, g, or t
  misc_feature (144)..(145): n is a, c, g, or t
  misc_feature (204)..(204): n is a, c, g, or t
  misc_feature (326)..(326): n is a, c, g, or t
tgggcgactcgccagagttgcngcgcacggggtctgttnagtcctcctctgcattttcaaatccagctgttganggcagaagcctttttggcgaaggtcaggaagaggtcctccaccttgcggaagtgactctgagcctccagnnagcttcttcttgcgggcggctgagttggccagaagctggctccacctcttcatgagggncggcgtgccgggcctcgatggccttggtactgaaccgtgttctggcggctgagaagctgactctttgcagggcagtgactgttggctatgccttcctagctggaaggcctgcaagcccagcntcacaagtttcctcgtttggcgatgtcgc

SEQ ID NO: 524175 - DNA, 244 bp, Homo sapiens
  misc_feature (174)..(174): n is a, c, g, or t
  misc_feature (207)..(207): n is a, c, g, or t
  misc_feature (219)..(219): n is a, c, g, or t
atctagaggatcccgacggcatggctcactgcaactccacctcccaggttcaagcaattctggtgcctcagcccccgagtaccgggactacaggtgcgtgccaccacacccggccaatttttattattttagtagagatggggtttcaccacagttacccacagctggtctctnatcaatttacgtgtagaatacaaagagtcaganggcacaggatgngcagtcgggtacgcgagcgtcgaat

SEQ ID NO: 524176 - DNA, 81 bp, Homo sapiens
gcgaagtcgtgtgtattggcagctgagacggtccaagactattctgtgctagagggtggtgtgactgcctgatcctgatag

SEQ ID NO: 524177 - DNA, 229 bp, Homo sapiens
gctgcgatcctgttcctggccaatgcatcctgcccaaatgtgatctaccactggcttcatggcctgagtggctacgaactgcagaactgcctgacgagtgccgaggcctgcgctgcgcgccgtgcacgaacagtgtgttctggctgaacccctgcgcgaatacgccactgtcggcctgccacctgacgcccgcttctacgtgcctgtacgccgacaccccggccatcgt

SEQ ID NO: 524178 - DNA, 551 bp, Homo sapiens
  misc_feature (104)..(104): n is a, c, g, or t
  misc_feature (137)..(137): n is a, c, g, or t
  misc_feature (154)..(154): n is a, c, g, or t
  misc_feature (236)..(236): n is a, c, g, or t
  misc_feature (244)..(245): n is a, c, g, or t
  misc_feature (289)..(289): n is a, c, g, or t
  misc_feature (302)..(302): n is a, c, g, or t
  misc_feature (322)..(323): n is a, c, g, or t
ctctgagctcgggtcctttcagtgcataactgtatttagaaaataagacctagcttctaagtgtgctaattactaaggagtggcaatgtttccaggtcctctcnagtggacatacgctagagaatatgtacacacanaacacggcatgcacacnatccagcatttacagtactatatcatatttcggaggtctatcgaatacgattttagaaaaccagtgaggttcacacgcaggntacctccnnaattccattctacacaccaacaaactttgtcttcctgtttcacnataggtaactccncttttccgggcagtgagaanntcctgtgtccctttatcatcaacatatgtactcacaggcataccttactttatggcacttggctttactgcacttcacatatatggtgtgttcttataaatagaaggttttagcaaccccgagacaagcaactctatcagtgccatctttcttttttctgaaaaatctttatggcttctgctgattacacaacaaatgtaaaaattcaaatattacacttctttaaaa

SEQ ID NO: 524179 - DNA, 385 bp, Homo sapiens
  misc_feature (329)..(329): n is a, c, g, or t
tcttatctagaggatcccagcgctgcgcatacagtactttggaagaaatagaaggccttgtaccacaaccgggttgatttttttttaaaacacggattcgggcacaagggctgaatccacttcggggtcatctttttcctcctctgggtgggttaacaagagtagtgaatacttcatttatggacagaaagaaagacacaaactctgaaagggagacttcacttttcactacaaggaaatcaaggtcacggagtcctcatggtggggtgtatctgcggcccctgtgcaaaagtaggggatccaaacttaactttaggagcaagaccggnataaaagatccatctacggatccaggtaccaggtttaaagagggtatggcccaggg

SEQ ID NO: 524180 - DNA, 126 bp, Homo sapiens
  misc_feature (11)..(11): n is a, c, g, or t
  misc_feature (42)..(42): n is a, c, g, or t
  misc_feature (104)..(104): n is a, c, g, or t
ggccctgtaantccagctacatgaggaggcagacaggaggantacttgagtccagaaagaggttgcagtgagccgtgatcgtaccactgcaccccagcccaggntgacagagcgagatcctagctc

SEQ ID NO: 524181 - DNA, 124 bp, Homo sapiens
agttcgggtcccccacgtggcagagctcatgctgtgattatccaaggagagaatagctcaagcagaaaaccgaagtcatgcaattctgagcacttggccttgggatgccacttgggtggcgtcc

SEQ ID NO: 524182 - DNA, 130 bp, Homo sapiens
tgcagcatcttcttcaagtgttcatcagggcatttgttccagcgttcattttggttgccagtcttcccaattttacaacacacatgttgcaggtcaatctttccccaccttccccaacactcacattctt

SEQ ID NO: 524183 - DNA, 1121 bp, Homo sapiens
ttacattgatagcattcgcatgggggctgggggcggcggtaccatgatgtgatagcagttgaatcataggtctgtttgtccttattgtacgtatccgagatccatgattatgagcttatggggttcggtcactcccaatctaacaaatatggcccggggggcgagcgggagctgctgctgaagatgatgttccaaagatcgcggagattcgtagattgctcagttcaggctcgtaatctagtcatctagcgaagcacgaagttgacagctcgatactcgatattacactgctcagtgacccgggtggcatgaacaggactcatacagtgggcttcctttcttttttctttctttctttctttctttatataaaatgggaaaaggggccggcggggctcccccccagggggagtagagagggggcacaaaggggggtggaggaaaccacacagaggagcacacggtgcacaaccccttgtgcacaatcgcgggggactaaacagaaggggaaaaactgcgtggtgagccaccaacgagcaccacacaccagaaaataaaccggggggaccacacaagaggacgccgagtgaaaaacacacaaaacacccagggcggagacaaagaaacgagagtataacacagaggaaaaaacaaacagggggcggggtctatctccacagcaagtgtgtgaggagccaaaagagcaatggggagcagacagaaactcacccaccggtggcaccccaactgagaggagcagtaaagcagcaaccagacaggtggggaccccacagcaacaaaagaagggcagggaggaaacacagcaggacacggagggagaacaaagcccccacacagtggccacccgcaggcacaaggcggggagcacaatcacgatctgagtacagccagcagggggagaaacaaacgcaggaacgagaagggaagacaaactcacagagcggaagtagccacacgaatgacgacccgacgaaggcgagagagagacgagttgaccagatgtgggttgagggacaagaaaagcccccggagacgaacacgacatacagcctcccacaaacaggtggagcccacaagaagggaagcgtcaggagaaaaac

SEQ ID NO: 524184 - DNA, 1724 bp, Homo sapiens
  misc_feature (520)..(520): n is a, c, g, or t
  misc_feature (740)..(740): n is a, c, g, or t
  misc_feature (750)..(750): n is a, c, g, or t
  misc_feature (783)..(783): n is a, c, g, or t
gagaggcgtgaggtggagtgatagagggcgctaccgtaggcaccatccgtagagctgaagccggagcataagggttgatagggccaaggacacgcgcagatgtgagaaatggtgggtctacaagactgaacggagagagagaagaaggagtcctgcaaggtcacccagcctaaccggtgggcacgaatcacaaacgtggcagactccagtgtgaatcagcgcacagaatatccatcgaggaagcagcggctcactcagggagcacaacaaagcctctgaatcgaataattggactcactacagtacgagaaggttatccgcgggcgtagattctcatcatcgaaagtacgtgtcaattgaatagacgatgaggcaaaggacacaacatatgagcacgtttcgattgtctccattttggtcggcattagtataagagatgcccgatacgagaagctatccagggagtcttataaagcatggtctttgtgtacacgtacaggtcctgggtagcttgaacccnttttggaatcgcttgtggccaggaggaataccaaacagaccccgatagaaatattcagagccacatggaattcgggaagcatgcatacgaagatgcgcggctacgtggtttggttgaccattgagaaatggcgcatgcaaggtttgcgtgaaaatgtgccaatgttgtgcattgctctggcccagatcttactaccaatagtgcggcaattcccactgcntgagatagcntgggcattgtgcccacagtcgtggacgcgtacntactttgctgcccatggatcattcatacttacttcgtatacaatcctgtttttcccacgaaattgaagagcaaaaaattcatttgacaacagggttgcggggtgtgcgcggcgagatatcaccagtgaggtattcaacgcaaaggtagaggcgttgccacggacattgttttcatcgtgggatactcggggggaaggtaaagtcaggagatggcagcagagtggagcgaccggcaaaaaagggtgaataggaaggggcaattttacttatcctgaaacagaagaagtccctccgaagggggcccttggggggaaatttccacaccgagaaaggaaccgtctccacacttttgagagccgaaaccccggttgcgggaccattggttcttgggaggaactcttcgtcttggcgggcccaacagtgcgacaaacaccttacacccccacgagtgggggggggagccagcgaagcagcacattagatcgtggggacgcaactagagttgaccaagcagcgcaaagagaggacgcagatctaccgcaacagttctacaacgaagcgggagcagccacatcatataaacagccacggttcaacaacgggcgggtcacacctgggggcgggggagcaaaccccaaaacatcgcactggtaagtgtgccagtccacctccaccacaaaaggaatgtatggcggaactcgtcgcggacacaaaggtggtcttccgacaaggtgttttactagcgcagggccgcaaactataatatatacaaataagtgtatggtgggtaggtaatacatagtagatactgatcagtagaagagaacgacgtgccatccactatcaaccagcggggatgagaacgcttcgtaagacagcggtaggtaccaccacagactcgctcgacggtcaaggaatttggctatcgctaccagtataac

SEQ ID NO: 524185 - DNA, 240 bp, Homo sapiens
tagaggatccctgtgattgatcagcaacgcacccctgtattcagccaacatgtcttaagcactgatcatattctagcagtttagtagtgctgggaatacaaggataaataaaatatagcttccctttgaaagatcgttttttatttacaaaggcaggctgctggtaaacaaattaccgtgtaacaacgtgagaagtattgcaaggggtgtagtgcgtgctgatcatcacaggtaccggcc

SEQ ID NO: 524186 - DNA, 234 bp, Homo sapiens
ggagaaactgctgcctcatatccggtggaatgcgggctttgtgttcaccaaggaggaccccactgagatcagggacatgttgctgtccaataaggagccaactgctagcccgcgctgttgccattgccctatgtgaagtcactagtaccagcccataacactgatctcggtccccacaagacctcctttatccacactctaggtatcaccactaaaatctccatggacaccatt

SEQ ID NO: 524187 - DNA, 342 bp, Homo sapiens
  misc_feature (114)..(114): n is a, c, g, or t
gcccccattggttcccccgggtccccccaaaatgggccgcccaaagtaagcagccctcttttttgttttttggggttccccccctcccttttgaccccccgtttttgggtggcntggggttttcccccccccgggggggggggtttttttggaaggattcccttcccgttgccttgggggccccccccccccgtcttttcgggtttccccccattttttttccaaactttttgtggggggggggggtttacccctgggggggggttttcccccctgtacgggttttttggggtttggccccctttggggggggattcttttttttcccccccccccttccca

SEQ ID NO: 524188 - DNA, 181 bp, Homo sapiens
gatttttaaaacccattggtttcccaaagccccttgtaaggttttgcttttaaaaaagcttcttggaacccattttattggatttggacctaaattttggtcttatctaaaagggccttttctggctggaaaaaaaaagctttgggatggaatttaataataaattaggaatcttaatgga

SEQ ID NO: 524189 - DNA, 280 bp, Homo sapiens
tagaggatccctgtgattgatcagcaacgcacccctgtattcagccaacatgtcttaagcactgatcatattctagcagtttagtagtgctgggaatacaaggataaataaaatatagcttccctttgaaagatcgttttttatttacaaaggcaggctgctggtaaacaaattaccgtgtaacaacgtgagaatgtattgcaaggcggtgtagagtgcagttgcgtgatctatccaagatcagacgaatgccggggataccgagactcgaagttcgtaa

SEQ ID NO: 524190 - DNA, 898 bp, Homo sapiens
tggggaaggagcgactctggaggcgaggagggtgtggggaaccccccagagatggcgcttcttgagaggcctgaaaccacctggaacggagtgtggggcacattgatcccctgagtccgggctggaaatctcggagttaccgcattctgcggccgagctagtgcgcagcacaagagtgcctgggacagtcacggagctcctggagcgctgcccgctggcacctctcctggacgtacccttgacaacaagacggcaggccgagcaggcctattcatcttgcaagccgagccctgcccgtgaccaggacaacggcctccgcgctcggcgaatcacccctcaactgttgcgcgcttgtgcgccccacgtgcctaacatgacaccagacgacacagctggaaccattgcagggcgcacgacccccctaccgggctccaagggcctggccccaacatccgcccaacgcgagacccaggccagtgggaatacgggaattgcgtcgcccgaaacctcacaaaccgcagggccaacatcaccgggccaaccctctggaacgaattgctggcgacgacacatcgcgcagcgctcggaagccacttcggcaccctgtggacaatttgagtgcaacccaacttgtgcccaacgttgtccactggagcaactaactgttctaccaaccgggcgccacgcctggcagctctcggggcccctttcccccttagggcccccattggcatcacccctggcccccgctaaccgcgtctaattcaccctcgcattaaaccttacaaccgcggatcaggggggtaaatcaggcacggcgaccggctcggccgcaaaggcctttcggaccttatcgcatcgactcaaacggctttctggatttgaccatatcacatct

SEQ ID NO: 524191 - DNA, 168 bp, Homo sapiens
ataacttgacgaacctcactaaccctcaccctagccgcgagtatgagtccctatttataggaaggtaaatcaaggatgatcccaaaacgaactaacagaccagtgcatcatgcacaacagactcaggggtttaccacgaagcgcgcttaacgcgggtcatggtagaag

SEQ ID NO: 524192 - DNA, 242 bp, Homo sapiens
acgtatgaatgtggtctgggtgttgtggtaaatcctggattatggagtcagaagccatgagtctgccactcaatagtgatgcaaattagcaccagcctgtagtcccagctactgaagaggctgaggcaggagaattgcttcaacctgggaggcggatgtagtggtgagctgatattgcaccactgcactgcactccagcctgcctggagcaacatgagcaggacgtctgtctcacatagaag

SEQ ID NO: 524193 - DNA, 534 bp, Homo sapiens
  misc_feature (309)..(309): n is a, c, g, or t
agactgaattcatttctagttgatgaatgttgtcttgttctcccctagagcaattacttccttaaaatcttcatttcaaaacatattttacttcatcaaaatagccctcaatggcagccgtaattgaatggttttgttttttaaatttctaattctctaaatcttcattggtcaatgttttaggacatggtaaggatctttgttcaaatgtgtatgcgtgtcaatgtgtgaatgcctacgcatgatttaattcttccagttgataattggaagataatgagtcaatcagacatatttaccaattaactnttctgtaagaattcataaactagacatgtgagtcctgaggaaaagaaaaaagaatacaacccctgccctaaaagacccgaacgtgtcagattaaaataaatttggccaagggggaaggggcacacccctgaagtcccagctactcagaaggttagggtggggaattcgctgaagtctaggaattcgagaccagcgaggggaacaatagcaagttgctgtctctaa

SEQ ID NO: 524194 - DNA, 833 bp, Homo sapiens
gcaaagatccaagctgcctggagggtgctttcactggcggcagaaattcctccggtgtgaagagatcagccatctgcatccagtcgtggtggcgtggaacactgggccggaggaaggcagccaatgaggaacgtgggcggtacatgatcatccggcggctcatccgaggcttcatcctgcgccaagccccactcgctgccccgatgaacgccttcttcctggaccatgtgcgcagcactcttttatgcgtaagacctgaggcggagctgcccagaatgtcctggacacctcgtggaccaagccacccacctgccctgcgtgaggcctcagagcttctgcgggagttgtgcataaagaacatggtgtggaaatactgccggagtatcaggcctgagtggaagcagaaggctgaaggagaacgggcgtggctagatgagatcttcaagggcaagaaggataattaccctcagagtgtacccaggctcttacatcagaaatcggattggtaacagatgagatcagaaccaccgagtgctagcaggcctatgggctctgagcccattcagtatgcggatgcctgttgtgaaatacgaccgcaagggctacaaggcctacgatcacggcaggtgctgctcacgcccaaggccagtcagtaatcgtgaagcgacgccaaacgccaagcagaggactcgactaagcaaaaacgtgaaacggaaatctctgtacagcaagactgagcgaacagacatataaggtgataaatggtaaaaggtacggaacaataggaaaaggggcaatgtgaagatgaacaagtgacaaagtgattgaaaacg

SEQ ID NO: 524195 - DNA, 485 bp, Homo sapiens
caagcccggcagcccgagaggaacatgaacagccccaaggcagaagcctctggcaagagtggaccccgagcccgcccccaggtagccagaagcggcctcagcggaaccgcaaactccagtagccgcccgtgctgcccgtgggctgggcgagggcaagcagaactggggaccaaggctccggggcaactgtgcgcacaggcctcacacctgaacgctgtcctcccgcagacgagaccggcggcaactgcaaaattggaatcgtctttggagggagaaaaatatgcgagtatgagatctagggcgatattttacactgacacatcgcgtacacctcttgtttccaaagtttttgagagctggaagctctgatctcggtgtcaaatatcgaccgctgtgagaccgtgttttaaacccgaaggtttgggagtttcagtgtgagcaggacaagtgaagaggttgaggctggtcaggacatctgagggctg

SEQ ID NO: 524196 - DNA, 924 bp, Homo sapiens
  misc_feature (1)..(1): n is a, c, g, or t
  misc_feature (11)..(11): n is a, c, g, or t
  misc_feature (31)..(31): n is a, c, g, or t
  misc_feature (42)..(42): n is a, c, g, or t
  misc_feature (71)..(71): n is a, c, g, or t
  misc_feature (81)..(81): n is a, c, g, or t
  misc_feature (108)..(108): n is a, c, g, or t
  misc_feature (200)..(200): n is a, c, g, or t
  misc_feature (224)..(224): n is a, c, g, or t
  misc_feature (226)..(226): n is a, c, g, or t
  misc_feature (256)..(256): n is a, c, g, or t
  misc_feature (268)..(268): n is a, c, g, or t
  misc_feature (357)..(357): n is a, c, g, or t
  misc_feature (392)..(392): n is a, c, g, or t
  misc_feature (399)..(399): n is a, c, g, or t
  misc_feature (417)..(417): n is a, c, g, or t
  misc_feature (475)..(475): n is a, c, g, or t
  misc_feature (489)..(489): n is a, c, g, or t
  misc_feature (493)..(494): n is a, c, g, or t
  misc_feature (498)..(498): n is a, c, g, or t
  misc_feature (501)..(501): n is a, c, g, or t
  misc_feature (507)..(508): n is a, c, g, or t
  misc_feature (530)..(530): n is a, c, g, or t
  misc_feature (538)..(538): n is a, c, g, or t
  misc_feature (551)..(552): n is a, c, g, or t
  misc_feature (555)..(555): n is a, c, g, or t
  misc_feature (560)..(560): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (579)..(579): n is a, c, g, or t
  misc_feature (583)..(583): n is a, c, g, or t
  misc_feature (586)..(586): n is a, c, g, or t
  misc_feature (601)..(601): n is a, c, g, or t
  misc_feature (603)..(603): n is a, c, g, or t
  misc_feature (608)..(608): n is a, c, g, or t
  misc_feature (613)..(614): n is a, c, g, or t
  misc_feature (624)..(624): n is a, c, g, or t
  misc_feature (627)..(627): n is a, c, g, or t
  misc_feature (636)..(636): n is a, c, g, or t
  misc_feature (639)..(639): n is a, c, g, or t
  misc_feature (648)..(648): n is a, c, g, or t
  misc_feature (652)..(652): n is a, c, g, or t
  misc_feature (657)..(657): n is a, c, g, or t
ntccggcggcngagctccaccgctgaggccnacgaggccagntttttatttgtttaatttggtaaatgtanaatgtgaggngggggggggaaccctggactacttcantcacaacccaatagttaacatgattctgaagaacagtcttatctgcgatatctacccacttctaaacaaacacatctatagaaatccatgtncatatatattagttttcaacaagngngggggggcaacaactctaaaatttcaattntatattctgaanacacttcaaaattatccacttgatgcgggatataaccatagggagataaaaattcatgcaatgatactcaggggttttttttaaagggnaatccaatatttgagcattcaatgctacataaagnggattgnatatcgaaaataaaacangcgccaattttatcattaattaataacacatttattatcttgaaaccaaactgggccnaggtactttttggntttnngagncanctctgnntaaactcatttctctcaagctncctggganataaaaccaagannttncattnattctttngngntaacaanaaanggnggcgggctcaagggngngatgncttgnnaattcagagncanaagggcttnttntgggcggangggnataancgctacttgtccgccactaaaatctaactatcttacttgctgggcggatcaacttctaaagggtggggggcatcttcatccaaactagggggggggggggccctaaggggggctattacttggcctgggcgtggtggccggggcgttggggagcggggagttaaatgggtgttgatggggggaaggggggcgcgagaagggggggagggtttggcgaaaacctgggtcccccggagttccagggggggagaggtggggggtcgcggc

SEQ ID NO: 524197 - DNA, 163 bp, Homo sapiens
ctcagaggcactggtggtgaagtttgtagggaggggcactctcttgccctcgcagatcaggtctctgaccaactcctacttgggatccataagctggtgggtagggagcacctgtgtctgggtcccaagctccctgctccttcttatgtgactcgtggaaatg

SEQ ID NO: 524198 - DNA, 143 bp, Homo sapiens
gatgtattgtgtgtgtggctgggatgagggggctagctgggggatgaggctgccgaggtggctgaacgtatgggatggaattagagcttcagaccttggacgtcatcctgggccagcacagtgctgcgaggagccacttgtgt

SEQ ID NO: 524199 - DNA, 746 bp, Homo sapiens
tgggttgagcacaggtactttattggatggtcacatgaaaaggtgcggccccctaggcccctcccctcttcaaggggtctacttggcaactgtgaggaggtggaaatctcagtgtggggggtggactgatgtgtggcatgggacctccccagcagtgatgggtctctctctcccctcttgtgctcttgctggtggctgtgtggctccaggggctcttactcctttgtgagcgccagtgtgggccatgagtgtccaccaccctgttgcttgtacgccaaattcgtagtcataccaggaaatgatgcttgacaaatgtggtgtcgtgaaatgggacaatgccagccccagcgtcaaatggtggagagatgtggtgttgtcgctgtacgaaagtcatgaggagaccacctggtgctcagtgtaccccagtgatgcccttgagggggccctccgacgcctgtttcaccaccttctggagtgtcctcatattgggacgggtttcctaaacggcagtgtcaggtcccccacgtgcaccacgtttggcaggtgggcgacccaggaggtgcacatagccagtgagcatctcccgaacagcctacaggaatgaccttgcccaatgcctagagagcgccattaaaggcagggataatgtttgaaagcccggggcattcagccaaaggtcccgaagagccaccacaagtcttctggtgcagtaggattacttgtgaaaacactcagaacaaggttta

SEQ ID NO: 524200 - DNA, 132 bp, Homo sapiens
tgaacatcggtccatcgtgtctcattcgtgtcctgaacattcgtgttccgtccgtcagttgggcacgagtcttagcagttctagattctatgtcttcttgcatgccgtccgtcagttggacacgaatgttca

SEQ ID NO: 524201 - DNA, 363 bp, Homo sapiens
  misc_feature (16)..(16): n is a, c, g, or t
ttaaaaaaaaaaaaanatttgaagcccctcctaaagataatatagcctaagcccttttcttttctaaaacccatccgcctccttttaaaaggatgaactaaacccggggtatgtaatacccgtgtttcccaaccggccatttatgctttaaatttaaaaataaggtcctttttccccccccggggccaatgtttacttgtaattttcttccccccgttcgggttaaaataccttttcccattattaaattgtaaaccccctggggtttggccccctttaaaaattcctctttgtattcccctaatttttggacccgttttggccctatggtagggccttaataaaggtttgaatgagtgtgta

SEQ ID NO: 524202 - DNA, 374 bp, Homo sapiens
gtgttcttccaaatgttttacacagaatttgtgttacttttgtagtcaaaaaaagtattctttaattttctaattttcaaaaaggatggtttttttcttccctgttaggtattaatatagtagggaagtaacactcaaaacaagtcaggaggccaggtgcagtggttcatgcctgaaatcctagaactttgggaggctaaggcaagaagattgcttgtacctaggagcaggaggcggaggttgcggtaaggccacatcatgccagtgcactccagcctgggcaaaagaatgagatactgtctgaaaaaaaaaattaaatttaatttaaaaataaaattaaataaataaatttgggattaaccagttaactgtca

SEQ ID NO: 524203 - DNA, 208 bp, Homo sapiens
  misc_feature (30)..(30): n is a, c, g, or t
  misc_feature (98)..(98): n is a, c, g, or t
  misc_feature (105)..(106): n is a, c, g, or t
  misc_feature (175)..(175): n is a, c, g, or t
  misc_feature (197)..(198): n is a, c, g, or t
cggctctgaagtatgcggaggcctcctccnggccccggcattcgcggagaacgagcctcgcagaagtttggctgcagctgcccgggcggcgtcgtatnggctgcnncgcggccgcgcgggggctgagcgggcgccacttcctccgggccggcttttgtgtctggcatctcctccncatgctgcgtctgccacctacnncggcggccgc

SEQ ID NO: 524204 - DNA, 542 bp, Homo sapiens
  misc_feature (125)..(125): n is a, c, g, or t
  misc_feature (542)..(542): n is a, c, g, or t
tttacagagaggggttaaatgcataaatctttttggaagttttgtttaggctcatcctacataaatatttatattttggctccgtactttaaaacataagtttctactttccttaatggtttttntaaggagggataaaagacccttcttccttatttgaaaattctggccatcaactcgaactgggattatgaacaccaactccatcaaagctatacttttgattctttttggggggcagggaaaatgcaggaaacaaaagaaactggggggctgttggaagggaattgataccatacttctttcaaagaggcacacttacctgtccttgacagaattaaaggaaactaatgtataaaaaaaatatccaagaacataacgcacaaaaagtgttggccatacggaaaagcaaaaatctaccttttggggactattgcttgcatgagaaggcccccagcttgatactaatgtttttaaatccaaccggattcggtcaacctggtgtatccctacatgtaagactgcccgcaccccgggggttn

SEQ ID NO: 524205 - DNA, 481 bp, Homo sapiens
attgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccgcgctacacaagcctggaagccgctgtgtgccatcggggccttggtcccgtgccttggctgtcgttccccgttctcattctcctctccccttcctcactgaaggctgtgagttgctttcaatgtgacaacactatgatgtcattcggacaggatttgccaggacagactgcattctgagtcctgggtgccgtatgtgtatgcggcagtgttgtcaggcagatcttgatcgaagacatctatgttgccataattaccatcaagtacacacatgtcggcaaaaggctaacaactga

SEQ ID NO: 524206 - DNA, 310 bp, Homo sapiens
  misc_feature (30)..(30): n is a, c, g, or t
  misc_feature (68)..(68): n is a, c, g, or t
  misc_feature (97)..(97): n is a, c, g, or t
  misc_feature (100)..(100): n is a, c, g, or t
  misc_feature (108)..(108): n is a, c, g, or t
  misc_feature (120)..(120): n is a, c, g, or t
  misc_feature (251)..(252): n is a, c, g, or t
  misc_feature (274)..(274): n is a, c, g, or t
aattaaaaacagggaagttaaatctatagnttatattaacaaactgcaagatctagatcttgcctggntcttgactcggttaaaccaactgtttaanganccttacgngaccatcaggangtttgagtattgactggtacttggcatcaaaaaatgttttagcagtcttacacaatggtattgtggttatgttcaaaaaagtaccctatctttggggttatatttgaatgtctctgatcacacaaacatgnnaatactatgcctgttaatgggnctcaaactgctccctgtgggttggggccggggctag

SEQ ID NO: 524207 - DNA, 433 bp, Homo sapiens
aggtgatctagaggatcccatctacttaagtcttaaaaaatttcacacgtttttcatagtagtgggctagtttacattcacaccaaaagtgtaaaatcattcctttttcaccacatccctggcaacatgtcctatttttttattttttgattatgatcattattgcaggagtgaggtggtatcacatcggggttttgatttgcacttctctgataattaggtatattgagcatgtttccatatgcctgtaggccatttgtatatcttcttttgagaatagtctgtttatgttcttagcccactttttcatggatttttttttttttttttggggggatccgaatgagttttcggaaaattcgggatataagttttgggtcagatgtatagatataagtcttgggtcagatgtatagatggtgaagatttcctc

SEQ ID NO: 524208 - DNA, 283 bp, Homo sapiens
ttggacatcttgactcactacaagctccgcctcccaggttcacgccattctcctgcctcagcctcccgagtagctgggactacaggtgcccaccaccatgcccggctaatttttttgtgtatttctagtagagatggggtttcaccatgttggccaggatggtctcgatctcctgacctcatgatccacccacctcggcctcccaaagtgctgggattaccggcgtgagccactgcgcctggcccctcaatccacagtttcatgcccatgcgtggattgccag

SEQ ID NO: 524209 - DNA, 471 bp, Homo sapiens
cagccaagcctcctaggaggtaagaatgggaggtgggaggtggcaaggaagaaagagcactgggtgggaaggacctgggctacttttcatctcggaggctcaatttcctcacctgtttgaagaggaaccaatttggcctacctcagcaatgcttgggagaattgcatgggaaattaatgtgaaaatttggaagaaagcagtgcacactaggagacgcaatggcgtatctaacctcagatatcccttcccttaatatgactaccacccagaaccacctagcctaggtccccagcagtagaggatggatggctttttttctgactcctacaaatgcaacatgctctgcctccctcaaatccttaagcagcgacgaactaatcctgaaactgcttttctacagcccatggtgcttagtataaagctgtgcatacagtaaagagaggttaaattaaactccctagtagactgaaa

SEQ ID NO: 524210 - DNA, 856 bp, Homo sapiens
tacccctctttagttttatgcgctcaaaaaccaatttaaaccccccccccatgtaaagggggggcagggaaaaaagacaaaaacgcacaaagccagcgcgggaaaccaccaggtcctgtgccccccgccattatttcgccctgtgagtgggattttgggttttctcattcttgctccctgtgttggcttggcggtggagtgtggggggtggagcctctcctgtcggggggcactgggccactgtgagcccccttgggaagaagtatcagaggggagggtggagagggccactggtgctccgggccagtggcatctgcgggggaacaggggctgtggccccccaagaacagccacgtgggagggcagagagggggagggataggggcaaggggctcatcactatcgagcggtgctcaaaggaaggggtgcctcgagaagagccaaacagagagagggggacctccagggacatgggaccgaggaggcttggccagaaaggaggaacaggaggaataacccaagggtggtggtcacaacagagacaggtgtctcaccactcagaggcatgggggcgcaagagggtgaggccaggcactttccggcaacacttggggaaaggaaagcactaccgcgctatccacatcgggggaaaaactcctgtgccccgcccgctgagagaccgttggcgatgaggcactccaggagaggcccaaaaaagaccaggggggaaaccacctggggggggcaaaggggggggataagcgacggacaatacagcgaagctcacaggacgggtcatgaccgcaagacaaggaaaggtgacagacctggacaagaaaccgcggtgggccccgac

SEQ ID NO: 524211 - DNA, 974 bp, Homo sapiens
  misc_feature (126)..(126): n is a, c, g, or t
  misc_feature (138)..(138): n is a, c, g, or t
  misc_feature (255)..(255): n is a, c, g, or t
  misc_feature (312)..(312): n is a, c, g, or t
  misc_feature (314)..(314): n is a, c, g, or t
  misc_feature (317)..(317): n is a, c, g, or t
  misc_feature (361)..(361): n is a, c, g, or t
  misc_feature (365)..(365): n is a, c, g, or t
  misc_feature (374)..(374): n is a, c, g, or t
  misc_feature (393)..(393): n is a, c, g, or t
  misc_feature (395)..(395): n is a, c, g, or t
  misc_feature (400)..(400): n is a, c, g, or t
  misc_feature (410)..(410): n is a, c, g, or t
  misc_feature (431)..(431): n is a, c, g, or t
  misc_feature (453)..(454): n is a, c, g, or t
  misc_feature (504)..(506): n is a, c, g, or t
  misc_feature (508)..(509): n is a, c, g, or t
  misc_feature (519)..(519): n is a, c, g, or t
  misc_feature (531)..(531): n is a, c, g, or t
  misc_feature (548)..(548): n is a, c, g, or t
  misc_feature (595)..(595): n is a, c, g, or t
  misc_feature (657)..(657): n is a, c, g, or t
  misc_feature (661)..(661): n is a, c, g, or t
  misc_feature (664)..(664): n is a, c, g, or t
  misc_feature (672)..(672): n is a, c, g, or t
  misc_feature (685)..(685): n is a, c, g, or t
  misc_feature (818)..(818): n is a, c, g, or t
  misc_feature (835)..(835): n is a, c, g, or t
  misc_feature (855)..(855): n is a, c, g, or t
  misc_feature (869)..(869): n is a, c, g, or t
  misc_feature (873)..(873): n is a, c, g, or t
  misc_feature (884)..(884): n is a, c, g, or t
  misc_feature (904)..(904): n is a, c, g, or t
  misc_feature (974)..(974): n is a, c, g, or t
tcggcttacatatttccaaggaggaaaaaaaagattctaagaaataattaaaagtagaactaaaatagcagcgattttttgagaaaccacacatttcatgcatcaaatattttttgaatgaaaggnataacatttgantctcttctgtgtcctagataccatcctagacatgttctctatctcataacactcatccctcacaaccatcctgtatcttagaaaccattctgcctaattaatagatgagaaaacgtngaagctcagaatgtgtccagtgacctgcctgcagattatacgaccaatctaggacanangcngaattcaaattcagctgccaattatgttgcagataccatctganaaanttctatttntttctaatcataatatttnanaaatnaataaatgtnaatgccatttaatcaaaactnaaaacattgaatgagaaaatgnnttagtctgacctacagcatgaaaagaaaaagtaaaataaactctttgggnnngnncagtgcagancccgtgacaggncaatggctgtttatcanttcaaagatttctcaaattttggttatgggtttttctatcctaaggnaaacattcttttcattaaacctgtaattttattttttccttgtatgaattcccttgcttatnagtntcnttaatagnaacgttcagtgtnttaatgacagtaagtacctattagcagttgttgtaagagtgtggtcaagggcaaatataccacctatatctttataagttagtcttccagtagccattgaatgtatgatagaaataatctattattttcctgnagctgagtttctatttncttttggggggcagggagcncaaagatgcagatnaagnatacatatctnactgccaaaaagggtgcaantcctggcatttcattattctgaggaaagagtcataataaccattatgaattagattacatctttttctan

SEQ ID NO: 524212 - DNA, 628 bp, Homo sapiens
gagagagagagagagagagagagagagagagagagagagatacagatagtcatagcattcttgttatctcctcacccctcctatttccttacttctttcgtctcttcctcactctttcttctttctcttctctctattcttttctcctaccactcctcttaccttcttcttctcttttgccccttcttttctatttctccctcttccttctccctcccttctctcacctccttttccctcttctttttaccatcttcttctttcccctcctcttctctttttttctctctttttcctcttccccttctttctcgtttctctcttctctcttttctctcctttttctcttcctttctttcttcccttctctctttctctcttttcttcttcccttcttcttgcttccttctcctttctcctttttcctctcttttctcttcttctctttctctcttttcttcttcttctctctttctctcttcttctcttcctcctttcctcttctttttccgttcttctctcttatccctctctttcttctctttttattccttctctccccttctttactttattcctttttcttcctccctttcttttctttctttttccccctcttcttcatttc

SEQ ID NO: 524213 - DNA, 645 bp, Homo sapiens
agcgagcaccacaacctcgtatcagatttctagatagacaggatcagattaaccagaagatgatgcaggccaccgttgccttgtcggccgtgctgactgtcgccgtaaggggcaggccggcggcgaggaggaggagcgccaccgtggccgccggcggcagaaggatgccgggcggtgccgttcgtgcatcggccgccgcggcgccggaggcggactacagctccagcgtctcggtgttccccatggaggcctgcgacctggtcggcggcgaggcctgcgacgcgcagatgtacccggagacgaagctcggcgccggcgccggtggcccggctgccgccgtcgcgagggcgccggaggtggagagggagtacctatcctacgacgagccaaaaacggtgttcccggacgaggcgtgcgacgatctcggcggcgagttctgcgaggcgccctaccaaaccagcaagtaactaactcaagcagcttactacgaactactattaggtgtaaaaaacggctcttattctcaggcagaggtcgatcggatgtatatcatgtgaataagcaaaaaacatggctgctacgctgctggcctgtaactgtattattggcaccattaacgaaatggcagtcatcaaaaatacaata

SEQ ID NO: 524214 - DNA, 402 bp, Homo sapiens
ctataacaatattacaagttggtctcccacacaccctacttctcagtgggctccaagaaggcagagaacatcttagccatcttggtttctctagcacctggtacaatgctccaaaaagaataaaagcactggttcacgtctgtcatcccagcactctgggaggccaagatgggtgaatcacttgagctcaggagttcaagaccagcctggacaacatggtgaaaccccatctctaccaaaaacacaaaaattagccaagcataatggcatgtggctgtaatcctagctacttgggaggctgcagcaggagaattgcttgaacctgggaggtggaggttgcaatgagccgagatcacgccactgcactccagcctgggcaacagagtgagactctgtctcaag

SEQ ID NO: 524215 - DNA, 86 bp, Homo sapiens
ggagggctgggcacaggcagtgctatggcctttttttttttttttttttccaataaaagaacttgcccagcgtgaaaaaaaaaaaa

SEQ ID NO: 524216 - DNA, 608 bp, Homo sapiens
tagttatactggttcatgtggagggaagtaatgtacgaggaggaaggtctggatgtgtgtaataaaagacaaaatttttttccaaatattttcagtctatagttggttgaatccacagatgcagaaccaaaagacatggagggccaatgatactttcaattctttcaaatacaattaaagcttgttttgtgggccagaataccatccatcttggtgaatattccagatgaacttgaaaacatacacacagggccaggcacagtggctcacgcatgtaatcccagcattttgggaggccgaggtgggcagatcacctgaggtcaggaattcaagaccagcctagccaacatggtgaaaccctcatctctactaaaaatacaaaagttagctgagtgtggtggcatgcgcctgtaatcccagctacttggggggctgaggcagggagaatgtcttgatcccaagaggcggaggctgcagtgagccaagattgctccactgcactccagcctgggtgacagagcaagactccatctcgaaagacagataaaacaattaaaaatacgtatagaccggttaaaagtaaaagcatgtaaatgaatactgtgcaa

SEQ ID NO: 524217 - DNA, 1133 bp, Homo sapiens
ctagcatgtaccatgcgtcgactatgctaggaatactagtgatatcgctcacagcgctcatatcctgccctactatgcctaggaaggaatagtactatcgtctgtgtcattcagtaggctactctcataaccctcgaacgacccactcccatcttagaccaatattgtgccgtattgccatactagtctttcgaccggctgcgaagcagcggtgggcctagccctactagtctcaatctccaagacatatggcctagactacgtacataacctagacctactccaatgctaaaactaatcgtcccaagcaataatattactaccagctgacatgactttccaagaagcacataatcggaatcaacacaaccacccacagactaattattagcatcatccccctactatatctgaaccaacatcaacaacaacctatttagctgttccgcgcaacacgttttcctccggaggcccctaacaaagcgcggctcctaatagtaactagcgctgagtcctacgccctcaaatcatggcgaggcaagcgccacttatccagtgaaccactatcaccgcaacacacacactctaactcctctatactcaatctccctacaaatcaccacatgatccctctgcacatctcacacagcaacaaattattcgctatcactaagtgactcctcgacaaccacaccttctaccaaaacacgcgatagagaaacaacaccaacagaggatatcaaacaacaacaacaagaaacgacaggcagaaacacacgcagatcaaacagaccgaacgtggaccacccacacacacaaacacaagagacaaaagagcaccacgaaacacacaggagcacacacgacgtgcacaacacagacagactgcggcacaaaagctcacaccgacccgcgacccacccagacgagacgcagacgaaacacaggcagcgtaaaaacgccaaaaacacgcgaagagggaacccgcgcgatacaacccacagcgagacgcaggcaacacgaggagaaagccaacggcagcacgcacacagggcggcgagccgcgccaccgccaccgggccgaaacgccgccccggcaccgcgaaagaaacaacacgaaggacgccatcgca

SEQ ID NO: 524218 - DNA, 109 bp, Homo sapiens
tgattcatggctgtagtcgacgtgtattcaccactgcggtgcatgcctccctgtacaagttcctgtcgacacgatgagcaccgtgcatgacctccaaatatctgattaa

SEQ ID NO: 524219 - DNA, 239 bp, Homo sapiens
atctagaggatccggtgatgttatcgccacactcactttaagtcagagaactgaggcgagagaagtaaatgagttgccgaagtctcagagagcaagaaatagagatggacttggggcactagatctctggttattgctgtcctgtagttcatggagctggcagatggatacatctgtgacctgcgatgatggagagactgctggacccttcagaggatctcatctcaaggtggggataa

SEQ ID NO: 524220 - DNA, 559 bp, Homo sapiens
gggtggctttggagttgcagttgatgtgtgatagttgaaggtgagatgggtctcctgaatacagcacactgatgggtcttaactctttatccaatttgccagcctgtgtcttttaattggggcatttagcccatttacatttaaggttaatattgttagtgtgaatttgatcctgtcattatgatgctagctggttattttgtctgctagttgatgcagtttcttcatagtgttgatggcctttacaatttggtatgttttttcagtggctggtatccgtttttcctttccatctttagcacttccttcaggagctcttgtaaggcaggcctggtggtgacaaaatctctctgtacttgttttcctgtaaaggattttatttttccttcacttatgaagtttagtctggttggttttgaaattctgggttttttttttctttaagaatgttgaatattggcccccactctcttctggcttgcaggttttctgcagagagatctgctgttcgtctgatgggcttccctttgtgggaacctgacctttctctcttgctgaa

SEQ ID NO: 524221 - DNA, 174 bp, Homo sapiens
gctgtcatggtgtcatatttgtggtcataccccacctccagcccctgcaccacgggtctgtttactgacttgattgtaacaccttatgctaggatgtcatgtaggcggaggcgttcagtacaaagactcctgtgctgagtgtgccagggttgagcaccatctaagttggtgcgt

SEQ ID NO: 524222 - DNA, 821 bp, Homo sapiens
  misc_feature (280)..(280): n is a, c, g, or t
agcgggctttagcttcggccccggcggcagggcgggaagactggtgtggtctggccatggatgggctccaggccagtgcagggccgttgaggcgcgggcggtcgaggcgccgggcaaagcccacagccacacagcgggtcggtcctggccctgccccttggaggtccagtgaagatacgaaaaagccagctgccgaaggtgtttgtaatccccgcatgtgcagccgcctgaggaacgcaagacagcccgtagccgagcaacctcgggagggacatcggangcgcgtgagacgtccggaaacggccggaacggacccttggggtggaaccagcagccttaaccccggttgaggggctggcacggcggtgtgaccgagcccgtttcccgggagacggcacaagacccggggccgaagacgcccattacctgggccacacccctgtggtgtgcctcgtgacacataaggtcttggctttggtgaaggtgcctttcggaaccacctcgcacggatgacgagcatccaccctattggcaaagagccgacggggttacagagacggctggcccttgtagtaggcccacggatttttcccggcggacacgagcacggcaagccaccattggggtggagaggggtatgacacagccaggagcccaggggttaccaggagagtgggtgggaaagaacacattcagagccctgagctagttcgcaccacgcgcgccacaacactttacaaggggccaggcacacaagtacgactcccgggggggcccctgggcaaacaggcagtacagagagcctgaaaggttgggattaa

SEQ ID NO: 524223 - DNA, 1528 bp, Homo sapiens
tgaaactaggtctcacaattttgccccagggtgggtctaaaactcctgaaactcaagcgaccctcccacctcagcccccccaaagtgtgctgaactatctacaggcaagggcccaccatacacagtttaagaatattatttttgggtattttccacagctcgtgtcaggaaaagtctttaaaaagaaaaagatatggggtgttacaagagttaagaacacgagcttataagacacagaaaccccttgtgttaaacacgaggaacacaactctacgtggctttaaccccgtggagtgttcctctataagcatattttctgctctcttattttacacaaactgtgttttagagactactcgtgcaatagtttctacattcgagcctttctccaaatttataccaatatttggtgcaccttattattctccccaccatgtgttccccaaatatttaaagcagagtatcctatgagggatttccccctatacaaagcgggtgggcacctctcaattctagtgtgggtgtctcccagtttaacactatttatttcacggggaccaaacacctagttggggtctttaacacagagtatcaccgtggtgtgggaaccacttgtgggggacacaacatattcacaccttaagaaacagtgccttcaacacaatgggtttccaagcaacaaaatctgtccccccaaaaagtcctctcataacgggggatcccaataccaaagaaccaattgtcgagaacagttgttacacccacggcagtatcaccccagaagggcggttgcttgcacaccctattaacccatgaaagcccaaatagttgcgaaaacccaatccctctgtgccccgggagggaatcacacacttagtggaaaacaggtgggcaacactataaattgggaaatctccagggagttgggaaccccaatctagagttatacagaacggccaacaggaacagcacaccgccgctatacaccgcatagttacagccagacgacaggggtggtcctaatccagttggaaaagcgtctctagaaacaatatagctgcggacgcacctcccacacgtggacggtggccctagttaaccagataacttcgtaggagaaaccatcacggcatctattccccgaggacatctgtgacaaaggggtgactaaccatcaagggcaatcaagcgacgtgtgcctccacaacaacacctcactggggagggctcaccccttgcgcataagcagaccatcgaacgggcggccgtactgcaaacaaatcacaagcaaggcgagtgccttactatggcaggacaacctatcagacacagaaacaggtggtggataacacacaactcagggaagaaaaccaatgctttagcgctcataagaatgtgctgtgacgcaagcagatgagacagccacaggacaagaaggagagagatcaccacacataacaaacgacaagcaagtacacaagaataataacatagatatcatgcgacttcatcgtgtcatctgttttgt

SEQ ID NO: 524224 - DNA, 357 bp, Homo sapiens
  misc_feature (57)..(57): n is a, c, g, or t
cccgaacccgttggaggggcagtgctgcacggcgcagtaggcttaggacagcagggntgccatgagactcttaatgctgcatgatctagacaggacgtacgacgtagccgtcatgctaatgactgagaccgtgatgactttgcaagactagctagagctaagacagatgggagcagactagctgcctaagaacagcatctcgagcgcatctcgctatgacgcaatacttcgccaagagctcttggtagaagccactaacctaacgggtgagctgataggtagctgatcgagatggaaccttacatgatctcaagatgtgcatacagatcggtttgaatgcacctgtgaatggcagat

SEQ ID NO: 524225 - DNA, 129 bp, Homo sapiens
  misc_feature (66)..(66): n is a, c, g, or t
taagaagtaaatccttagttctcttgcctaagttgcgcctctctcactgaaagatatgtataatantgcgtataatggcgtttagagtctgatagacatgttttatattatatacctagctagctttag

SEQ ID NO: 524226 - DNA, 1235 bp, Homo sapiens
taaactgcagatgaatgagcaaaaaggatgacacgccagcagagtgacttacgagagttaatttagcagtcttcgtgatagactcttcagaattatttatgtccctgtcactatttaatatcctttgtgccgtgaggctcctcggatggttgttgtaaatagttctgccttgtatttaattaactacccactagaaccggaacgtggtgctataggacagctatcctagcatatagatagtaatgtgtaggttcgcacatagtacatcatgtactagaccacgtagcgctgaccgaacagtctctaggagaggaatagggcttatccaaggtgacatatgaagcaccgccatatatactttactatactcttagccttctactatgcctacaccagaaagcaccaactcgactactctaggcgggcacttacacacaatagacccctcattagcgcacaatctggcaacggacacgcagctcacaataggccgtcgtaaattcagatcctcaaataagggagacaccaagtacatcccagcttcaagggtcaactgagtgacgaccaactttgccacagcgcatagcacgcctgacactcctatcaagataactatcaccttccaaggataggtcccctctgggacttgcgcgcaccgacatcgtctgggctatttacacacccaactttatcaccacggccatcaaaacacgtctgtcatcagaccacaccttgcccacctactgcactagcggatggcccttcatgacgagcatcatcaaaaacaccctaggggcacccacctgggaaccaccagcactcacacacaacccccatgctcaaagaccaaataaacggcgcagcagggcaaacaccagtcacagagcaaggagacacccacaaccaacatacgcaacacacgccaaacgacccacactagacaactgatacgacatcaaacgcaacccaaaacggacatcccaccaacacagagagcgaaacccacagaagcatacggcaggactagcagacactacggggacatcctatcacaatcaaccacagccacaaacggaacaaacacacacctaaagagcccgaacctcaccacacaaaaccaacaaacacggccaagcaaccgcgcatctgaacaacgagaaaacacaccatataacacacccgagcaaccataccacggaacagccacacacaccacgcgcaacgaacaaacaagg

SEQ ID NO: 524227 - DNA, 150 bp, Homo sapiens
aaggggaggacgacagaaggttatgcatgcttttcttccttccatggcaaccatctccattgctcactccggattaccttcatccttatgtacgataagagtgctagtaagagatcgaaagtgcagagattcgcttgtgtggtgaaacaa

SEQ ID NO: 524228 - DNA, 417 bp, Homo sapiens
gcctggtggttcagctctagcttgtgtataccttaaactgtaactagcaggtgtatatcagtagctgcacttattatttaatcttgctcagtcccagtaactatctcaaaggtaattagctggaatatgcatatagaaatacggttaaaaaaaaatctgtgtattgtttcatctaaaaagaaaagcacctatcggcaacactacaacacctgttaaactttgtagttacttttgcattcctgtactttacaaactgtcctcacagcacaaacgtttacgacttaggtaatgaaactatgttagtacactaaataccgataacgctggtactaacaaacaaatgtatctatacactaatgaatgtgcctggaaaatgttcatatatatgtatatgaatgtctcatcatgctgacgtgt

SEQ ID NO: 524229 - DNA, 331 bp, Homo sapiens
agcaaggtcccacccttgttggctccaacagtgtttgatatccaacaataggaaaccagacccctagagtgattttagtgtaccctggagtttgagaacctcatctttccggcaggtggaagggatgtggcaaacagtgcacaggggtcccaagacttgtcccttcactcacctttcactggccaaagcaagtcacctggccttgctcccccattgccttttgccatgattggatgcttcctgaggcctccgcagaagcagaaaccactatgcttcctgtatagcctgcagaactacgagccaattaaaactcttttctttataaatgaaa

SEQ ID NO: 524230 - DNA, 216 bp, Homo sapiens
gaaacgtgaagaaggtgaagatggcggtagccagggccggggtctagggagtacagtcgctgcaaagtgcattcctggaacgtgatgccgcttggcgcacggacagccgaccacatgaccaaggacatattccttggtcctgatgctgaggaccacagaagaacgataccgccgccgccaagaagtataatatgcgtttgaagactacgaacctta

SEQ ID NO: 524231 - DNA, 287 bp, Homo sapiens
aggactactcccatctgcttcttcccgtccccgggaagtggcccgatatggatgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccgg

SEQ ID NO: 524232 - DNA, 364 bp, Homo sapiens
tccttagacttgataagcactaaatttaatacaccaccactactcacgaacatagaacttcagagtagaaaagctggtatgacacgcaggacaggacagaaactgcataactacttattggtctgtaatgaaacagtgcactgtctctatgtcataacatttatgatgatcagaaggcgagtgtgataagtccccgtagatgtccacatcctagtccttgtaaactattaataccttatatggtccatagggacttttgaaggtgtgaccaagttacaggctctcgatgaatgtggagactctatcctgggattatctaggctgcgcctagttaatatcactggggttccttagtccttgaacg

SEQ ID NO: 524233 - DNA, 318 bp, Homo sapiens
agggtacgaatgagcagctcactatttgataacaagataaaacaatcacctgttttaattggggatgcctgtattttatgcacgatttaaaaatgtatgtatatattttttgagacggagtttcgctcttgttgcgcaggctggagtgaaatggcgcaatctcggctcaccgcagcctctgcctcccagtttcaacggattctcctgcctcagcctcctgggtagctgggaccacagatgtgtgccagcacacccggttaattatttttttgtagagatggtgtctcactttgttgcccaggctggtctcaaattcct

SEQ ID NO: 524234 - DNA, 632 bp, Homo sapiens
  misc_feature (211)..(211): n is a, c, g, or t
gatggcgctggaccgccatggccagacgggcgctcaccgtggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacantcgacgcccagtggacattaagacgcgtgcggctcccgcttcattccacgcccggtggaaaaacaaacggcctttagcaattggttgcagttgttgttgccagccacggcgccaagcgtgaacgcgcaaagtgtactccggcagtctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcaggcagctgctcaagtccaatggtcttctctccgatcaccatcctcctca

SEQ ID NO: 524235 - DNA, 135 bp, Homo sapiens
cacaccatctttagtcccacctccttgggaggctgatggcagtgactgcttgagcccaggaattcaatggctgcatgggagctatgatcacacctgtcgacagccactgcactccaacctgggtaaggctctgat

SEQ ID NO: 524236 - DNA, 268 bp, Homo sapiens
cagtcgcttcactgtgactctctcccacccaaggtatcatgcaaaggtgacatgctcatacttggggcaaggcccatcatcactgtatactcactggatttatccttagggtgtgcatcgtcctgagtttacacacccccttcatggctgaagtctgtgtggcttctgagccaagcttggagacaggagcctatggcagaggctgggagcctggaatcagcatccagcttgccctgctatcacaccccagtgctgagagtcctccacg

SEQ ID NO: 524237 - DNA, 695 bp, Homo sapiens
ctccagatacatactctagagtacttttccatctttaaaacttgaatgtgtagctcagaatcttgttaaaatgcaaattctgattcagtaagtctggaatatgacccaagagcctgtattattaacaagtttctaggtgacactgatgttgctggcctacagatcttgatttgagaaagaaggcagtgaagaagggaaacctagttttagtcccaggttttccactgacgtgctctgtgacataggccaagctgcctcctgagtgcgggttggaggatagaggccttctgtaaggcctcttgtgactctaaatctagactctgtggagggccatggatgcctacggtggagcacaactgctgtttgcccttctctcacatttcacctccaaccgtgtgagagccagcgggcagatttcatatactcacacaagcactgatagcctctctctgtccttctttccacccttgttactctcgcacatgtgcatggacgacacgtaggagagtgttacagcattgtaacagcagattattgaaaacacctgcatctgtcataggagactggattaattgtggcacgtttatgcagcagttaactgtcagtggattaaagctacatgtatttacatgaataagtctcccaaacacagtaagttatagaagaatatttatagttggatatcatttgaatac

SEQ ID NO: 524238 - DNA, 901 bp, Homo sapiens
gctcactgcagccttgaacttcctaggctccagtgatcctctcacctcagttccctaatagctaggattacaggtgtgtggcctcacacccacccacccttcaacctggctgatccaaaaagttgtggaagaacacagggtctcaccatgtgtgtccagccgtgtctcaaacctcctggtcctccacgtgatcctcccacctcagcctttctcaaagtgcatggaatttccacagtgtgtagacgccacttctggcctgcgctcaccactaagtgtgaattacattcagaatcacctcctctcccccaaaatttggtcagaagatagtatatggaggacagccaacaagccaacagcagaccaccctttacaagatactcggttacctttatcccctcttgtgttaccgtgtggtcatttcacccgacaaaacatcctaacgcacgaccgtgcctacaacacacttgtacatgtgcccccatttgcctcacgcgcttctcactgcactgggaaggtgtacacaccacagtaggacatcattggtcaggccaccattgctaattcacacaagtgccccgacgaacccagacggcgtgccaacacactcctttcactacagtgcagtatttggtgagggagaaaagactggtagtacaattgtgattatctgggtagacatgaggccaaagttatcctttgataagaaaattggtggagaagaaatctgatactgtggtgagtcattatctggagaaggtatacgaacacgatatcgagtaggaatacagtggttggaaataacccgtgtaagcagcctaacagagaggtgttaaacatagagttggaggtggaggtacggattgcaaggggttgctaaagtggtggattcggggatactgag

SEQ ID NO: 524239 - DNA, 555 bp, Homo sapiens
  misc_feature (89)..(89): n is a, c, g, or t
  misc_feature (104)..(104): n is a, c, g, or t
  misc_feature (110)..(110): n is a, c, g, or t
  misc_feature (117)..(117): n is a, c, g, or t
  misc_feature (362)..(362): n is a, c, g, or t
  misc_feature (376)..(376): n is a, c, g, or t
  misc_feature (510)..(510): n is a, c, g, or t
acagccagtggtggtgattactggcgaatcttgaacccgggtgagtaccgcgtgacagcccacgcggagggctacaccccgagcgccangacctgcaatgtgantatganatcgggnccactcagtgcaacttcatcctggctcgctccaactggaagcgcatccgggagatcatggccatgaacgggaaccggcctatccacacatagacccatcgcgccctatgaccccccaacagcgacgcctgcagcaagcgacgcctacaacaaccggcttgcggcttcgggcacagatccggcttgcggcgccttcaacgccaccaacaacctaggcccccaacacttgggccttccaacgcttgncccctgcccctggncaaccacccttgaggcacttaccatagaagcccttggggccttcataccggccaaccaaccgctggcttgggaaggaagtccggaagacttgagacctacacagaaggtggtgacagaagttttgggaaccgangtgggaagccccgaggtttgggaaccaaggtgggccccgggtttg

SEQ ID NO: 524240 - DNA, 1024 bp, Homo sapiens
tgcaacaggttaacgtgtatggcgtgtgcgtgccaggtagtgagggtaaggtgggcatggctgctgtgcagctagcccccgggcagactttcgacggggcagaagttgtaccatgacacgtatcgcgctttgtgcatcccatggactacgctagccccacacatttcatccgcatccaggactgccatggaggtcaacagacacgttccaaacttgatgaagcacacggatggatgcgatgaagggcttcaaatgtggcggatcgaggataagacccctcatgctcagtacttggaacaaccgtggcccagatcccttaccggccacatgcacggcacgcacaatgttaccaacgggctgcgctgtagtcgaacgggaaccttgggaagagcatctgagtccaccatggaccacaaccaattggagatacgggacatcacaacgccccatgacaaacaccaccaccccaaaaacaaaactcagcgtagatcccattagcaactcaccatgggagcgacacctggagagtgaaatcgccgaagcctgggcccaaatacccccctcaaaaccatcacaggtggggcttgggacaaagtgaacacggatggagacccctggtacgcacaggcagggcaacgacatacacaactccagagaaggtggtagcacagcaaagacaaacaaacagaaaaacgaaaaaaacaaaaaacaaaactacaagcccgggcgcataacggcccccaccaagacacactatcacgataagaacacattggtaagcgaagagacgcggaagccacaagcgcgagaagaagccacacagtgggaaccacaatcaggcgaaacacaaggaaaaacaaaggcgacgacacaaaagacaagcgaaggacactccacaccaccccacaacaaaacgtcccgtggcatcctccacctgacacaacaacaacaacaacagcagaagacagtacgacaaaaaagaaaaaacaacaccaccaggaagacacgacgacggaacctatac

SEQ ID NO: 524241 - DNA, 81 bp, Homo sapiens
acttgatcatctctactgcaagcatctataatttaaagtctcgagtacactctcagagtcgattcatgagtcatctgtttt

SEQ ID NO: 524242 - DNA, 144 bp, Homo sapiens
gcatggccccagcccctacccccaagggggctacccacaggtcccctacccacaagagggctacccacaggccctacccaaggggtacaggcttcgaattccactagagcatttagagattacactgataagagagtcccccaa

SEQ ID NO: 524243 - DNA, 508 bp, Homo sapiens
cactcatctgatctatgtgatcatttttacaactgatactgcagtgaacatccttgtgcacatcttctttgacattatatgcccatatgtatggatacatttctagaagtaggctatatgtttcatgcattagaaatagattagtatctgttaaacagcccctccaaaagttgtatcaatttatacttcattgaataggggacttgattcggtatatcatggacaggagcctagggatggatagtagggaatagcatttccctgacacatatggtccatatagctttcagtgcatatctgcacactgcgtggtgagactaataaatgtgagaaatccggaacacctagataatgtcctgtttcctaatcggtctgtgccccctgtgtaatctactcattatacgtagtacgtgtcacaaaacctggaaagttctctccgtatcctttctcttgggcacgaatagccagggtataatggaggcaatgacagaaagagctgacataggct

SEQ ID NO: 524244 - DNA, 195 bp, Homo sapiens
tggcacgaggatgcaaacttcctgcctcctccttcccccttccatttcaagaatatgtttgtgtgtagggtgggggtggctttttttttactaccaatattgatgatgccatcaaagaagctgatctggtattcattgctgtgaatactccatcaaaaacctatggaatggggaaaggacgggcgacagatctga

SEQ ID NO: 524245 - DNA, 118 bp, Homo sapiens
tgcagcggactcggcaccgagcggcggctgtcacccgctttgaaacactccccctctccccacggtctccctctccctctctttccacggtctccctctgatgccgagtccgctgatt

SEQ ID NO: 524246 - DNA, 256 bp, Homo sapiens
tatatacatcaataccttaggatggtcataacactttgtcacacagtatggtaacacggatgcatagaaccacagccatgaaaatgagcttccagctcttctgctgttgcaccatagtccacattgccaacataaatggaacgggcatcagcctccatcttgctcctcaatggacatgatcaccgggccagcattgcctggaggtggactcttattcatctgcttctctacctcgtactgtacctcctttagcttc

SEQ ID NO: 524247 - DNA, 123 bp, Homo sapiens
gtttgacttagaggatcccagcaccacgaccctactactatcttgcaccctgaaacaatgctaacatgactaacctccttgtgactcctgcctcactcatttacaccaaccacccaactatct

SEQ ID NO: 524248 - DNA, 350 bp, Homo sapiens
  misc_feature (39)..(39): n is a, c, g, or t
  misc_feature (97)..(97): n is a, c, g, or t
  misc_feature (244)..(244): n is a, c, g, or t
  misc_feature (274)..(274): n is a, c, g, or t
  misc_feature (340)..(340): n is a, c, g, or t
aacataccgtccttcgagactgtgttcaatgccagtggntgcaggctaaggtggccaagtatggggactggttttcttatgacgggagcccccgggnccagatcttccggcggaaccagtcactggtacaagacatggactccatggtcaggctgatgaggtacaatgacttcctccatgaccctctgtcactgtgcaaagcctgcaacccccagcccaatgggggaggaatgctattttccgnccgctccgaccttcaacccgggccaatggnttccttacccctttccaggggcctgcgttagggttcccatggggggtattcgatgttgaagggtgnaccaggcatt

SEQ ID NO: 524249 - DNA, 160 bp, Homo sapiens
ccaaaacgcaaggtaatttaatgcgggatgataaaaagcagtaccgggcaactggaaaaaagagttattggcccaatgaggacgagcacatcacctaaaagagtagaggggccttattcaaacactataaaaccaagaggtatgggtttatagaaaacta

SEQ ID NO: 524250 - DNA, 293 bp, Homo sapiens
gtgtcactgttagtacggcgtgggtatggtgggtcatgcgtataattccaggacattggaaggctgaagcaggctgattgcttgagcccaggaattcgagcccagcctgggaaacatgaggaaacctgtcgctacaaaaaaatagaaaaattagccaggcatgtggcacatgcctgtactcccagttactcgggaggctgaggatgagaggatcacctgagcctggagatcagggcttgagtgagctgagatttgtatcaccccgcagcgtgggtgatggaatagacactcaa

SEQ ID NO: 524251 - DNA, 756 bp, Homo sapiens
ggacaggccaggtttgccggggggaaggcttagccgcagtgacttaccgagcccaggcttcctcctccacggtgcaggtcttcggacgcaagaagacagccgagagctgtggcgcactgaagacgctgcaatggtctcatcaaggtgaacggagcggcccctggagatgattgagccgcgcacgctacagtacaagctgctggagccagttctgcttctcggacaaggacgcgatttgctggtgtagacatccagatgtccgtgtaaagggtgagaggtcacagtggcccagatttatgctatccgtcagatccatctccaaagccctggatggcctattaccagaaatatgtggatgaggcttccaagaacggagatcaaagacatcctcatccagtatgaccggacaccatgctggatagctgaaccctcgtacgctgcgaagtccaaaaaagttatggaggcacctggatgcaccgacgcttcgctaccagaacatcctaccgataagacacatcgtgactcagaactcacttggtatacaatacaccaagaacacacgcacggggcatacagacagaggatccccaacagacgacaaccaaaacaaccacgaaaaaacaacaagagaaacccacacggaacgagcgacacacgcagaacaaaacgcacgcgctaccacaacaaatggccacacaaaggccaccagaaaaaagcaaccccggagccaccccaccacccacacgagccacaacg

SEQ ID NO: 524252 - DNA, 402 bp, Homo sapiens
gtaatcactctaactggaaggtggaggttgcagtcagctgagatcacgccactgcactccagcctggacgacagagtaaggctccgtctcaaaaaaaaaaaaaaaagaaaaaaaaaagggttttaattccttgtttttttttaactagccaacaccttcctaacatcagtgcttggaaagttttaatccaagtatagcagtttcccctggaatttattaaaatcccccgaggcatttggtctgggttgtggtgcctcttattgggttggtgttatttccacgttcccctcccctcccattttctccattaacacaagagaggcattaacttgggaatgcccggtgaaaagtctcttagaaacctaattggggtgatatttggccctgcttccccttttagtt

SEQ ID NO: 524253 - DNA, 951 bp, Homo sapiens
ttggaagcgcctcagtccaagtggatgtgcatcagaaactccgggtgccagattttcacttgcatccttctgtgcctttatcacattccagccaacctgccgtatcagccctctgggaagtctagcatgcttcctggtggtctagggggcttggccttcctcggctcgactagcgctctcaacattgtcccagggcgcatcctcagcccagtcacgaatctcgaagcctggctctccctcctgcgccagcgctcgcccccggctgctccatgacggaccgcacacggcctctcatgacggacacgagagtaccggatcgcacagccctcgtggacgccatcaacgggctcatcaccagaccgcctcttcccaggaccctagcaacttctgggactggcccattagcagtagtgcacgctgttggggccgtcccacttgtgtcaggtccgccgccctctgccccgtagagcttttagccgttaggcaagcacatgatgaggctgaccggcggtcttcatatggctccgtctcaatcgtatgtgacaacatggcaattgcgttcatcactactggatcactattgtgggagacgacaggtggcctaggtaggatgacagcggcttaaccccctggagtgacagtccttcttgggtggactaggcatgttgttgctgtcgcactatttgccacttcacacgcgtggcactagtttctcacggtgttacgctagacatttgctgcctccaggcaggaccggtcaggggtgagcagctattgggagagacacgtggcctttcttgctcctggagcactctccctcccggccctgggaagtgggcgcagccctgtgtatcccccagcttaggcagatgggctgataccggcgctcccttccatcccacgctcagcggccccggccagatactctaggcagacattcacacctcattt

SEQ ID NO: 524254 - DNA, 179 bp, Homo sapiens
  misc_feature (1)..(1): n is a, c, g, or t
ntatacatgtgcctagagcaaagaagttattatctcgaactgacactgagccacaacccaaacaacccagactctccctaagcttacaaacgtagactacattctccagtaatattcatccactgtagcatagttctgttacagagggatcctactagaagtcagaccatgcatggcat

SEQ ID NO: 524255 - DNA, 506 bp, Homo sapiens
aataatgtcacatcactaatcatcagggaaatacaaataaaaactacaatgagatgtgactttactccagttagaatagctactatcaaaaaaccaaaagacaacaagtgttggcaaggatgtggaaaaaagggaaccattacacattgctgatagaaatgaaaattaatgtacaaaaattagccaggcatggtggcactggcctatagtcccagctagtcaggaggctgagacaggagaatcgcttgaacccaggaggcagaggctgcagtgagccgagatcacgctactgcactccaacataggtgacagagtgagactctgtcccagacaaaataaataaataaataaaagagaggaaaattagtacagcccttaagaaaaacaatatggaaatcttcaaaaaattaaaaatataattaccatataattagcaatcttactactgggtatatacctaaaggaaataaaatcagtatgttgaatactgcatattcagtaaattt

SEQ ID NO: 524256 - DNA, 313 bp, Homo sapiens
  misc_feature (19)..(19): n is a, c, g, or t
  misc_feature (26)..(26): n is a, c, g, or t
aatgaattagcactttcanattgaancaagcctgttatcctatgtataaaatagcaaaatgtttgctgtttataaaaagatgtaatggggtggggggggggggtaatttcaagtccctaatttaaaaatgaactagcaattttgtacctaaaaaaaaaaaggtgcactcccctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgta

SEQ ID NO: 524257 - DNA, 265 bp, Homo sapiens
gttttgcacggcgtgtttggttagcatgaaacagaggcttagcattgctgctatctctatcaaagccttcaccaggcagattcttcagagcttggttgttagatccggctgcaaaagtctgcacagacctcagcgcattgacgatatcctttgtttttccaaagtagacttcgttcagcggacttctgatggtattttccatgacctctaccaggcgtccgatgttggctatctgtgggcagcagtcactcacaggttcatcctt

SEQ ID NO: 524258 - DNA, 1089 bp, Homo sapiens
ggtcaaggcccacgaccccggaaacctagcgaggtaccgtgggcgtctaggtagtacagacgacaacttctccgtgttcctcggcgatggcggcgtccgggagcggtatgtgcccagaaatacacctgggatactggcctaacaaacatgcagcgaagctcagagttatcgcatgacaaatcatagcaaatacgacgaagtagatactagcagcaaggaaatcctggcggcgaagccctggacttaaggatcacacattactttaagtactgcaaaatatcttcagctattgtgctctgctgaagatggtgatgcatgccagatcgggaaggcaacgggagacatagatggatgggttctggatgcgtacgcaaaggtggaatgggtggatagacccatggatccattcatgggacagattaagctagtggacctgtgcgagggcaactgcaagacccgcagtaaaatggctcgaagcgtagctgacaatcatggaattacaatgcggcgtggcaatagcaagtacgtagagacatggctacacaagctagtgtgtggcacagcccttcgacaaagatagcaagtgccggtgtcgggtgaatcgataagcgcaccccgtggtctagtcggctagcttgggcattgtgcctgggatttggatcgttagtacctccagaattgcgtcaagatcacgcgagattcccgagggagaacccacttattgtaacgacgacccggttgacttggactccccaaacaagggaaagcaaattatccgccagggtaaactgttgcacatccttgggaggaccattctaccaagattagctccaaaaagggctagagaaacccgtcccgggatgaaagggaccatttccctgcattacccaggcaactcaatacccagcttacagacaaccagctagcaaggactcacggggggggtacacgggcaataccaggaaatatggctaaaaaacgtcccaccaaataacacaacatcgctactttgggatcgacaagatgcttgagccggtggggcaccacacccgggggaagaacagagcgaggcaacaaagcagggggacc

SEQ ID NO: 524259 - DNA, 923 bp, Homo sapiens
cagtttgtcctcccctgcgcttgtccaggatgtcatacgagaatggtcacaacaagaacgccctgaatgcgaggtcactgtcaatgcccccacttggtctcctccgaaagtcgaaaggtgtttttgggatttgggtggccaccctccttgtatatatgcgtgtgtgtcaaccaaggggtttcttgaggaagggggctctttctgcctccgacttggagccctggtacaccgtcttaggccccatcatccaaaagggggcctaccttgccatctcatccccccgcaaggagctgttatggtgggtgtctgggaattttggagaagacgcccttgtaatagctgggaaggagcaacagatctggggacccaccccggtaatggcacattcctgacacctggcgtgttttcgatgttgcttatttcagaagccagaattaggtaagccaaaactccccggtgtgactgaggcacaccagaaggcacgcccatacacccccacctcccgccatgttgaccagtgacacaatgttgtaaccagttttactactgtgtgatattttgtttggacatctgaagatagagcttgtttttggttttttaataagaaatattctcaccaaatttaaacccgcggtcctatttgaatcctggggttaactgagtgagcggctgatgatagagcatgagaaataggacccaaaatagtatgtgccgtaggtagcttaaggaagtttccagaatattttgttgcgtgatccaaatactgtttttttgtggccttcacttgttatcccccctgtacttacctaattacattggagatgctgaggcaggagaattgcttgtaacctgggaggtggaggtttccgtgaaccgaggatcccctgcactacaacctgggcgaccaaatggggctttttcca

SEQ ID NO: 524260 - DNA, 472 bp, Homo sapiens
  misc_feature (1)..(1): n is a, c, g, or t
ntcacctgagaagttgtggctcagggcacataaagatgagacagagttttgacatccagccccacctctctggaacagaaagtttactggggaggaaacacagccccgcatgtgaacaggtgtcacggtggacacgggggtgagctgtctctccacctcctcacattatgctaacagggacgcagacacattcaggtgcctttgcagaaagagatgccagaggctcttgaagtcacaaaggggaggcgtgaagaaatcctgcatctcggtccctgacaagacagctgtctcaggcttttcaagctgtgagagacacatcagagccctgggcactgacgctggacgcagcctgagagtagctcccttcttttccacctgagctcttcctcctacacatcacagtagcgaccacagctccgatgaccacaacttctaaggttaagcttaaccttagaagttgtgggaaaattta

SEQ ID NO: 524261 - DNA, 252 bp, Homo sapiens
cttttggctggtaaacccaaccaggaacatttatttaaaaaacataagcaagtttttccccaagaaggttaagcaccgcgggcgtggttcatgacatttcgatttcaggctagaaggcacggaaactctccttccagccctttgcgggaaaagtgctcctacccagaaccagcgggcattgccccagttgcagtgtgggccccctataaaagccccacaaacacttttattcccaccacaaagggctttgaa

SEQ ID NO: 524262 - DNA, 740 bp, Homo sapiens
tcatcaacaagcagacagggcagcacgccgtcattgacagttcaatgccttcccaggtctacgagggcgtgagcggagttcttcacagacctcctgaaccacatcgccactgtcctgcagggccagagcacagccagtggcacgccacaggggacgatggcccgtgctgaggcaacagcaagcttctggccgagccggcgggacgaccggggtggcgcgagcggacatgcagcgccagccccggttgctgcgggaggatgatgggccaggacgcgcccgtggaaggctgagggccgaccgcgggggggcaagcggccaaagcttgcgcaccagagactcggggttgcaatcgcgggggtggtcgcccaagctgccagggagtcagttgtgtggcctccgctgggcaccaaaagggctcccgtccacagatacgcccaagggagcgggggaccccatgagggggcagcgcaggggggacagaagcaacaaccccggtgggcccaagggaggctcccacaaggggcgactggcttactaacataagaaagtccgcaaggtggaccgtggatccgtcccgggagagcaaattttacagggcgggaattgcggggagggtcatggaatcgaaacatgagggggaagagggggcgcgcatgagaagcacgaggaacccaggtgtggcccacccggacgagaagaagggggggccggccggacgggccctaaacgggtggcggcct

SEQ ID NO: 524263 - DNA, 298 bp, Homo sapiens
ttagccttctaggtagtggggattacaggaacgcgcgggccacacttagttaatttttggatttttagtaaagacggggtttaaccacattggccaggatggtgtgggggtacaagatttcttgacctgcgggatcaacccgcctcggcctccagaagtgctggaattacaggtgtgagccaccacgcccggcccagggtgctcttaattcagaacacaaatgaattcagagggatggtgctgcataggcatgagccgcttttacgatactcgggtctgaactgtccctgggaagttg

SEQ ID NO: 524264 - DNA, 361 bp, Homo sapiens
ttgaccagaacaggtgtcggtgatatagacagaggtctcggagttggggcacatctggtgacttccgcaagctgatggtgcccggcaaaggtggtggcccagtttctttcttgccctgctgtcctcccaaggcaagtcacatacctcattttatacttggagtgaattaactaaatcccctgtgcctgcatcagaaattcagctgcatttttgaaagtgggtttgcactgtcactgcagagttgtcaattttgtataataggatttcttatcctgcaaaacctcatggacaagtggactttgggagccagagaagggatgggcggctctcaagtcctggcctggatttatgtgccagagcc

SEQ ID NO: 524265 - DNA, 861 bp, Homo sapiens
ggctggaggtgaaagtctggcctggcagccttccccaggtgagcagcaacgataggtgtagagaatgcacgcatgctgcaggccacagtgctgctgggtctcagtccatcctagttcccgtgtcctctggaagttgtcaggagcaagtgttgagcttgtacgtgtggtctaatggtgagatcgctggcgtatcaccccttcagccatgcaggtaggacaacagggagctgccagagagcatgccgggctctctctcttggcagcgcattatcaagccgggcagctatcaggctcggaaccgcggagccctgttagcgccttgcagagtagccaccccatgggtggccctctaacatggttctgatgcgggcgctcgtgttcaatggccgcgccagggcatttcaccctcttgcagcatggtccagtcacagaaacgtgcagccttcttgctcaacgggagcggtggttcgcgcaacgcgctcggacccgtatcacggaggactccccgcgcagtcggtgtggggccccatggggacccgcggcggcgtccgtgcgatggcgccttatcctgggccctgggcgcctcatcgcctagggcgaccggggaccttcgttgcggcacccctattcggttcctggccattctttgacgtcttcaacgataatcaacatgggccgtctcacaatctaacacttgggcttgcaacccccacaacactggttcctccacttatgcgaagacacgttgctacgcaaggttaactggagacgaacgcgtacacttttcgcccccgcacatgcgcgctatcataccacctgctggcacccgccttatccaagtgtccgtccaacttttgcccc

SEQ ID NO: 524266 - DNA, 133 bp, Homo sapiens
ctaacgcacctgtgcgtagtgaagcgttggcatagatcgggcagcaggttgtcaccagcgtccaggtctacgccatggcaggcacaagggcagcccccttctcgatacagctaccactgaactgcctgacatg

SEQ ID NO: 524267 - DNA, 167 bp, Homo sapiens
tgacatgatacactcgatctcggtacctcgataagggccaaagggtaaataaaattgaaagctttggaaagccgggcaaattgcagtcagcaggtcagttccgggcggttcattgaccagcttggcccttatcgagggggatccttcataaagtcgaccgtgcaggc

SEQ ID NO: 524268 - DNA, 194 bp, Homo sapiens
aggtgacctagaggttcccctgctgtacatagtattgatcagaacaggctttggtcgatggaccttgtcactccagttaggagacaggccatgcctttcaagtgcatacagctcactgattgcatcctcaaatttccgcacgtgcccaccattaagtatgtccgacaagcctggcagaaggccgacgtcaatac

SEQ ID NO: 524269 - DNA, 362 bp, Homo sapiens
  misc_feature (4)..(4): n is a, c, g, or t
  misc_feature (29)..(29): n is a, c, g, or t
  misc_feature (54)..(54): n is a, c, g, or t
  misc_feature (57)..(57): n is a, c, g, or t
  misc_feature (145)..(145): n is a, c, g, or t
  misc_feature (174)..(174): n is a, c, g, or t
  misc_feature (182)..(182): n is a, c, g, or t
  misc_feature (185)..(185): n is a, c, g, or t
  misc_feature (205)..(205): n is a, c, g, or t
  misc_feature (240)..(240): n is a, c, g, or t
  misc_feature (243)..(243): n is a, c, g, or t
  misc_feature (248)..(248): n is a, c, g, or t
  misc_feature (254)..(254): n is a, c, g, or t
  misc_feature (262)..(262): n is a, c, g, or t
  misc_feature (275)..(275): n is a, c, g, or t
  misc_feature (299)..(299): n is a, c, g, or t
  misc_feature (308)..(308): n is a, c, g, or t
  misc_feature (338)..(338): n is a, c, g, or t
  misc_feature (348)..(348): n is a, c, g, or t
tttngaggtcttctcaataagaagtaatncctgggggcggtaatcctaataggncgncccgcacttgtcacagtacagctaatttttcctagttaacatattttgtacaatattaaaaaaatgcacagaaaccattgggggggantcagaggtgcatccacgggtcttcttganctgtgacntgnttttatgtggctgcccaacntggaacgggcagtgtgataggctgggtgggctaancancctantctatntgggtganaggccacgctggnctcagatgcccagtgaagccactnacatgagtnaggggagggctgtggggaactccattcagntttatctccntcaattaagtggcc

SEQ ID NO: 524270 - DNA, 789 bp, Homo sapiens
aacggctaggtgcgaggcctgggtggcgctggtcgatgagaacagaggcacaggtgcctggccctgctgcccccagtaatctggactggagggggccagtggtggcacctggaccctggtctgtcctgggtgctgctgaccttgtgtgtcactgctggggaccccggaggtgtgggttcaagttcggatggaggccagcgatgctctcgtccttcagcatccgtcgtgggttcctgggggtctggctccactctccctggtgactgtgtagctgggggggtcccgagcgggtgctggggggaccacgctggctgtgttgcacccagtaacgtggctatccggcaatgtggcccctgctctgccaggtcccgctgggaaacccagaggaggatctctctcatcctggaagggctctggggccagcaggccctgcgccaacaccagcttctgctgctagtttgcgtccttccctgagggctcctgggaggcctgtgggagcgctcgtcgcccagatcgagatccagggctctctggtcgccgtcgatactctgcgcccattctgctgggcagagcttgggcgggatctggggggtctcgggagtcctcctcttttgggcttgtgtctacctccgttcatcgtgctggggcgggcttaagcacgggcctggcgcctagggtcaaggcgtccgcacaagcccaggccgagacccggcatgggcccaagccggctccaaggtggcttagggtcctatgcatttaaacagtgccgccgcatttggccagccaccc

SEQ ID NO: 524271 - DNA, 219 bp, Homo sapiens
  misc_feature (157)..(157): n is a, c, g, or t
cagttgggacgtcagacttgtgatggcttcgcagacaggtgaacacaagtttttatgatttgtcttcagaatccttttctcctttcaccttcggggcgaccgtgtgcttgctcagatcctccacgtgcaggtggtttgttgtcacagtgcaggtaancagtggcacaagtgctaattgagacaggcagacatggcttgctccaggggtgggcccttggc

SEQ ID NO: 524272 - DNA, 103 bp, Homo sapiens
  misc_feature (71)..(71): n is a, c, g, or t
  misc_feature (86)..(86): n is a, c, g, or t
cccagtgcctgccactctctgggactctcctcctcccctcctcttcccttagcctctcccacccgggccanagctgctggagaatnaatttgggatgctgata

SEQ ID NO: 524273 - DNA, 299 bp, Homo sapiens
  misc_feature (46)..(46): n is a, c, g, or t
tgtcaactgtcaaccactgggaatgatctcactgatgaaaaggccncccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagcccctagaatttaaatagagaagaatgccattttatcactctgcctctgggtgaaataaagatcagtcttgatgttctaaa

SEQ ID NO: 524274 - DNA, 311 bp, Homo sapiens
ggtgtactggggatagatgagttagtacatgtctttctgttttttgagacacggtctgctcggtctcctaggctggagtgcaggatttccatcatagttcactgcagcctggaactcctggtctcaagggatccaggcacatgccaccacacctggctaatttttaaattttttgtagagtcagggtctcattgtgttgctcaggttggtctcaaactcctggcctcgagtgatcctccttcctcaacctcccaaaatcctgggattacaagtgtcagtcacctggcccagctagtacaacctgccggtgg

SEQ ID NO: 524275 - DNA, 166 bp, Homo sapiens
ccaggggctggggacttgttaaacacagattgttgggtctcactcctagagtttcttcttcagtattctggggagcagcctgtgaatttgctgtgtttcctctggtcttcagagtctcctccctgcgtgcgggttccaggcgcagctctgttcaatccccggtcga

SEQ ID NO: 524276 - DNA, 143 bp, Homo sapiens
  misc_feature (66)..(66): n is a, c, g, or t
  misc_feature (141)..(141): n is a, c, g, or t
tgagacagagtctcgctctgttgcccaggctcgagtgcaggactgtgtgtccagtcctgtcttatnccatgaataagcacccagcccccattttcttgatcatggcctcagttccgaaaaccaacaaaatagaaccgcggncc

SEQ ID NO: 524277 - DNA, 403 bp, Homo sapiens
ggcgttctagaggatcccttctacataggtgtaaaatccaagcccacaagacgccctaggttgagaatctgcaccctgtactatatccccagctcgatgtgcgattgtaataaaacagcacttcaacgccccaggttctttcatcaggctatgaactactccgagatacgcacaagaaggcaggcaacgaggtggggcgttaagaggtcaagggtctccatctgcaatcaccatctacggggcatcagtcagcgattgtgtgatcaacgttaaaatgttctacagcttagggctcttcttgaagcaaggttccaggcacaaaactagtatgagcggagtctcagtttcgaagatgcagcatcagaaaccctttaccccatgggaggaggggtgcctgcgggca

SEQ ID NO: 524278 - DNA, 102 bp, Homo sapiens
ctgttgtagtgaggatcacttgacgcccaggagtacaactgactagcctgggcacatggcaaaacctcatctcgacaaaaaataatgagccactgtacccta

SEQ ID NO: 524279 - DNA, 996 bp, Homo sapiens
  misc_feature (3)..(3): n is a, c, g, or t
  misc_feature (301)..(301): n is a, c, g, or t
  misc_feature (303)..(303): n is a, c, g, or t
  misc_feature (380)..(380): n is a, c, g, or t
  misc_feature (407)..(407): n is a, c, g, or t
  misc_feature (413)..(413): n is a, c, g, or t
  misc_feature (419)..(419): n is a, c, g, or t
  misc_feature (427)..(428): n is a, c, g, or t
  misc_feature (434)..(434): n is a, c, g, or t
  misc_feature (437)..(437): n is a, c, g, or t
  misc_feature (459)..(459): n is a, c, g, or t
  misc_feature (475)..(475): n is a, c, g, or t
  misc_feature (494)..(494): n is a, c, g, or t
  misc_feature (663)..(663): n is a, c, g, or t
atnctaggtctagacagaaagaaatggatagagacttgacacaaatttatgaaagaaaattgggagtaggaatgtgaccgaaaaccaagttgtgctaatgtctgttagatttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcaccacccncnagcattgacacatagcttcacccgaggtgagatatggcagctgtttgtatctgcactgtgtctgtctacaaaaagtnaaaaatacagtgtttacctgaaatttnaacttngtaacngcaagaannccagcncanccgggcgaggattagtattatntttaactctccgtaanattttcagtaccaccaaantgttttggattttttctctttcctcttcacataccagggttattaaaagtgtgctttctttttacattatattacagttacaaggtaaaattcctcaactgctatttatttattccagcccagtactataaagaacgtttcaccataatgaccctccagagctgggaancctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagcctcacaaaagcgccgaacacaaacaacaaacaac

SEQ ID NO: 524280 - DNA, 682 bp, Homo sapiens
  misc_feature (349)..(349): n is a, c, g, or t
gttctagatcgcgagcggcgcctttttttgtgttttgtccagggtatcattggttttacggccctgtgtagaagtgggaatttatgtggaagaataaatttcttgattttctaaaaagaaaataaaataataataaaaaaaatactcagaaaaaataaaacagaaagcaggcggggtgtgagagatcccccccggggccgctatcacataccagggctcattattttgtgtgcaacgtgtgtcacattatattacagttacaaggtaaaattcctcaactgctatttatttattccagcccagtactataaagaacgtttcaccataatgaccctccagagctgggaancctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagcctcacaaaagcgccgaacacaaacaacaaacaac

SEQ ID NO: 524281 - DNA, 154 bp, Homo sapiens
cgaattcgtcctggtcgctgtatggaggagggacagctgctgacattatcacagtgtgacatctctcttcaaggcttgtgggtctggcaggctgagtgtgagctggggccttctccatccagtggcacctggtgggtgcccctgttcacaggta

SEQ ID NO: 524282 - DNA, 370 bp, Homo sapiens
gggatgtgcactgtgactcatgacactgaagagacacttgtgaaactatactgatatgataatgccagaggagattcttacttgtatgcccccgaacttcttgtcgttgcattgccagttgccacagctcgaggaacttcgggatgatgggaaagcttcgactgacgaacctagacttgcgtgtgcctgtctccatgaagatggaggagcattgagacgcatgagcagtagctcgcctgagacagagattatgcacagctgcgactgttgaacgtgcaagttagtgacagattgtaccatagtccacacgggatgctgccatggagaactgcttgtgtgctcatgactgggaggaccttgccacgtagtt

SEQ ID NO: 524283 - DNA, 428 bp, Homo sapiens
gacgctccaagagagagtcccccacctttcccttgcccaaacaagtgagtgaaagccccccccacccccttttttggttcccggctccccaagggctttgtagacccctcttctggggagggccctcccaagcttatagacttcctttagctggagggaaatcccccgggggaccccttttgggcgtttttgaacttgggaagaggggcccccccccccccccccggggggttttttttaaccccaaattccccccccccccgatgggggggggccgggcaggggggacaccccccccttttttttttcctttaccttcccccgggggaaaaaacgggggggcttttcccctttttaaaaaaacctaaaaaaaaggtctttaacctagggaaaccctccttttctggtaataaaattttttttttgga

SEQ ID NO: 524284 - DNA, 217 bp, Homo sapiens
  misc_feature (102)..(103): n is a, c, g, or t
gggagctgtcatcatcatcttctgccatctccttggcaactccaagtcctgctgttctcgctcacgccgttcctctgcagactccaagtccttgttgtacgnntttgggaggaaacctcatggccttgtacagacatgttgttggatatactaggcagaaggagatgcgctgtgtggaaggctagctaggggctctcgcggtggaatatgatgtcaa

SEQ ID NO: 524285 - DNA, 478 bp, Homo sapiens
ggtgaacatgctctgacagctcaaatccttcatcctcatgtacgtcttccctgctcctgctctctgcagggatggctcctctgacataaactcccatagacaacctagctgtgatgagttagagatctgtgcaactgtccaagaccatgcctgcttgctaaccattctagaccttgtgcctggcacatagtgggtcctcagtaaatggtagatattgccaccactgatcatcccacatttacctatgctgatatttggcagatgtccccaagaatctgtgtgtaggccgggcgtggtggctcacacctgtaatcccagcactttggaaggccaaggagggtggatcacctgaggtcgggagtttgagaccagcctgaccaacatggagaaacctcatctctactaaaaacacaaaattagccaggtgtggtggcgcatgcccgtagtcccagctactcaggaggccgaagcaggagaa

SEQ ID NO: 524286 - DNA, 105 bp, Homo sapiens
ttgtgcttgagaaataatcaaacaaaaattatacaggaccttatcgggttagcagtaagtaccagagcgtgatgcacgatcttagaagacaggacgttatcttgg

SEQ ID NO: 524287 - DNA, 119 bp, Homo sapiens
ggggacttggagctgcacttgtctggtaggaccttgcctcacccgcagataccgtgggaagagatgctctctctcacggcctcagagccactcctagccacagttccagcatctctgtg

SEQ ID NO: 524288 - DNA, 534 bp, Homo sapiens
  misc_feature (1)..(1): n is a, c, g, or t
  misc_feature (10)..(10): n is a, c, g, or t
  misc_feature (53)..(53): n is a, c, g, or t
  misc_feature (77)..(77): n is a, c, g, or t
  misc_feature (101)..(101): n is a, c, g, or t
  misc_feature (256)..(256): n is a, c, g, or t
  misc_feature (448)..(448): n is a, c, g, or t
nccaattggnggatttagtacattcacagtgtccccccaggactttggtgacncccttccacatcagggtggagganccagttgcttctgacttaagcgtnactctcttttcctgacctcttgagcagtcactaattgggggtggtaccacccaagggctgtttggaaatgcacaggatggttttggttgtcataagtgactgggaggagctgctgcatcttaggcccttgaacccaggagggcaaactgtccctncacgactgtggcagctctgcagggtcaagaaccatctggtgatggcagaggtgcctggtagaaacaatgtggggaattttatctataatgtctgccctttgcagcagacatccacccctacccccaccaccgcagggttcaacagtgccctggccgagaacttgcagtcttcagaaacaaagcagccgcaancctctggtcaggctcacgtttcccagtcccgttagaacttctcctctgctggcttttgctggcgtttctcctccatgactttttca

SEQ ID NO: 524289 - DNA, 769 bp, Homo sapiens
ctcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccactactcgccactcccccaaaggtcaacggtatctcccattcccctggttatcgccaccaggcccaggctacagtgctcaacaagccccggctatcagcccggatgacagtgacgaggagaactgagggcacgtggggtgcggcagcgggctagggcccaggcagattgcccggctgccgtgcagtgcctgtgcctccctcacggggcgtcacccccagccagctccgtgtacataaatgccttgtggcaaagctcccggtgaacttcctggatcccgtttctgatgcagactcttgtgcttgttactccactatgtgctgttagaactcactggcccagtggtgttctcacgtcctaccccaaacagccacctgactgtcccacaattgaagatcctgccttgcctgtgtgcttgatgcagggcgggtaaaagggtaatgaacttaggggtaggaaccatgctgtgagtaggtaacaagtgatgctcgggaagacccacagccttaaagcacgacctcctaggtcggctaatacacttgtcgttggacggtgacagtaaacgtttacctacttttgaaccaacagtacacacgaacacagagggg

SEQ ID NO: 524290 - DNA, 197 bp, Homo sapiens
ctcagacttactggagagctggcaggctagtgactcatgactgtaatccagcactttgggagtctgagtcaggaggatcgcttgaggcaggagttacagaccagcctggtgacagagtgagatcctgttttcaaaaaaaagaatgagggcaagggtggtgtgctggacatgaactggaaggcagaaggtagctgccc

SEQ ID NO: 524291 - DNA, 1034 bp, Homo sapiens
agcgggcggttgccaccgagcggcgtgtccgacctcgcctgtcaccgggggttgtatgaaaacaccgggcgtgctgggtggtgagggatccggcgcgatgcaggttgctgagccgggtgcttgcggagctcttgcggcggtcctccgctcatgcggccccattctcattgattgccgatatatgtcggaagttatcgcaaatgatagttaactcaatgattgatgcatagttaaacataggtgactacctagtaagaaagatgctcttgagcactgtaatgcgtaggattcgtagagattgctctgggtcaacctcggtaggaatgatcgaaatagctggaagtcgctctacaagtaatctaggtacacttggctggaatcatggtttacgatcatacagatattcctgtgcattcttggactgcagaaggtcgatagacagaaaatcggagacacgaagagaatagacatgccatagaggtatcctaacaagggagaattggcataaattgtctgacttgtacaaacagtggtagatgaaatcagcgaaagtagatctttgaaaagctgagaagcttagattaatcgttgaacagcacttgctttgtaggaggcgtgtggtgtcacgacatgggattgagacgagtctggagaagaacgtgaagtttcccttaagtttcaccgaaaaagtgatggggttcattcaaaactcatatgtttgcatgtatagtatcatagaaatgggcatgggaaaatgaactctgagcatcaaaatgaggacctaacttgggtacaggacttcatacgtatatctatgcaagagggatggggatcgatacagaataagaaagttttggatgtaagaggcataaatatttaattgggggctctggaatatggagcactggaaatatgggttcaagcacgaagttatgtatgactcgtcggctggggatcgtacacttggccattcagagttataacgagtatattattggcaacatctgtgtaatcaggaaatctaagggaaagag

SEQ ID NO: 524292 - DNA, 399 bp, Homo sapiens
ttcgagccaggcaggcagagtcagtcacaggcaggttcttggtaatcacacgggaacactattctgaatggtaatctgccggctgccaggacacatcaaaatcgggcttttagatcaatgcccagggcggcctctgagatgatgagagaggaagcgcgccacttcccagagtgaaggctccacgacgcatccgaggcccctcaacacgggcccaccccgaccatccagacaccacgcaagtgcagcacacgggagctcggggctgtctgtggtgggaggacaagagtggcaaggtgcagggtcagcgtgttaaaatatgaccaaagatgccaactccaggccaaaccgcactgcgcacgggaggtaggatacggtgtcttgatggctgagaggccggcc

SEQ ID NO: 524293 - DNA, 1882 bp, Homo sapiens
  misc_feature (1406)..(1406): n is a, c, g, or t
ctctatgcgttctttagagtttctattggctgggttgaggtaatactgcttgttattgttgtccttcttatgggccgtctttagagtgtcaaatttggtggttcatctaaaagcttatctgtgtgttatacaaaccataaggtcttttaatggttattcgagctatcttagataatgtccagatttttgcagcggcttcgcagctttaatcacaaaattcgctttatggtatcctaaaatgaattgggtgacacaccccggaatgctagttagaacatggaaagtgaccggtgcttctaacgcgagaatgaactacacttccagtgtgctcgttcaacgtttaccaagtccgatggcattcgtggcttcctatagagggagaaactgcctcgttatgctgggatcttcgcgagactgataatctgcttgtgctactcttatgaaaaggttaaagaagtatgctgataagaagctccagtagcctgttctgcataatgggactgagaaacattccacaagtgtcgttagttgttcgggacttataggcgagcttgctgctctttctaaggcatgtgcctcctcgcattgcttatccacacgaagtcctataaggacgaggctccgggaagtagggcaccaagtacaagtcttttgtccagacggcgcgcctcgtgttccgggaagaaggctaccttgccttttatagaggactgtttgcccagcttatccggcagatcccaaatactgccattgtgttgtctacttatgagttaatgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatacatttggcttgtgtcctcttttatgctcactatactatgaaggacttaagtaattcagataaacctgccctagaactgcagagaaaaatgataaagtgagaatacaacttgttttataatctgactttaagatcttgcactgctagacagggaagaagtgtcgcattttggctgggcactgtggctcacgcccgtaatcccagcactttgggaggccgaggcagatggatcacgtgaagtcaggagttccagaccagcctggccaacatggcgaaaccctgtctctactaaaaatacaaaaattagccggacgtgtgcctgtgatcccngctacttgggaggctgaggcaggagaatcacttgaaacccaggggcagaggttgcagcgagctgagatcacgtcacttcactccagcctggtcgacagagtgagactccatctcaaaaaaaaaaaaatttgtgtcccatttctggtggtggtgtgtggccaggacaaacttcccagcaatttttcttctcggtacatttccaattacttgcagatggatcatctaaagcgttcagactgtgagatgaatatatataactttctgagactcaatattttcaaggctaataaaaaacttcctgaagtatcctttctccctaacttggaaccaaaggcaagaattttaaagaactggtttatcaaggggcggctctggataatagtcggaagtacaccagttgcctgtaaattgtgtgacgacacgtccccggtgggtggatccaatggtgaacacagcactccacggggctacaccgg

SEQ ID NO: 524294 - DNA, 654 bp, Homo sapiens
  misc_feature (1)..(1): n is a, c, g, or t
  misc_feature (103)..(103): n is a, c, g, or t
  misc_feature (211)..(211): n is a, c, g, or t
  misc_feature (219)..(219): n is a, c, g, or t
  misc_feature (266)..(266): n is a, c, g, or t
  misc_feature (299)..(299): n is a, c, g, or t
  misc_feature (416)..(416): n is a, c, g, or t
  misc_feature (587)..(587): n is a, c, g, or t
ngggggggtggggggggggtttgggtcctgctttgccctgcctcccaccctatctctccccaaattataaacagccatccttgggaagcagcagagttaagangtctccccactgccctagtggcatacacaccaacaggggagcttgttcagttggcccagaatccaggggctgcttttcatggggggaaactggtaccaaaatttgggnggggggtnggggggtgtgggggggcaagcgcaaagggaaccttcctccgtttctnctcatcgggtcctggcgctgggtcctctgggcnggggggggtgctggctagttcttcttcttcagagtcctcgctcctcctcctcttctttttgctcttgttctctcccgaagggctctcttcactagacacaaactctttgctcttggngctctcgcttagctgccttgggggcgacttggttggtgagcccctagggggcgtggatttcttttccatcttttcctttactttcttcttcttctttgacttgtccctcttagaagactcgcctcggcccccttcttattctttcatggctttttcatagtccctcctggnatcctcagccttgcgatcccactcctctttcttctctttggacattcccttccagatctcgcctgcc

SEQ ID NO: 524295 - DNA, 485 bp, Homo sapiens
ggtcagacgcatcttctttggcgtcggcaagccgagccaaatcgcctcagagcaccatggggaaggtgaagggtcggagtcagcggatgtgggcgtatggggcgcctggtcaccagggctgcgtttataactctggtaaaggtggaatatagtgggcgcatcgaatgatccacccgtatacagtctgtagcactcaagcatacgagtggatattacgatgttgccaatactgattactcaaccaccatggtgaaatctcgcgatggtcatcggcgtgcgaatggtcgtagacgaacggggcaagctttgtccagttcggatggataattcccatgcatctcgatgcatatactcaggggaggcagagattctctcatacccaaaaacatcacggtggagggcagatgggctggtgcgcattgagtagcgtgcggtggcgagtccagcgtggaacgctcttcatccaatacactgggagcaacgga

SEQ ID NO: 524296 - DNA, 223 bp, Homo sapiens
ttatactctatgtgcgagacattgggaggggcttctgaattatccgggagtatcgtcatttgcagtgtgcataagtatggccaaccgttgctttcgtagcccctgctagtgtgacttttaaaatataagtttattgtaaaagtgacatgaaaattacaacagatattccagaccaaaataatacaacaatcccagcatctgattgagtcagtgtttgctgttt

SEQ ID NO: 524297 - DNA, 623 bp, Homo sapiens
tagtaaagatggggtttcgccttgttacccaggttggtctggttctcctgacctcgtgatccgcccgcctgtgcctcccaaagtgttgggattacaggcgtgacccactggtgcccagcctccagcatgatttttttaggccgattctttgtgtttgaaagaattcaactaaggatccactctgccgtgccgtgaccggttttctctcctttcttctctctcatcgggctcccgagttccccagtgactgcagctctccagaaagagcaagagcttgggtactccttactcacagcgccaaaaccgtgcaggggccaaggaaagatacaaaattctttggtgtgcagccctctttgggactccagcctctgtgtcctcctcgcgtgaattccccaccgccacccctttcaagtcatcggcgtgtgatcacaccgtggtgggtatcctgaaggctaaaagcttccacaatgagcccaggaaacaagttctgatgtggttgggaccagacctcgtgctccaagatccagggctggcagtatcccttctgtcctggtggcttcaatcttcatggcttacctctggacttgtagttatccaacaaaccccagtgctctgcgtgaact

SEQ ID NO: 524298 - DNA, 598 bp, Homo sapiens
  misc_feature (538)..(538): n is a, c, g, or t
gcagaagcaggaagcaggaagatcagtgtgacaggcaccaggcatcgtggacagggagtgactgagggagtcacacagggcctggagacctctgtgaagggccaggaggaggcgggagaaggcagtgaaggttttagatgggagtgacatgatcagatgactcctttaagccatgaccctggctaccttggggagaagccaggccgggacgagggggtcaggtcatgaggctactggagtggtcagggcacaggtgctggtggcttaggctaacagagtgggcctagtgggattagaacttggccagacctcccagagcagtagggctttatttagcccattaatttttccctaagagaaacactgccagaggagattctaagacagaccattctctgaatgtatttattcttcttggggctactgggcccaagaagtaaaaactgagaggcaatttggagacacccgatgcaaaagagcccaccacttgtggagcacagtagaatctgatcgtccccccacaggccttagagcttcnctgcagagttggagcgcaggcaccagctctatcccaaactccttgcccttttcgccgcag

SEQ ID NO: 524299 - DNA, 1621 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 524300 - DNA, 668 bp, Homo sapiens
  misc_feature (483)..(483): n is a, c, g, or t
  misc_feature (486)..(486): n is a, c, g, or t
gtgtatgtatgtgtatacatacatgtatgtatttctttcctgctttatccataaactgtttaagtcagtttacaataatacaaaaggtacaaaatagcaaaaattaaaaacaagaaaaaagaaaaagtagaaaccatgtaaggaggactgaggctgaaccagtttggccatgatggagagtgtgacatgggaagcccgagcagtgccacagcccagtgtccacaagccccagtctttgtaattacatcagggaggtacaaatatttttgatattgacaacagcagaaaatttcttttcagagccttcgagagtacggactatgtaatgaatcggaatcttgacaccattttgtcaataacactaatcatgatgacatatttcattctctgggtgtaggagatgctaccacaccaaggcagggtacagtaaggcgctttttgcttgttgggatgctgatattgtgcttgagctttgaggccacngtncttggccttgctgcttcagaagccatgctcacgcttctcttgccttgtgttggggttggattgcacttgaagttgttctattccaaactcctggtggtggcctctttgctcttggtgggaattggccatgagaagggctcgtgggagacccaaggttcaagggaagtgggccggcttccttc

SEQ ID NO: 524301 - DNA, 1628 bp, Homo sapiens
  misc_feature (22)..(22): n is a, c, g, or t
  misc_feature (25)..(25): n is a, c, g, or t
  misc_feature (30)..(30): n is a, c, g, or t
aatggccaggctgtactggccnganttttnggatcgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 524302 - DNA, 2014 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 524303 - DNA, 239 bp, Homo sapiens
  misc_feature (7)..(7): n is a, c, g, or t
  misc_feature (10)..(10): n is a, c, g, or t
  misc_feature (23)..(23): n is a, c, g, or t
  misc_feature (164)..(164): n is a, c, g, or t
  misc_feature (229)..(230): n is a, c, g, or t
ttagttntgngaagccagttcgntgttggagtagtttggaaaatacaatctcactggtggttgcctgtgttctggtgctttcgttgatattaattgtactatactgaccacaacttttgttgatgattttaataactatgaggtatgcatattacactattttnacaagtaagtgactaatggtaaactgtttgtttgtggcctccttgtgaagagagatctttcctcnnttcagttcc

SEQ ID NO: 524304 - DNA, 2400 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaaaaaaaaaaaaaaaaaaaaaaaaaaaaaaaacaacaaaacaaaaaaaacaaaggggggggggccgcaacaaaaaaaccccacacgggggggagcgccaccccagtcacgcccaccccgcacgctttttgtgtggacaccaggaagggcggccccaaacaaaggggagtgcactaatatataacagaccgaaggccagcgcgggcggcgatataacaaaacacgccggccgagggcagaggaggaaacaaacgtaccataataggcgggctcatctagtcgcaggggagggaacccacacactacacggaggaggccgagcgaacaaaaggggggacaccacacaccaacccaaggcaaaatacataaatggctcaagggacgggagcaacaactcaaaaacgacgccgcacgcggagggtaccgaggtgcggccagcccaaccacgcagaaaaaatacgccgcgggcgaaaaaaagaacttcgggccaccaacggcgcgcacgtagatacccgtaaacacaaccattataccaccgcgggccgcgggagtgcagataaaaacagaagaactggaccgcaagcagaccacagacaaccccacacgcgacgaaacccgccacagacggaccaacaaaaagcaagcccccacagcagagccgaccacgccaagaagaccacggcgagaaggcgacgcagagacgccacgaaatagacagcataacgcaagacaacacgcgagcacggagtcacgcagcaac

SEQ ID NO: 524305 - DNA, 290 bp, Homo sapiens
ggaccctccgctggccaatgcacggagaagataccagatatgttgagacttaacacccagcatgtacgttgctatcaggctgtgctatacctgtacgcctctggctgtacactggcatcgtgatggactccggtgacggggtcaccacactgtgcccatctacgaggggtatgccctcccccattgcatcctgcgtctggacctggctggcggggacctgacttgactacctcatgaagatcctcaccgagcgctgtgttacagcttcactgccaattgggccagcgggg

SEQ ID NO: 524306 - DNA, 281 bp, Homo sapiens
ctcctgggctgaatcctcctcctcattctgcatcctgtcgtaggtcatcttggcattgtctgcacagctgctccaagccaggctgatgaagtgaggagtcccctatggtgagctggagtgttgtagcctgaagatggcacagctctgtgattcatctcctgcggttgtggcggccatggtgatggagactgcagctcaacaggagtggtcggcgggtaccctttttaggccaagtagatagtgagccttggacgggttgggtaggagcgaggaggaatacg

SEQ ID NO: 524307 - DNA, 1754 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaactctggggggggctcggcccccaattcgcctttagagaggtgttttaccaatcaatggcccgtgttttacaaaccttcagactgggaaaacccttgggtttcccccacttt

SEQ ID NO: 524308 - DNA, 163 bp, Homo sapiens
ccccagttattgctgagccaggactgtcgggcactgtgttggtggagtacaggattgagcgaagtaggatgcagctcccactaatggccacccagattaccaaggacaaagagatgccacgcttgcggcgtgttggcctgagcagctcttgactgggccgagc

SEQ ID NO: 524309 - DNA, 1553 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 524310 - DNA, 328 bp, Homo sapiens
ggttgtccctagtgctagaacagtgtatgggaggagagagtttccacagctgtgatgctaaagcctgagaagatgttactgttcattaactggcaacatctgttttaagttgatgtcactgctcaggcctgaagggacattattgctgtcatcaccctcttcccttctttcctaaaagccatggagttccactgaaatgatctgcaggactgagcatggccaggtctctcctagagtctttctgtaggtctccagctcctggactgggccctgaaacaatttcagtgtgtgttgtaatgtgggtcacactctcctttcttcagtcaca

SEQ ID NO: 524311 - DNA, 1333 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 524312 - DNA, 287 bp, Homo sapiens
ttaacctagctggtgctatgagcacaagtcaggagagggggcaggagtgactctgaggcaacagagagggtgggaaggggatctccctagtgtccctggtgatacaccccccaaccaaaatgatatctccacatactcaatgactatgaagacataacaggctctgtccttttggaccccaccccatccctggccagagcttcaaaggccagtcccaaaaaggttctaccctcacttgctcatgctactagccttcctcttctcctccttcttcacatttttctctg

SEQ ID NO: 524313 - DNA, 2525 bp, Homo sapiens
  misc_feature (1010)..(1010): n is a, c, g, or t
  misc_feature (1059)..(1059): n is a, c, g, or t
  misc_feature (1083)..(1083): n is a, c, g, or t
  misc_feature (1252)..(1252): n is a, c, g, or t
  misc_feature (1282)..(1282): n is a, c, g, or t
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcaggtgcccttcccccggccccagatgggcaagtgtggagancccaggcttggcttgggtcctggggccgggtggggcgaggatccgcagnccggccaggggctttgcctcctgncccagggctgtggtggggtggacagcacgaccttcccagaaaccctgggggaggcaggggccgtccctggggaccctctcagcactggctgtagccaggcccagcttggtgggtgctgcccaaggggcccctggggtccccagcatggagggcaacagagggcagcagnccccaccctgccccgtggagagcggggggncctcaacagtcaggcccggggctggcagcacagacaccgccgacctccaagcaggtagcctggagggccttcctcactgggacctacagatccagagcccagatcccctgcaggaccattccgaggggggacaggttggtggccggagcccgcggtgtgtctgtgtgtggccgctgggccccagcgcctctcctccccagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 524314 - DNA, 1966 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcaggtgcccttcccccggccccagatggcactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 524315 - DNA, 1940 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcacactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 524316 - DNA, 112 bp, Homo sapiens
aatgtgcacagaatggggagagactggtagagttagctagaggggcaaagggaaaatggataacacaagtcagatttagttaacggggtgcaactctttgatcatacttgct

SEQ ID NO: 524317 - DNA, 290 bp, Homo sapiens
  misc_feature (3)..(3): n is a, c, g, or t
tanttttgacagttggatggtgtctgctccttagggcaggatcggaggcgatcagccagacacccaagtgcagatactaatgaagcccctgctgttttggctcacctaatcattgatcccaactcatcagaggcagtttgtgttgagaacatgacaaagcctcattacaaaatgaatgggggtgggggcacggaactgcgtgaagaaacccgcaggttgtgttgacagtcttataacggatatcaggctagggcttaaggaccggctggaaaacccacgatgagtgtgga

SEQ ID NO: 524318 - DNA, 478 bp, Homo sapiens
catcactacggaatgtcctatcgccatctgtcctcttcttcatggagctcatagcagcatgcagcagaatgcagcgcaatgagcagacacctgtgcaggcgttgctgctaccatctagaagcgcgttgtagaagttgtagccgaagtaggggcccctgttgctgatggactcgtagtatgtggtgtagaggatctgggtgggaaaagaggaccagtcgggtgtagaagaagacaaagggagaagatgaaggaagagagcgtcgcacacttgctgatactgcatgtagttgaccatcttacaaggcctccagcaggtagtcagaggaatcatgtaacagcagcaccagagagccaatgcgcagcaggttggcactgtaggagaaggtcatcaggatgactgccacgaagtggtgtatcacctgctccttgaaatccttgcgcttgacatcatagggcagtctgattagcagtgatgaga

SEQ ID NO: 524319 - DNA, 210 bp, Homo sapiens
tgctcaaggcggcccttgaccgttggtgatggtgatcttgttggccttgccggtgctcttgtcccgtggccgtgacgttcaggatgccgttggtttcgatgtcgaaggtcacctcgatctggggcacgcccctggggcccggagggttgccgctcaagttcgaagcgccccaacagattgttgtctttccgtcatggcccctctagcctc

SEQ ID NO: 524320 - DNA, 127 bp, Homo sapiens
cctggctctaggaatactgggggaagtatgtaggagttgacagattagtccgccgtagtcgcctaagttcagagccaggcctggctctgaacttaggggatcagaacggtgtgtggcaggtcctgct

SEQ ID NO: 524321 - DNA, 185 bp, Homo sapiens
atttttagctagacgacgggtttggccattttggccaggctgatcttgtagctcctgacctctggtgatctgcctgcctcggcctcccaaagtgctgggattacaggcgtgagccactgcgccctgcatgtactgtaattttgcttatttttagaccttccaaagttgccattccgtcttaactg

SEQ ID NO: 524322 - DNA, 536 bp, Homo sapiens
  misc_feature (421)..(421): n is a, c, g, or t
  misc_feature (424)..(424): n is a, c, g, or t
ggccacacagccgcggcaccatggcacctgctggacgcccgagggccaaaattgtgagtttcgtgccctcgatcctagcggagctgctggacgctgggctgcgagcgaatccgttcacacccggcgtgcatacgtagacaagccctggggcctcggcaaaacacttggacgggatgtgcctgagcctgaatttttccctagaacgggttgtgtagacgatatggagcccttactcggtgcctggcgctgcacatagagcatggctaaagttatctgctcatgttcacaagtatactcatttcacaggtgaggcaactgaggctcggcgagtcaagcgactagctcatggtaacagctacagacccacgtggagcgaggatcagaagtctagctatcggacgcatgtagcgcacacattttnttnccttaaccgacccttgtccagagctctttgggctaaaccgaacggggactcttttgactgtacccttccccttatggttaataggctggtcacaccccctcttggtgcggtg

SEQ ID NO: 524323 - DNA, 327 bp, Homo sapiens
  misc_feature (51)..(51): n is a, c, g, or t
  misc_feature (57)..(57): n is a, c, g, or t
  misc_feature (170)..(171): n is a, c, g, or t
  misc_feature (223)..(223): n is a, c, g, or t
  misc_feature (228)..(228): n is a, c, g, or t
  misc_feature (285)..(285): n is a, c, g, or t
  misc_feature (287)..(287): n is a, c, g, or t
cttatcacaacgcagcccaaaactctgtttacatgggtggggtagatggancagggnactacagagtgggatggtcaggacctgggccattgcaaccaaaggggggacctcctgggtgggccggtcactccctctactcactgagccaggattagggagggttattgccnnaaccattgcaatgggcggtggagggacaggctcagcctcctcattgtctaantgagncctaaatgtgtgaagtgcgatttctgcttttgtgtaccccacctccccattaccaananctgcctatgtgtatttgtgtcaataaaaagccaaaccctg

SEQ ID NO: 524324 - DNA, 727 bp, Homo sapiens
ggggttaccggctctgctcgatgtatgtggagatgtcgattccctcgggaagttctgccacattaacttcaaaccggccccgggacgtcatggaggatttgggcatcattctcgtcagacacaaaagtgatggctaggccttgggtgccaaagcgacccgcccgggccacccggtgcaggtaggtgtccgagtcctcaggcatgtcgtagtaaagacgatgtgactcgctcgatgtccatcccccggccaaacagatgggtgggccaccaggatccgccgtgggaaatccttgaactggctgatagcgtgacaggcgctcctccggggccatgccccggtggatggcagatggccggaaagttctggctccacgaggagctggggccaggccatgcagcgctgccactgacttgacgaaagataatcacctggttaaactccagccacttccaagagatcaaagagctggggggtcctcctcactgtctggagttggcgtagaactgttgaggccgtgcacggtagagctgtggtctcgtcgtccaaaactcctccatgggatcctcgcatgaaattcctgcacacaaggcgggattgcctgcccaaggggcgccgacattaggccggtctcggggggcaggggaaactcctgaaccgcggagtcacgtccgatttggcactctccccaaggtccttctagggaccaatcgaaccaaaggcgggcca

SEQ ID NO: 524325 - DNA, 103 bp, Homo sapiens
ccgtacaagtgtgcacgtatactcagtactgcctgtggctctctgtatgacatcacaaggctgcaaggtgctgtttttctagaactaggagttggtgaggttt

SEQ ID NO: 524326 - DNA, 402 bp, Homo sapiens
  misc_feature (265)..(265): n is a, c, g, or t
gccctacctcccctagctctgaaacgagccagatgacacccacctcttcctaggactcccgaagaccatggtgatggtgcagggagagaaggccacctgccagcatgtgcccttcagggtacagacaccctggctactagtaatagcggcccaacaagatcagattccctccccaaactgaagaggagaaaaggaaattatttctgctcagggttggggcaacagagaggagtttttcttcttgtttcaaggccctgtagagaanactagcctacctgcaccagtcaggttaggcgtcagagaaatggcattgaaggggttttgagggatgaagaggagttcaccaagcaggaaagagatgaaagggtatcccaggtggaggaaatagggtgtgcaaaggcc

SEQ ID NO: 524327 - DNA, 362 bp, Homo sapiens
  misc_feature (160)..(160): n is a, c, g, or t
  misc_feature (233)..(233): n is a, c, g, or t
tgaggatccaacacgatctcgcaagattgacaatgaaattcagaatatacttctggtctaacgggaggataaacaagaaaactctagaatgtgccccgagtatctcttaaagggcagaaacactagttatgcgcacactgtggaaaacaaactcgcagancgataacctaaatggttgaataagcatcaaactggtatctggaactccctagtgtgctcatcacagctcaaancacacactttacatcttgtctaacctttactttccacttgtctcagtctaatcatcagtaagagataaggacagcctctcaagagtaccctgaagaaggttaataaaagcattctgagattgcggtgtt

SEQ ID NO: 524328 - DNA, 512 bp, Homo sapiens
tgtctggaaaaagtacaggagagagaatggaaccattcgcaaatgtgaaaaacacatatattagctgaaacatatgcatgatctcaatgcagttacataggaaatgagttttgaaatgatctgattctcatattatctctggtggattatgcaaggtgtcagttactgcttcttctactcctttcccaattttgagggtaatagactaaataccaccctaataaccaaaaggaccaagtagcccatttaagaaacatgaattaaatttctgaggttatctacatctatggggtaagttcaactcttgaatgagtggttgtgaatagcctaacttccttgggagacctggaaaaaaactcggtggtgaccccaattcaagcccaaggtgtccacctttggatatcaaacaccaatcgggcgtttgccaaagccccccccttctcttgcgtcctcctgggggcagtgagccccgctcgaaccggggagcttgaggtgctcttccggcggaaacg

SEQ ID NO: 524329 - DNA, 198 bp, Homo sapiens
  misc_feature (38)..(38): n is a, c, g, or t
  misc_feature (174)..(174): n is a, c, g, or t
gctcgggtggctgagcgcgcggggaaatggccacgggnacagaccaggtggagggactcggcctcgtcgtcgttagcctgatcatcttcacctactacaccgactgggtgattctcttggcatgtcattctccccgtccgctactcaccttccccgagccctggcaccggcacngcaactactatataggctctaggc

SEQ ID NO: 524330 - DNA, 210 bp, Homo sapiens
gctcctgattgtatatccgcaccacaggctaggttgctatccgtgcagtctacagcgttcatcaggttgacggacacagcttacttgttcttccacgggttgggcgttgtcgctgcagatggcgggtttgtgactgctccgctgctcagagtatcagagagaagattgcccgtgtgtggcaccgtttgagttcgcttcacagtgcactct

SEQ ID NO: 524331 - DNA, 434 bp, Homo sapiens
attaaagattttgaggagatgttttaggatggtatctttcagagcgtccagtaatcttggaatctaaggaattgctttaggttggattacctagacctttgctactgactagtgatcctgaactatggcacatgaatatgggggctaagaaattgctccatcggattaataaacaattaacagatctaaatgctcatccatcaaaggattataacggagcatctgctcaaagaaaaaccatgataataatcaggctctaaaataaacattcgaagataccaagtatggccccaaccaattttaaaccaactcgccagtcgcttcgggccagtctactgtagactctggcactttgacccatgcagggcgtttatctcccttacttggccaatttggtagggtagtcctattaccggtgggtcccccatttcgcc

SEQ ID NO: 524332 - DNA, 171 bp, Homo sapiens
ggtgatcctccctctgataggaatgataccgggcttggctggtggttacacggtatccatgaggcatggatgggctagcataggtcaagtgcttagcctaaaccgggcacagaggaggggcagatatgggctgcggtcatcattccattcaaagggtactcattccattca

SEQ ID NO: 524333 - DNA, 964 bp, Homo sapiens
gggctttgggtgcgctgcagcggtcctgcggctgcgcagctgtttctggtaactgctttgcctcccggctcccgcaggaggatgcttggtggtggagtgtggcgaactggcctgtccctggtgtggggatgccgaggctggtgcagtgccctccggggagcgcctgggtgtgggtgggcctgcaccggtagtgcgccctgcccctgttgggccccgcagaactcgcgcctgtggcctccctgctgctgctgatgcccgaagaggctgcggtcttggccgcagatcggcgcccgtgactctggtcagcgccccgcgtccagactctcggaccacagcctggcctgacatccttcaatgcgccagcaaagaggagagcttccaggagcagagcgccttggaagctgagtgcccgggagaccgtcgtcaggagctcctggagaagattacggagggccaggctgctaagaagcagaaactagaacatggcttcagggtgccagctcaatgccaggatggctggctcgagccaaggctgcaaagaggatgagaacagtgattggccaggcttcgggagagcaggaggaagctggccctcgtcttcccaagcagggaacctcaactggggtaggccccttgccaagatctgtctcctttgtccaagctgggccactggcaaggccttcgacgtcaggcaaggcccctggaatggcgtgtccagtctaaagaatggccccaagccggcgcctgccacgaggtgagaaagaattaaaagactgtggaggaggtctacccagaggggtgcagttggagggatccggacaacctggaccctaggttcagccaatttccaatttggcctgagaacccatcagactgtgtcggcttgacaataaaacgtcttgtcagcggagggaaccagggacaaaacactgattgccacttcactgaaccacaggagaattga

SEQ ID NO: 524334 - DNA, 163 bp, Homo sapiens
tcccggtgcagtgtgctatgatgctatggtactttgtaaagagacttagcataccaagatactcatggtccattcatttgttggctaagacagtggctgccacacacttattctaaaattaaaaaaaatagcagtaagcattttaaggagcatcaagataatt

SEQ ID NO: 524335 - DNA, 376 bp, Homo sapiens
ggcgaggctcatcaccatcgagatcaaccccgacttgtgccggccattcacccagcggattggttggatttcgcttggcgttaaggacacaggtcaccctttgttggtttggaggcgttccagggacattcattccccccagcttgaaggaaggaaggtattgattgttggacacacttggacattggtcttctctcggacccacttggaagggaccgggtaccttgccgggacacgctttctctttgggagggaatgttggccttccttgcggaaagggggacagttctacttggctgacaacggtgatctgcccaggtgcgcaagacttcctagcacacgtgcgccgggagcagctgcttttgagtgcacacac

SEQ ID NO: 524336 - DNA, 1663 bp, Homo sapiens
cgagtgctgtggtgtgtggggcgcggcgggtgggtgtctgtggtttgtaggtgcttgctgcttctgtttgctctggtgcggcgtcgttcgtccgggcgcgtcttggtgtgggtgcggaccatgatttattgtttgcggtagcgctaagttggtgggcgctgctctcgtggtttgtggtggggttggagtggctctcgtttttctactcaaggggttgctgtgtgttgctgcgcagagcaggggtcagtgcatgtccgtcggtcgggtgcatcgatgtatttttggcgtcgcccgccgttccgcttgcctctcttttggtgtgtggttggactatagctacgttgttgctgtaatatttaaggagatgggctgcgcttgtgttggtgctgcctgcaagattatttactggctgcgcgccgcgttctttcttttttttgtgttgtggggccccgcccttctttctcctcctcgtgttggggggctgtgtgccgacaaccagacgagtgggtgtgggtgtgtgttgttatgccgacgaacgatcttctctctgtactgaggagggttagtagtgtgtttgtgtggtctcccccccgcctggtggtgagtggagtgggtggatatggtttgtgttgaggataagtatctcgccttgcgccgagggaggtgtgggtggagcccgccgtgtggtgtttgggccccgccgatggggcacagggtgtgttcccccccggttgggggagaagtttctgtggtgggggtggagtgggcgttggggtgcgacgacactacgtgtgtggcgggggggttgtgtgtctcccgctccattggtggatgtgtggttgtggtggagtagtagggcggccgccccggctgttgatgtgtctggcgcagcattagtggttggggtgattggtggcggggggggtgtgtgtgtgtgcatcttggtggtcccgcggctgcgtgtgggggggctgatgatggtgtggtttattatatggtggtggtgttttctcgcgcgggtgtgctgtctgcatcagagtagagagtcgcacacgcacgctcgcactcgcgctgtggcgtcactgtgatctctctccgctcgtgctgtgttgtgtccgcgctctctcgcacgcgggggcgcacacaccgcgcgagagaggctcacacagcacacacacactctctctccgcgcgcggcgggagagagagagagacacacccgccgctcgcgccgagagagagcaccccgcgcgagagagagaagagaagacaacacacaccgcgcgagggcgcagcgccacgcgccgggggcgcgccgagagtagtatttgtgagagaccgcgcgcgcgcgagaggggagccgcgcggggtgggggcgccgcgagagagagaggcgcgggggaggcaagagagaggcacgatgagagaacaccccctgtgagagggcacaccacccaaacaaatagttttttcgctttgtggggttttttctccccctgttttgttgccgcttgtggggactcccccccccgcgagattttgtgggggccgccgcgcgggggggcggggagagagccccccccgcgcgatttcgccggggcccccttttttttcggatttccaaataaaaaggggggggggcctttttttttgtgggcccaca

SEQ ID NO: 524337 - DNA, 124 bp, Homo sapiens
aataataatcccccccccccccggagcgcaagagccaagccgccagcgctgtgatgtgggccacgctgccgctgctctgcgccggggccaggcacatggatctagctggctgcggggccgccga

SEQ ID NO: 524338 - DNA, 110 bp, Homo sapiens
gaagcgcacgatggccgccctaggacacggagctgccgtcgcccgtagtgagatgacaggccaggctccgcccttgatgggacgcatctcctacgctgctgttggtaggt

SEQ ID NO: 524339 - DNA, 840 bp, Homo sapiens
gctaaacgatgcggttccccggtcctcctccccagccatggggagtacaggtccgaggggttctgattaatgtctgtggctgtgaggtacatggccgggtctcactcttctttacgccattgtgcccggcagttatacgcatttggatgaggctgaagacctgattacagatgattcctatagaccatgtgtcattatccctgaggtcgtcctttgtagatcccagagtacctctattcgacgcggttctgctgtgtcatgtttctttgttgcaggcagagtgcgttacacctgggtctcaatatgcccctctgtggatatcatattggaggtatatgagtagaccagtgatgagtggcccaggatctatgacctaaacatcaatgaatgcagatattctagcatatggtcagaaggaaggatggtgcaaattagtttttatcttctagcatttttttataactatatggatgatctatgtttgggtgagctcttagaacaaaaagaaagaattggtccagttaagtgcttgaaaaggcaccaaaatgaaggggattctatccaagcaaagatcctgtcccaaggagtaggcctgtggaaatcttgatcaagttacttttaaaaaaatgactcctttatttttttaaagtgtttccaacaatttgtggtgtgggggaaagaatggtgtcatattgtcattactcagatcacagatttaaacggggtattacggtatacagtcattttaatggttacctctggggggtgacgggttgaattggcattttaaggaaagcataatctcggagagggtaatagggtgccagactggagagttgt

SEQ ID NO: 524340 - DNA, 406 bp, Homo sapiens
  misc_feature (52)..(52): n is a, c, g, or t
  misc_feature (65)..(65): n is a, c, g, or t
  misc_feature (68)..(68): n is a, c, g, or t
  misc_feature (71)..(71): n is a, c, g, or t
  misc_feature (80)..(80): n is a, c, g, or t
  misc_feature (89)..(89): n is a, c, g, or t
  misc_feature (98)..(98): n is a, c, g, or t
  misc_feature (102)..(103): n is a, c, g, or t
  misc_feature (117)..(117): n is a, c, g, or t
  misc_feature (122)..(122): n is a, c, g, or t
  misc_feature (132)..(133): n is a, c, g, or t
  misc_feature (138)..(139): n is a, c, g, or t
  misc_feature (145)..(145): n is a, c, g, or t
  misc_feature (152)..(152): n is a, c, g, or t
  misc_feature (158)..(159): n is a, c, g, or t
  misc_feature (161)..(161): n is a, c, g, or t
  misc_feature (170)..(170): n is a, c, g, or t
  misc_feature (172)..(172): n is a, c, g, or t
  misc_feature (176)..(176): n is a, c, g, or t
  misc_feature (179)..(179): n is a, c, g, or t
  misc_feature (188)..(188): n is a, c, g, or t
  misc_feature (191)..(191): n is a, c, g, or t
  misc_feature (203)..(203): n is a, c, g, or t
  misc_feature (217)..(217): n is a, c, g, or t
  misc_feature (220)..(221): n is a, c, g, or t
  misc_feature (239)..(239): n is a, c, g, or t
  misc_feature (243)..(243): n is a, c, g, or t
  misc_feature (259)..(259): n is a, c, g, or t
  misc_feature (264)..(264): n is a, c, g, or t
  misc_feature (266)..(266): n is a, c, g, or t
  misc_feature (285)..(285): n is a, c, g, or t
  misc_feature (287)..(287): n is a, c, g, or t
  misc_feature (324)..(324): n is a, c, g, or t
  misc_feature (329)..(329): n is a, c, g, or t
  misc_feature (338)..(338): n is a, c, g, or t
  misc_feature (391)..(391): n is a, c, g, or t
aggtggggcctccagactcatggtgggaaaaaggccaaaaagggctattgcncacagaacgtccnttnaantggtcttcntcccctggngactttggncctnntggtttcttttttngtttntttttcatannttttnntagttnttcttangtattnntngttttttantntttnttnttttttttnttnattttgctagtntggcaggggatggnagnnatgttatccaggtaggcnaccncgccggcagatttganttgtntntttgatttgttggtagttnangtcccagcagcccctgttgcttttttgttctcccgcnggggnaaagcgtanggttggggtaggtgtacattttgttcctctgtttcgttcacttggtatttgtnggagaagaggatctt

SEQ ID NO: 524341 - DNA, 479 bp, Homo sapiens
ggggtagagggataggaggagaatgggggataggtacataggtgcttactatactgttgtggtttctgaattgggaatttctcaaaattagaaaagtatctactgaggagcttttcgttttaactggtggggactgggttctgggtggtttggccccttttcttttgagcttcaagaaatccatggtgcaaaggtggggcatacctatgacgacacaggaggataaagtgatcacggagatggcagctcagatccgtgaggtggagcagagccgacaggaggtggttcggtctgtcttagaggtgggtttccctcggaggatccagaccacctcgggcaagtgccagacccagaagagggtcttcagcacctagaagctggaaagggatgaccagccaagtagcttccagcttacagcagccctcaatttgggacctgccaccagctccagagctggactggatggagccggaccatct

SEQ ID NO: 524342 - DNA, 257 bp, Homo sapiens
ctgctcctccctccttactgctcatccctccttatgctcatccctcacttctgctccatcctccttcatccctccttatgcacaaacatacacattatgctcatccctcattatccctccttatgctcatcctccattctgtcatgcctccttatgctcctccctccttatccctccatatgcgcatccctccttatgctcatcactcctcctgctcctccctccgttcatgctccaccctccattatgcaccatcc

SEQ ID NO: 524343 - DNA, 276 bp, Homo sapiens
ggcagtggcaggcgcctgtagtcccagctactcgggaggctgaggcaggagaatggcgtgaacccaggaggcggagcttgcagtgagccgagatcgcgccactgcactccagcctgggcgacagagcgagactccgtctcaaaaaaaaaaaaaaaagaaagaaaaagaaagacatgcagcatcaccagatcaccagtgcttctgactaccacagatgatgaataactaaccatggattagtgaagtaaaaatgatttcaaagactttgctctgaat

SEQ ID NO: 524344 - DNA, 1055 bp, Homo sapiens
  misc_feature (189)..(189): n is a, c, g, or t
gctgcgagaggggtccatactggcgcttgttctggtattcccgtcgtagcttacagggaagctttcacaaaagtccggagcccttgatgtcctgcaagtgaaggaggaggatgtccattgaagtatccttgcgagaagagagaacccaacttgagagtcggcaccgaagtcattgacgttccaagaatnggagccagtacatctgatgaacaatggaaaagtcgagcggcatcatcattatcaatcaacatctcgaaggcaggactctgggagaagcttctcgctggcagctcgtgcaattggttgccattgagaagcctgtctgatgtcagggtaatatcctccaggaatacttggccagagggcttgtgctgaagttctgctgctgcacactgtgagccacatccaattagtctaggccgcttcagatccactggaagcttcagcgtaatccatgatccacggcaggcttccgggtagccatcggcttcttgtgggtatactgagcccagggctgagccaaccatgcctcatcacggaggcatctgtatgttaatctacctaccagttgcgctgtgtagatcacagattgctcctcgtgtgctatgtggacagttgccatcccatgcaacgaacaggagggagctcactcagatgggtgcaatgtggttggatgctggctctgggaagttctgagcatgcgtggcaacatttccctgtgaacaccgcaatgggcaggtcattgcctgatctgtagcttcctacagatgatcctgatgagattggcaacaagaatgagcaggctggtgctggagaacggtgagtgaccaatggagggaatttcagggttgaatggactggttcgctgcttcgtgactttcactggtaacttcagccctgatggtggagaaccggtcctgactggtgctacaggggggcctctgttgcctattcgggcatttcctattgctgactcgcggcgtttcggctggcccagggaaccacctgggtggacgtccccatggttcagggcactgcatggtggaggggcacca

SEQ ID NO: 524345 - DNA, 110 bp, Homo sapiens
cagtagtcatactttatgcatccccgcagctacacacacacaacacacagcacacgcatgatacacagcacacacacgagcacagcacacacacgagcatacagcacaca

SEQ ID NO: 524346 - DNA, 488 bp, Homo sapiens
tggggccagtgaactgacaactaacaaaaaaattccccatgtccttaaaaatggctatttaaaaaaccactagccctttggttttttctctgttttggattaatggcacctgcttaaaaggaaagggtcaaataggctttgtttccctctgggcagggtcaatcatgagctaagctggcaggtgatttaatattagtataactagtcaccttcatttacgatcctgccagttttggctctctatatacttaaaaactcttccactttagattatgataagtatgcttttccatacttttaaaaagatgttggaaaccttcgggaggctttaaatagggatcttcccattcccctttggcagcaaagaggcagattcagttcaacacaccgttgtaagagaaaaaagaaattctcgagaattcaaattattattcaacccacaacttttagttaatccacttcccgctcacaagcaacttttataatat

SEQ ID NO: 524347 - DNA, 272 bp, Homo sapiens
  misc_feature (3)..(3): n is a, c, g, or t
  misc_feature (74)..(75): n is a, c, g, or t
  misc_feature (121)..(121): n is a, c, g, or t
  misc_feature (138)..(138): n is a, c, g, or t
  misc_feature (142)..(142): n is a, c, g, or t
  misc_feature (213)..(213): n is a, c, g, or t
aantggttttgggagaggaaacaggggggattcattgttttcaacaaagaagactggtcattttctttaacttnncaaactggtcttcctgttggcacatactgtgatgtcatttttgganataaaattaatggcaantgcncaggcattaaaatttacgtttttgatgatggcaaagctcatttttttattagtaactttgctgaagatccntttattgcaattcatgctgaatttaaattgtaaaatttaaaattaaatgcaaatcccca

SEQ ID NO: 524348 - DNA, 219 bp, Homo sapiens
cgttatggcttgagcacataaagactgtatgcgctgatcctactttgctattccttatgccaagtgtttgacgcatacatcttgagattgctattacatcaaggatgattatcttatgagagctaacaaactttgcaagacggcgggggccgggtcacggagctgaccaccaagccgctcttcaacctcttctacccggaactgacgggcttcgtgcag

SEQ ID NO: 524349 - DNA, 726 bp, Homo sapiens
agtggtactgtcggtgagtgcagagagaaagaccccaatgctagagattcgctatctgtgcacaagaatgtcactggtgagcgtgtgatgtgcaatgatgctgggacagcagtgatgccccgtgtgatgatgtgtgtggatgtgtgctgcaatgagtgcctgtccctgaatccatgacgctgcatgctgccgtgtgcatgtggtcatgtggacatgggtgtttgggtgccatgcttgctcgggtggctctgcttctgccccagaaatcctctccgcagcccttggttgtgccacacccatgccagcatcaccatgcatgcatgcatgcatggcagatcaaatctggtcatgcaccggcatgttgtggtagaagttgtgatggcatgtacgtgcgcactgatggacttgtgtggtcacttgtgatattctgtacgaggacattgaactggaatgttctggggggcccctaacaaggatccggcacgaaagtgccggcttgcgccagtgccagctgcgggcccgggaatcagtacaagtacttcccttcctctgctctcaccagtgactgcccatcagatgtcccatgccaaggcccctgcctggcacacttgccagccaacagcagagccactatgccatcacagaagttagggcgcatccgtgaagatgagggggcagtggctggtcatcaacagtcaacggagcctcctgagagctacaaggcac

SEQ ID NO: 524350 - DNA, 1134 bp, Homo sapiens
gagctgctggaggggaatcgaggcgcgggtccggggattcggctcgtggccgctggctctgctctgcgcgggagtggagctgtggcccgggcctgctgggggcccgagcccgtcctggagtgctgcccgctcctgcggtctccgcgccgctcgtgagactccgtctgtgctgctctgagggttctgccggtggccagtggagccggggtccgtgcgccattgcgggcatcgcgtgctgctgtgtcggtgctgctggcccggatgggccctgtggcgggtgggcagtcgtccctgtggcttcgagccctgaggcctgctcagcgtcgacctgggctggaggagccgtgctggtcccaggcccgacccaagcctggaggacgtcttgagctagcctgccgctgctggctaaccgagcaagcggctggacggcgcactggcaccagatctcaggtgcaaggcccgtgagcggattctgcgacgaaagcccggtgcgccgggggacaggccgaccgggggcagagatgtggggagccgcggcgctccgttgcgccactacgcaaccgctgcgaacagtgcccggctccatcgctcagtcctaacaatagtgcccgttctagggatcctcgacttagctattctaggctagcggcacgtcattgtgttccatccagtggatacgcatgtcatcgcttgcctgcgacgggtgccctgtacctcgtctcagaaactcgcccgccgttgtacccggaccgccttgcgggcgcgttgcgccgcttggcccgcgcgtggcggcctggggtggcacccccgggcttgcccacgccggtgttgcgttggctcccgtcgcccgggcgccgccccggtgtgggctccagccccgggtggcaccgccaaagccattggtgccacttgggccaaggtgtgggtgtggaccgggcgtacgcgtccgcaagggcaaggcgtgtagcaccacagtagtgggaatacaacctatttggcaacacgttgcgtaggtgggtttgcgctccaagtccgtggcgctttgaagagctaggaatcacgtgcacggaacatgacactatctaggaccattggtatatcctcttcccactgggattgcctatggaccaatcc

SEQ ID NO: 524351 - DNA, 240 bp, Homo sapiens
aagatggagtcttactccagcctgggcgacagagcaagactctgtctcaaaaaaaaaaacaaaaaaccacactattaagttactaggaataactctagcaaaatgtatgggaggccgggtgccgtggctcatgcctgtaatcctagcactttgggaggccgaggtaggtggatcacctgaggtcaagagttccagaccagcctgaccaacatggtgagaccccgtctctactaaaaatac

SEQ ID NO: 524352 - DNA, 911 bp, Homo sapiens
cgcagtggcacacgcctgtaatcccagcactttgggaggctgaggcaggtggattgcttgagctcaggagttcaagacctgcaacatggtgaaactctatgtctacaaaaaatacagaatttagccggcatggtagtgtgtgtctgtagtcccagttacttaggaggctgaggcgagaggatggctttagcccagaaggtggaggctgaagtgagctgagatcacatcactacactccagcctgggcgactaagccagaactatctttcaaaaaaaaaaaaaaaaaggtgggccagggggtgggggctcaccccttgtattcccagcattttgggagaggcgccaagggtggggcggagataatgagagggtcaggagaagatctaaaacttcctgggttaacttgggagagaaaccccggttctctatctaaaattaccaaaaaattaggttggggctgtgagtaggcgggtggcctggtagtcccaggttactcgggagaggttagagcgcaaaatggcgcgtagaaccctgggagaggcggagaccttgtagtggaggcccaaattcggtgccattggcattccacgcctgggggggacacagcgaagcctctgtttcaaaaactaagaaaacagcggggggaacaggggtgcagcatttcctcgtagtttatacaaagttaagttgtttttcaaaagaggaaaatggggaaccgatttatcagaaaaatttttttaaatgggttagagacttttttacacaaaaagggggggggaaatttagcggcttgagggggaaagtttctcttgataaagcgtggtatttttaataagttaaggagggtcgagagtatcccatttttggccgagtgtttaaaaaggtttaaaaccactgttgggaattattag

SEQ ID NO: 524353 - DNA, 288 bp, Homo sapiens
tctagttccatcaatttgcctgcaaaatttcatgatcacctttttttttaacaacttgtgtcatatatcattttataaatatactacatttttatgcattcctcagttgtggggcatctaggtttttaaggtattcagcctctggttgctggccttcaaggtagtgtcagacatggctctctctcactgcatggctcttaaactgaaccaatggggggggggatataagggacttttgggatagcatttgaaatgtatatgaagtaaatacataatagaacattggag

SEQ ID NO: 524354 - DNA, 108 bp, Homo sapiens
atattgttgatcttgaggatcccagtgtactccacaaacagcagagagagagagagagagagagagagagagagagagagagagagaatgtgtgttgcacagtgatga

SEQ ID NO: 524355 - DNA, 479 bp, Homo sapiens
cggggtccagagactggaatgtgaaacctctcgctgcggctaggtctacgaacaagcccattgtcctgtgcctcctaatatcattcgtactgaagaccccatctggggacttggagcactttggtcccgagaccagactcctcagacttctctctcagttgtgatgcttcattcgctgagggtgtctgtttgccctctcatctctcagtacttctacagaattttctctagagtcagtcattatgaattgtacttccctccatcttaagctatcaacttatctgcccctccttcaaggcccaggtagttaatgcacagcctcctccatgaagccttccctaaattccatgcccaaacccccaacttcaacaagtatttcaaggcttctgcaatgattggcactgaaacatagttgtagtacttagcctacctagaccagtaagcgttcatttttagctcgctcattttttaccatgtta

SEQ ID NO: 524356 - DNA, 505 bp, Homo sapiens
ttcgagggttcgcacagcaagtacgcgtacaggttgtaccccaagagcaataggctattatcatagcagcctaggtgtgtagtagactataccatctagggtgtgtaagtacacgtgggatgttgcataacaacaaaatggcctaacaatgcattcctcagaacagagccccatcattcacgggtgcatgagtgtatgttgaatagaaaacataagatttccaggcaatgctgtacatctacataacgttgaagactatgaactaggacgatgtactggctgcaaactacagttaggtgattttctccagtaggacctcatgtgcttgaatttggatcagactgtgccaaggtaagggtttggataggtatacggaacaaaagaaaaggaaggctatggaaatggagtataagactgacaagaatacagctgaattgatctaagctagttagggaacgtagtgatgggacaacaataacaaaagaaaatggaggcagtacggtca

SEQ ID NO: 524357 - DNA, 510 bp, Homo sapiens
ggaggaggtgatctggcattgtgatggctttggcaaggtgtacagggggcagctggcgaggtgagctggtggcttgtgaaggcagctcgccaggaccccccgggatgaggtgacatcacgtgtgacatgcctgagagctgttctgccagtgaggcccgtgcgtcttacgacacatggcttgggctacagcccgccaaacatccatttggccctacaagggactagttgttggccctggggaagggggacagaccacacaactaaccccttgggttggccacaataggcggattccggcaatttaggaggcacggctacaatttggcgccatgggcacctctgcggaataaggcagggaggcccaccacccccaatttccaggaaaggcgcgacgtgggcaaaggactatatcactaggccgaccccagagaggaggaccctgggtggaacctaggccctgggattaggggccccatggttccaccaatccgccaaaaacttggattcgga

SEQ ID NO: 524358 - DNA, 403 bp, Homo sapiens
gggattacaggtgtgagccactgcgaccagccctgttggcgtctttgatcctgggctgaggagctgagaagtttctatggcctgagggtcacacacacctgcccacacacctggccttcacccttcctgctagggggtatgtcctctgccaggagctgttgctcgtatggggggaccaggggcctttgccttgatcagatggagtcctggctggccacaaaacagaacacacccacctacaaagcacgtggcccagagatgtcctcgtctcccggccgctggctgaccagctaagtcctggcactgcagggcctgcccaggccgaattggggctgagccagactccctgcagtggggcccggtggcactgggacctctcacagcctcttttctgtcttgcagg

SEQ ID NO: 524359 - DNA, 128 bp, Homo sapiens
tgagaggaaaccattaaaatggtgttctactctccttgcttgtagattcacaagttgggggtgggtaagagggatagttaaaatgtttacaaaactttaggctccctcggaactttgccagtgtggag

SEQ ID NO: 524360 - DNA, 204 bp, Homo sapiens
ttttatcaccattatatgtctagaaaactaatgggtcaggttcttagcaaaaaaaaaaagaatgtagggtatgttctcacaagtactatcttatttggcataagaacccggacccatccgtatactaaccatataatggtgtatacaaaaggaatgaagcccaatacaaaaaggggtaacaagatttttgggggatcctcatag

SEQ ID NO: 524361 - DNA, 374 bp, Homo sapiens
  misc_feature (22)..(22): n is a, c, g, or t
  misc_feature (368)..(368): n is a, c, g, or t
ttggttgtaaaattgaaattanattgagtacattcagaatacacattttgtgtgaggcttataattacatacatataatttaaaatgaaatgaaatagactggttcccctctatacaaagtcctttgtctctgttatcaagtcactgtattagtggtgattatgaacacagtcaatgataatagaccttctgcattttttttgatttcatagcttcgtatagacagaaaccagactaccttggttaagagtcaggctggatgcagtggctcgctcctataatcccaggactttgggaggctgaggtgggaggattgcttgagcccaggagtttgagaccagccttggcaccatagcgagaccctgttncttaaa

SEQ ID NO: 524362 - DNA, 158 bp, Homo sapiens
  misc_feature (102)..(102): n is a, c, g, or t
aggatcgtctgggtgatgatgtgaatatgtgtgtgtgtgtgtatgcgtgtggcctcgctctgtcttcttcctatacgattccaaggtatcatagattcgtancttccatgaaacagtccccctgtacccccgtctccctctccggtgcacacgcggga

SEQ ID NO: 524363 - DNA, 161 bp, Homo sapiens
  misc_feature (94)..(95): n is a, c, g, or t
gcttgatgaagaggtagagggccagggtttctgctcttgtccttgcttggatcctgtaacaggctgggtcacaacccaaactttcccagctttnnttgaaagagctcttactcaagcccctgacccctttcctattaaggggagaatggctttttccccct

SEQ ID NO: 524364 - DNA, 278 bp, Homo sapiens
  misc_feature (12)..(12): n is a, c, g, or t
  misc_feature (17)..(17): n is a, c, g, or t
  misc_feature (45)..(45): n is a, c, g, or t
  misc_feature (49)..(49): n is a, c, g, or t
  misc_feature (54)..(54): n is a, c, g, or t
  misc_feature (58)..(58): n is a, c, g, or t
  misc_feature (63)..(63): n is a, c, g, or t
  misc_feature (79)..(79): n is a, c, g, or t
  misc_feature (94)..(94): n is a, c, g, or t
  misc_feature (106)..(106): n is a, c, g, or t
  misc_feature (127)..(127): n is a, c, g, or t
  misc_feature (132)..(132): n is a, c, g, or t
  misc_feature (136)..(136): n is a, c, g, or t
  misc_feature (157)..(157): n is a, c, g, or t
  misc_feature (173)..(173): n is a, c, g, or t
  misc_feature (183)..(184): n is a, c, g, or t
  misc_feature (204)..(204): n is a, c, g, or t
  misc_feature (221)..(221): n is a, c, g, or t
  misc_feature (228)..(228): n is a, c, g, or t
  misc_feature (274)..(274): n is a, c, g, or t
ttcatgaatcanggggnaatttgtcttgggtgtcctaaccccatntggnaaaanaaangggcncctaagttctggcccntccttcctttggggntccctgtacctnaggaaaccaggccctgggtgnctttncagntctgctcacccccggtgagcnaacagtgtcagccatncaagcagganngaatggtgactgggtgcccntggtgagctgtgtattncctaggnggtagaaaactgtgggaaactgtggctaataaaaactaagtgtgancgtc

SEQ ID NO: 524365 - DNA, 171 bp, Homo sapiens
  misc_feature (2)..(2): n is a, c, g, or t
  misc_feature (26)..(26): n is a, c, g, or t
cncagttgtgtgctgggtgcctagtntctactgtagatatgaactcagtaatatttgtttaatgaatggctgaggcaggagaatagcttgaacccgggaggtggaggttgcagtgagtcgagatcgtgccactggactccagcctgggtgacagagcgagactccatttca

SEQ ID NO: 524366 - DNA, 495 bp, Homo sapiens
tgtgtctgtgtgtgtgtgtgtgagctggaggtgtcaaggggggaggctcctctgcccttagaaaggggagggaagagtaggaaggaccgtcttgtggtttaagtgccagcttctctgcagtacaacagaacaccaagtagacttctgaggtttttgcctctagtccctggctcctagacagcacttctgcacctttccagggcctgggggaacttgctgccctgaaatgaaggacacaaacctggctgctttgccacctgctgattgcagaagcccagggctttcagtgaatgtatgtggtagccaggaagtggttatatcaggccttgggcaagatctggtggtggtcacaggggtgcttgtgccactctacccacagttccaggtggctcagaaaagagagcaagggaagagaacaagaatctctgcctgaaaattcagagaagtcttctggatattgtccaaaaccatcaagatggtacctctatgagtctg

SEQ ID NO: 524367 - DNA, 138 bp, Homo sapiens
aaactgggagactttgggtcggcttcacatgttgcggataatgacataacaccttatcttgtcagtagattttatcgtgctcctgaaatcattataggtaaaagctatgactatggtatagatatgtggtccatcggt

SEQ ID NO: 524368 - DNA, 126 bp, Homo sapiens
gtctgcaccaagcattacatgtgtaataattgtgctcgatttgtgatgattgatcactagtggataggagcaaggatcatatcaggctggatatacagggtgttgagaataactcagtctctataa

SEQ ID NO: 524369 - DNA, 124 bp, Homo sapiens
  misc_feature (80)..(80): n is a, c, g, or t
cagtctgcgaggacgtttagcagtatctgcgtaacccacagagggccaggccctgcccagctgcagtctcccagcctccnacttcagagtgaaattcaaggcagcacggacatgtgcccatcag

SEQ ID NO: 524370 - DNA, 183 bp, Homo sapiens
atccacttgcctcgggctcccaaagtgctgggattacagacgtgagccaccgcgctcagcccagtagctggctctttattcacactctgtgaagccaaacataagacctccgaccagccctccttcctcaggcttatcacacgccctgattccaaacaaactgcgacccgagctgtgtgagga

SEQ ID NO: 524371 - DNA, 606 bp, Homo sapiens
tctcgttgcccaggtgcgagcttcccagaaggagcagctgctggcatactaagcgctcactcccccacagagcttcccttccacggggccatcatctccgagccatcagagagctggaacgtctctccggtctgggcacacacctcgtgattgcagctctccacagcaccggggcgagcaagaggcttgagcgtggtcacactcagtataaggaggtacacctcccgagagatgacgcccgctcttcgcgcccggctccccaggacaaaggaaaactcgctgacctgggcaagcgccgcagagacgatccacttgatgtactggctgctcctcggcagaatgagagacaggaccagcgccgccaggagaaacttcatcaccaccactgacaaggtgaggaacaccagcaccgtgagctcgtacgcccacaaacgtggggaaccacgtggagccctgttgggaacaaggacagacacgttacgaccgcaggacagcctcccccagcgcacactatttctcacaacttcagtgtgtcacttgcttcaatacagggattaaaatcctaaatcctcccaagtgcacgtgttgaagccacaggaaatgctt

SEQ ID NO: 524372 - DNA, 164 bp, Homo sapiens
ttgttcatgatgggctacattatgtgatctagtttaacgtgtaatgatacaatgttattctacctctatatgtgcttctatctagattttcaactcatctctctgtctttggggtatttcttattctcccttgtccatgagttgaagtatgcacatatatatag

SEQ ID NO: 524373 - DNA, 750 bp, Homo sapiens
gagaagatggcgggctccacaggagtgaaagttcctcgtaattggcgcttgtgggaagaacgttgaagagggacaaccaaagcggagtacggcgaccgggacagttagcttggggccttgaaggatgatgaagatatgacacttacaaggtggacaaggcagtgaattacttggtgccaccaaggacaaattatgaacagcagaatatatagcctgaaatgtcgaatgtgtgactcgtaaatacccagaagctcctcggtcagttaagagtttgtatcaaagattaatatgagacggaatgagtaattccagtgggatggtggattgcccggagcatacccagggttagcagtagatggcaaccaaattcattatacgcattaaatgttgtatcttcaagaggtctaatgacgtctactgatgtccaaagacttataggtgaagcttccacagccatcggaaggacacatgatacatacaattaatgttaacgtggatctcagaacgttgtcttaccatcaatgaacctgtctactcagtgttattgtcttggattaaatatcagaacatgcaacattacgcatcatgttcaagagtcccagctggtaaacatgacctggactttgttagaatgttttcatagtatgtacaccattatgtggcaggtaacgggaggaaattgcggcagttgttactccggaaggcccgggttaaacttaacctggggcccgaaatagaattcggttccag

SEQ ID NO: 524374 - DNA, 418 bp, Homo sapiens
  misc_feature (214)..(214): n is a, c, g, or t
  misc_feature (310)..(310): n is a, c, g, or t
cttctgtccacagccacccccacattttcttttgtattggtctgccaacttcagaagaacttccagataagaattctgagtgaaggtccagaatacaatgagtactggggcaaacaggaccggcaagagactagccggatgcacacagcacgacactactagaggacccacgctagatacacagacaagagcgtcgaaaccgcgactacagcanaagagagcaagctagaaagagaaaaaaaacaaagaacacaggacacgccagacatgacataaggacaaagaccagacgagacatagtagcacagancaagaagcacaagcacgaacagaatgccacacaacggacagaaaggagaagcgacctacacccgatacgaaacggacagactcatcaaaaacaacaaaaaacaacaca

SEQ ID NO: 524375 - DNA, 184 bp, Homo sapiens
cgtaccagcggtccagagaccccagagatgtgcgatgttaagcatctacctgctctgggacacagtcaattaaatgtgactcgcaccagcctgcatggacagattgtgtgaacagattatcttctcagaagcagctgcagctgtgtgcttccgttatcagccctccgaggtggatctgaattgc

SEQ ID NO: 524376 - DNA, 341 bp, Homo sapiens
catacagaggccctcatctttactaaaaatacaaaaagtagccaggtgtggtggttcacgcctgtaatcccagctactcgaaggctgaggcacgagaattgcttgaacccaggaagtggaggttgcagtgagccaagatcgcacggctgcagtccagcctgcgcaacagaacaagatgccatctcaaaaaaaaaaaaaaggaaaggaaaagaaaaccaaccggcctgggcaaaatggcaaaaccttgtttttactaaaaacacacacaaaaaaaaaatttacctggccatggggccagccccttgtagccccaccctcttgtgattttttgggagcccctt

SEQ ID NO: 524377 - DNA, 315 bp, Homo sapiens
ttccacaggctcagagattgctcattgtggttgtgcacagcatcccacccggcacagaagtgttgatggctcaggtgggagcccgccgtcgcaggccgtagtgtaaagagcgtggtcatcccagtcccgcacacaccagttgcacaagctggaggatcttcctcttagagacaacagcatagtgcaggttgaggcggccatactcccactgcacagggcaatagacgtccagtgcattgcaaagccagaagtaggaagagcgtcgggcctggaattccttggtgcagagtgagtgagtgatgcctgtggttaaga

SEQ ID NO: 524378 - DNA, 715 bp, Homo sapiens
gggatcgttaaaaaaaaataaaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctttgggcccccctggcccaattctttttaaaactgggacagttttttcttggggcccaaaattgggcccatttggccaattcccccttttggggggcgattaaaaaataaatggcccggtttttaaaaccctcaaattggaaaaaccctggggttccccaaattaaaacccttgggaaaaatcccctttttccccactggggtaaaagccaaaaggcccccccccattgccttttcaaaaaatgccgccacctaaatgggaaatggaaaatttaaccgttaaatttttgtaaaaattcgcctaaaaattttgtaaaaaccgtcctttttttaaccaaagggcccaatatcggaaaacccctttaaattcaaaaaaaactcccccaaaagggttaaggtgttttccaccttggaaaaaaggtccctttttaaaaaacggggttctcaacccaaaagggcaaaaacaccctttttagggagaaggcccctttatggacactcttcccctagttttttggggctaggggcccctaagacctatgtggccttggggccccc

SEQ ID NO: 524379 - DNA, 249 bp, Homo sapiens
gcctgatctgggagcgaacggtcggacctcggctgtgtgtgacacgccgatgatccggactagttcctgaaaagtctcttccagtggttcagtgtgcatgcttatttctattgggttcatctggttagtcagttcttctggtctgagacattttctcatcttagcgagatctctctgctttttcttatatgggctaattagtcttctttgaatatccagtctgtagcgtatggactctcggcgtgtgca

SEQ ID NO: 524380 - DNA, 438 bp, Homo sapiens
gcaatctgttagggtttgtgtctgtcgtgtggaagctttgttcattcgtcttttgcaataaatcttgctacttctcagtctttgggtccacactgcttttatgagctgtagcagtcaccacgaaggtctgcagctgcacgcctgaggctagcgagaccacgaacccaccgggaggagcgaacgactccagacgcgctgacttaagagctgtaacagcttaccgctaaggtctacagcttcactcctgagccagagagaccaggaacccacctagaaggaacaaactccggacatgccgcctttaagagctgtaacactcaccgccagggtccgcagctgcattcttgaagtcagtgagaccaagaacccacccattccagacacactgtcatcagtgggatatctttttcagagataacattgcagtcttgggttgct

SEQ ID NO: 524381 - DNA, 620 bp, Homo sapiens
aacaagtgtcttggatggtccggatggagggagcacagatacaggcaaacatatcaaggagaatgactattatactccaactggggagttccgtgtggaccgtgaaggttctccagtgcatgctcaactgcctcatgtactaagatgtgttgaactatcgcttggacaggtttacacagaagccaagcgtcctccaggctttgaggcgtgtccgagaatgctgagatgggaataaagactttgagcttgatgtcctggaggaagcatataccacagaacatgggctggtcaggatatacaaggtaaaggacctggataatcgaggcttgtcagggacataaatgtcacgtggcagctctgatatgcttcgtactgagcacatcacatttaggacgttgaagattttttggggtggttaataatgcagttggtaggaacaaaacgggatggtcatcagaaatggtctgggaagttgtgtctggggcagtatgggctgggccaaatgagatgagttcgataaattctaaacgggttaccaggtgaaagtgtcagggctggacttgggcgcaactcgacgggggcactggtggtgcagaccacaaatcggacaaaacacacga

SEQ ID NO: 524382 - DNA, 168 bp, Homo sapiens
tgactggctagtattgtcacatgtgtcctcgagctctactgcgatggtgtgcaggtgagattcgggctgagactctgcccttggagttgcgctctgtctcttgaggctgccgctttcaccacaccggctgtcggctagtcgggggggtacgagctcgaatcgtatcat

SEQ ID NO: 524383 - DNA, 824 bp, Homo sapiens
gaggcaatcagacgggtaatggttgtctgtgagtgttgtgctcagctgtctgcaagtatggcgtctaatactgatagcaagatgatcattgaaatccgataacttataagcttgtgactatggatccttattacctgagttaatacatggaattatcaagtgatactcgcactggctggaaggatgctccatattgatgcattcactaaaatatctcgcctgcagagactgagctactggtcatacggctgtcacaatcgtgtattacctatcaaccaatagtacttttaaaagacgacgtactagtagaaatcttagtcgcacttatgctaattatcattctttccttagactagtcaaaaagactctaagcagtcattgaaatgagcctagctatcttatctatagtactcgtcacactgacttttttccactattcgatttcccataactgacaaattagagtttttaaatcacttaaatcatcttccaaaactctatccctaacttttataaagtaagcaataattatcttcagcacttacatctttaggagtcgactggactcgtcgtaatgagagtatttcacctagtgcaataacctggattccatgctcttttcagagcttgaagcatccaatgatttttccctccactgctgtgtaatgtaatgtcacttccaaagaagaaaaactgttctgtggtaacaaaatataattgctcttaattcttggggaggttactaatagcagtaggatagaattttatgaggttacctacaatactttaatgtacgttacactgtaagcccttgttgctttacc

SEQ ID NO: 524384 - DNA, 713 bp, Homo sapiens
ggaagagctgcagtgccttgcgaggcggcggcgggcgtgagtgctggtgcctggaggggtggggacggcgaggaggtggagtgcctgtgctgctcctgctccgttccagctcggtttcattgtccctgccaggcgaaggatgacttcctgctggcactacacatgtgtcttgaccccagtgactcaccccaagggctacaccgagtacaaagtaatctgcgcagttcatctcctctttaactgtgagagcaccgaggagtgcatctggttcccctgcccgaggacccctcaccgaggactgagcttgccctcttcgatcccttctccaaggcaagaagtgcgcaagcccccagtaccaaaccatgtggcctgagctggcaacgactggaggtggagtctgcaaaggctgcgaccaggaacccatgggcagccagtgacgtgcgccacgaagtgagggaagcagtgactgctgcacacgtatggtctacaacaccttcactaccttaaccccacgccaaccgtatcgtaagtaaaccacgctcgcgatgctgtgtcaattgacgaaaaggccaggcgggctataccgagatgcttgaatgctaccacgggactcctcgcaacagtgagccgttgaacccattatatgcatcaattggtacgatccaatgttcgacaccggtagtgccgtgtccaggccacgagacacctgtgac

SEQ ID NO: 524385 - DNA, 197 bp, Homo sapiens
gtctagaggatcccatggaagtctggctgtctcttgttttaaacatcttgtttcaaactataaattcccaaagttcgttcagcctgcgtccaggagtgaacaaggacagctggaagttagaagcaagatggagtcaattaagttagatctccttcattgtctcagtcataatttggcaaaggcaatttcaggattac

SEQ ID NO: 524386 - DNA, 285 bp, Homo sapiens
cagctatgaccttcacccatctcaagaactcctacattttcacgatcacaccttaataatcgtattctttatcagctctttaattgttatatatcatttcactcttactaacaacaaaatctgacacacactagtcacaatgttatgcccaagaatagtatatacacacttgaacagatccttacccgactatctattctatattcgttattagccctgatcattagctgtattcctgggggagtatccgtctagaagtctgaccatgcaggtcctgcggagctt

SEQ ID NO: 524387 - DNA, 263 bp, Homo sapiens
ttctagaaagttacattctctgtttttagaaaattttatattttgttttacacttttacttcttagtaagggattttctacatttaatttagatttaatcatattatttcactctatattcttgtgttttatttgaaagagcctaataactgaaaacataccttctttctatagtcacatattataattcaagttatctgtaactaactaatagagaacagaagaaaatgtcagtcttacatatatttttttccaaaaaaaaa

SEQ ID NO: 524388 - DNA, 275 bp, Homo sapiens
gctcccaaggaaaaagtgtagcctttgttgggttttggcctctaaaaatgaaattgtcccctgatcaggaggggggcagtatacccctttttttagttgcccaggcctaaacagggcagggtcaatcaagtcaggggggttagtaacagccaaaacataaaccccctgtaagcctttttctccctccaactgagtcagcaactggttaacaacccggtttggaactcctgtattttcatgacccccccgaggagcaatggattcaaattccccca

SEQ ID NO: 524389 - DNA, 811 bp, Homo sapiens
gacgccggtgcagcgggggggccgggggcctggtggccctgggatggggaaccgcggtgggttccgcggaggtttcggcaggtggcatccgtgggccgtgggtcgcgtgcgtggacgtgggccggggccgaggccggggaagctcgcggaggcaaggccgagggataagggagtggatgcccgtcaaccaatgttgggccggctttggtccaaggacaattgaagatcaagtcccgtggagagagaatcaaatctcttctcccatgcccaattaagggaatcaaggagatcattgattcacttccatggggagcctctctacaagggaatgagagtttcgaaagattatcgccatgttgcagaagcacatgaccctgtgccgggccaagcgacaccaggttcaaggcattatgttggctatcgggggactaacaatgtggccactgtacgggaacagggagttagtaaggttgctccaaagggaagggttggacaaacaggcacaattacggtgggggccaatcactccatggagcaaaaggatcctcccaatcggtccccgttgcgcaagaggccaaactgtggggggaaccaaagatcggggaaaagcaccaaaacttgtcacctctgcaaaggtgttgccaagggcggactggggcacacatagagcatgagaacgcacacaatcccttgcacccagggcgcactgggcaattgtactcggaaccttgtgcgataaaaagatggcaaatgaagcggggaaacagcagaagggaaccaaagcacggggtgatgcaacctgggaatacga

SEQ ID NO: 524390 - DNA, 768 bp, Homo sapiens
agagctttctatcttaaggtcccaacaagtgcttttggtgtcggtgctagagtttcatgtttgctgagcaagtgctctaccgccgagctgcatctccaaacccacacaggaagccttgtaaaaaactgaaatgaaagaaaataccagagcacattcaacaatagaaaccaacattctcactaccaagcctcagcacagctggaaggaattcgaaggagaagtgttgtctcctggcccttcccctgacactcctgcggttgcagacaggttgactatagaaaatcacagcaggttggagcattccatttcctactttgcaaacagggagtggcccaacacctacttctgcatctccgcccagactcgggggtgggggagggtgtaaaggaccttaagagcgagcgtattccttttcccttatgcaaaaagactgttgaccactctacgtacaaaatgtcccctgtctgtctgccttttcctcagcaattgctgagccagtcatggaaagcggcaaggcaaaacacccattaccaagatgtagctaccaaaggactgagattgggatcagaaattcaatacctttaccccagcccttgtggacaacttcctcctgtgggacttgaggactctaagaggtcaccagaaagttatatatgagctcctccattgcatggactgtctaacccttctcatcctgccgagcgccctctgtctcagtgagttctgctctttgtttccctcatctttttccctgtctgaatccaacca

SEQ ID NO: 524391 - DNA, 676 bp, Homo sapiens
agcggcagggtcactagtcgtgtctttgaagctgcctccgaccggcaccatgagcggccgaagtcggggtcgaaagtcctcccgcgccaaaaaccggggcaaagggccgcgccaagggcccgagttccgccctgctccggacgacgccccgcgcgacccggacccttcacagtaccagagtctcggggaagacgacccatggcggcacacgcgtgcaggcatggctgcggggtggggtggcctggaagccgctgcgtccgcgcagctcctccggctcggggaggaggccgcctgccggcatccccactggaactgtgggctcgcgctgctggcccgagctgcgtggggaccactgggtcaggccgcggtacaggcccggcccggggtaaggccgaatctctctcggagacgcctgggcgcagacactgtcttcgtgggaacaggcgggaacccgtgggaacggccgaataaatgccccccgcgttggaaagccggcgtggccctgccgggaatgatggccccagaatccctgtagcaccgcgagggaagggggcctcaggttccatacgacttggtgggacgcgcagcaaggaccaggcggccggcaggggcagaattaccttcggcagtcaagcatggcggaaggccccagaacggtaagtacgacggggcgact

SEQ ID NO: 524392 - DNA, 112 bp, Homo sapiens
aggcgacatagaaactcaacgatgatccagaacatggagacctctttactccctagaattctgccagtatgagacaagtcacttatatcattactactaactctcataacac

SEQ ID NO: 524393 - DNA, 227 bp, Homo sapiens
acgaatcgagctcggttaccacagttcgtgtcatgaacgatgtcggtcttgaacattcgtgtcaagtgcccctaactgaaatactatccgtatggtcccacctataagttacccccagtactccttacactattcctcatcacccaactagtaatattaagcacgaactagcacctacctccctcaccgaagcccattaagataacatattattacaaagccctgct

SEQ ID NO: 524394 - DNA, 329 bp, Homo sapiens
cacgaggtagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctactaaaaatacaaaaattagccaggtgtagtggcacgctcctgtagtcccagctactcgggaggctgaggcaggagaatcgcttgaacccaggaggtggatgttgcagtgagccgagatcccgccactgcactgcagcctaggcgacagagcaagactccgtctca

SEQ ID NO: 524395 - DNA, 322 bp, Homo sapiens
cacgtgcagatatgtcaaggaaggaaggtcggagtcctgagtgcagatgtattgggagggtgaggggcagagtagttccgcccggcgtgcttatccaggcctcgaatgggacctctggttggggtctttcttgctcgctcgtagtacacacagacatgaccatagacacccgcctgaaaggcaagatgtttcaggaaaggaagctgcgtagactgtcaggtgcggtactgggttcacagttgtagagaaactgcagtgggatttcatccacgccaagggcgagggtctaactgttatgcgtgctggcaaatgcagcaaggac

SEQ ID NO: 524396 - DNA, 604 bp, Homo sapiens
  misc_feature (75)..(75): n is a, c, g, or t
tctggggaaaacttgaaatccagcaaaaatatccgtgggccggcaagatctccccttttgtggtggtcacagccnccaggccccaggagaaagaagaaactaaggtgcctggcctacgcttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcttgccacgtgcagcacagcagcctggcccagcccctcgtggtgccctgggaggccagctaggaagcaagggttggaggcaatgtgggatctcagacccagtagctgcccttcctgcctgatgtgggagttgaaccacagaaatcacagtcaatggatccacaaggcctgaggaccagtgtggggggacagacaggaggtggatttggagaccaaagactgggatgcctgttttgagtagacttggacccaaaaaatcatctccccttgagccccccccccccccattgtttaatttgtagaagctaataaataatcatccctccttgcctagcata

SEQ ID NO: 524397 - DNA, 643 bp, Homo sapiens
tggacctgacggagactgggcctgttcccaatccatgaggtatatctacacccgcgagtcccgggccggtcgcggagagccccgcttcatcactgtgggctacgtggacgacacgcagttcgtgcagttcgacagcgacgccgcgaagtcgagatgtgagccgcggtcgccgtgggtggagcaagaggtgccggagtattggtaccgggagacacagaagtacaaacgccatgcagaaactgaccgagtgagcctgcgaaacctgcgcgggtactacaagcagagcgaggccgtgtctcacaccctccagaggatgtattggtgcgacgtggggcccgacgggcgcctcctccgcgggtataaccagttcggctacgagggcaatgattacttcgccctgaattaggaacttggctcctggaccgccgcggaacaaggcggttcagatcaccgagcgcaagtgggaggcgggccgtgaggcgtagcagcggagagcctacctggaaggcacttgcgagaagtggtccgcagatacgtgagaacggtataagacctgctgaaatgctaagaggatctctaaatcacctgagattcaagctgaagccctctttaactcgtatgaacacccggagaagcaacaaac

SEQ ID NO: 524398 - DNA, 158 bp, Homo sapiens
atcaggcccactctccacaaacagacatgaggagaggggcccaggcccggcccccagcgcttgtgcagcgggaaagctgcgtccagagaaggctgagaggttgctcacaggccggctgaggagagaccctcggagcattcaacgcagccaggcggccg

SEQ ID NO: 524399 - DNA, 402 bp, Homo sapiens
cacaacaatttttttttttttttttaaaaaaaaaaatttttcccccccccacaaaatttgtgttgggtgagccccccccctgtgggtgcggggggcccccaaaatttttgggggaaaaaaattttttgataatataaaaaggcggccccctttttttcccccctctcttttttggggggggtgggagggaaagccctcttttttttttttaataaaaaaaaaaacaccccccctttttctttaatttttaaaccaccccctttttttccccccccccccaaaaagggtttttttttagggggccatttttaaaccgcgggcccccaccgggggttttggggaccttttttaattttccccctttggatcagggcccttttggaagaaagagcccttttagca

SEQ ID NO: 524400 - DNA, 700 bp, Homo sapiens
gacacacacacagacgtgctcacggagagcctgtgcctgcctctacttgtctgctctgcgcagatggttcctggcttttgggtcacctcatcctgcagcccagtccagttagaacctttcttccacagagactggcaagctgtgagggtaagagttaaggtaaggctgcctggtcttgcagagcatgaaggacactgcccggagagggaagagggcaatatatagtgtaagggcctacttgtcgttgggctccccactgcctctccttggcagagctatcactgggcaccctgcggttgcaaactctgcgcgatggatttcaagcctacaaaagaaaacactgacgagggtgtccaagaaagacgacagaacgaaacacgtcgttgatggtcctggattccacgtgttggatcattggtggggatgagaagcaggaattaccaggtgtgatcaacacctgacacggtacctgcacggatttaaacgaatggcgttcccacgacggcaggtgatcccgagggctcagccaagaacgaaaatttcccagagacatactacgaggacaacagtttaccaagggcctaaaacgccatgaacgcattagacaggcacgaacagaagactcacacagtgagtagggatgtaatcactcacggggtcccaaggcagaaaacgccacaacaacgtgggtatggcacac

SEQ ID NO: 524401 - DNA, 751 bp, Homo sapiens
  misc_feature (345)..(345): n is a, c, g, or t
cgccgggggttggataaatggcctgtaacacggggtctcgtgactgattgaaagtacccatgagctatttcaggcccgtatgcgctatgcagaaggccgtgttaaaagtatgcctcgtaggcctagtccaagataggggacggctctgggatatgtcagtaagttaatactgagtataaagcgtttgaatcatagccccactacctttagtagtactgcggcaagtactattgtcacagcgtctggcggcatcgtcatggtctttaggcaagtcataagtggagtacgtctaagaggtaccatgcactataaaaagctaatgtgtgatcgtactcatattcatgncgatgacgcacgagcttactagtgcctgctcagtgagagtgagtattaggaggattagtcaacttagacatctgtgagtgtactgcactgccatgagtataggtttgcagcatatcagtgtctaagattgaacgtatgcgcctgcgttaagacttgccgacaggtagactcagccggtgatgatagacatggtggcaataactgtagtgatcaagctttcatgccatatgagtacgctaggagtctgtcaatgttaacataagtacaatagtaggaaccaaagcatacatgcgcacatagctcttcctgataggtgagcacaggatttggctcttgaccgacataattagcaatcggtagtcgttctgaaggtagcagttagaggagtaatgttataaagttctag

SEQ ID NO: 524402 - DNA, 950 bp, Homo sapiens
gtggccccggagcagtttgtgtgtgtgtgctcagtgagtgatgccctgagtgcaacagcggccacacagacgaggggcaaggtgctccaagatgctccttcctcctgagcccaacagcactgggtctctctgtgtgccagggccaccctaggcctctggtgtgtccaactgcccaacaacccccgtggccctccacctggtgctcatgtctgaggagggtcccagggacgtagctggtggcgccagttctatgccttggggtctatggcattgctagtcacaatgtgacaactgagttctgaccccatggtggccagtggaacccatggtacacctgtcctccttcagacttccacgcaagggcaccatcggacataaacaccctggcagccctgactccaggaagcaaacacatggaggaacagctggacactgaggactgcctggacaaggactacattccaccgaaccggtgacgcggacgtggaactccaggcgcccctgacccagccggagtgcacacacttcccgggctgtcctacgaagtacacaaggactctactcccatcacgaagcgggggagaccgtgccctccaggcagactttgggcacccagagcctacaaccggcaaccgggaaatcacacgggcaagaaccaaccaaggcggaacaccaagcaagtgcagcccaagaacccagttgggcgaaccaaagctccaaaagtcgcacagatgccaagccacaactgctcacaacaccgcaccacggggacacaggggggacacaaagcccaacagtggggcaacgcggtcgcgaggtccacggtgtaacaacacggaaagctggagcctacaagagaaaaccacagtagccaccaagaacaaggaaacccatagtgccaggaccgtggagcaaggcgataggggagcaacacaaaagccgggagcaac

SEQ ID NO: 524403 - DNA, 513 bp, Homo sapiens
gagagcagacacgtctacatgggcgaaaccctgtctctacaaaagaaaaataaaaaaaaaataagccataaatgggggcccacttctgtagtcccagctacttgaaaggctgaggcatgaaaatagcttgaccctggaaggcagaggttccagtgagccgagatggtgtcactgcatcccagtcggggtgacacagtgagacttggtctcaaaaaaaagaaaagaacaaacgaggcctggacgcggtggctcacgcttgtaatcccagcacttgggcaggcagaggcaggcggatcacgaggtcaggagatcgagaccatcctggttaacagggtgaaaccctgtctctactaaaattacaaaaaattagccaggcgtgctggcaggcgcctgtagtcccagctactggggaggttgaggcaggaaaagggtgtcaccctgggaggcggaggttgcagtgagccgaaattgcaccagtgcactcaaggcggcgatcccactactgatcagcac

SEQ ID NO: 524404 - DNA, 157 bp, Homo sapiens; identical to SEQ ID NO: 480870

SEQ ID NO: 524405 - DNA, 357 bp, Homo sapiens
tgaggatcctcggacagcacgcgctaacaacctgctccctcttaagccaggagatgatgtttggagcattcccacaacgttccctaacacagttgcagcccccagggggatattgagctatcatctctgcacctgcttcgtgagaagactacacaacatttctaagagtctgagattcgagtatttgtccgtttaccactttcattattcattcacctcaggacatgcagtaattatttcagtctcgaactgggaaacaccctgagctacattctgctgtcacctatgtgtcaagaagcagatgatcgatgaggcaggtcagttgtaagtgagtcacattgttagcgcgtgctgtcc

SEQ ID NO: 524406 - DNA, 187 bp, Homo sapiens
  misc_feature (123)..(123): n is a, c, g, or t
agcgggcggcagtgagtcggactctatggaggtggcagcgggtacgagtggcggtgagcagcgatcctctgagctgagtttgaggccgtccccgatccttcctcccccttccctccccctttngttccgtccccttcccctccttccctatccgatgacgatctgagaggcatggtggggagtacgg

SEQ ID NO: 524407 - DNA, 163 bp, Homo sapiens
tctagaggatcctatggagaccaggctgagcggcaggctgtgcactggaggtctggggtccatgctcaggagtctggtgggctgggacagtgaagcatcgatgacccctccgaagtcacgatcttgcctggagctcctggttcaccgttttattccgtggtcg

SEQ ID NO: 524408 - DNA, 236 bp, Homo sapiens
ttgcatcgggatgtggaggttgcagtgatccatgacctcaccacagtactccagcctaggggacaagaaccaaactccgtcaaaaaaaaaaaaaaaagatttttttggatggttcaataaaattaacttttttttaatttctttggggggttttggcctttttattcccgaatttttttttcattggagcacaaaagtgatttcccattgggggggtgtcatctctgatttttttc

SEQ ID NO: 524409 - DNA, 293 bp, Homo sapiens
aatccctgttatctgccaacacagaatgatcttggcttgggtaagttttcctgcttgtgtaatttttgataaataagacgttaatactgttttaatgaaaaacagttaaatattgaattatttagtaaaataaccatatatttaatcttaatgtttctactcacctaaatatctgaaattcacaggctataaaatggttgacagggaaataactttacatgatgactcacagttttcataaataatgcaggtaaactattaatataaaataattaggtgttggggataacata

SEQ ID NO: 524410 - DNA, 1399 bp, Homo sapiens
aatcccaggtttggcagcactcaccgcaagccgctgaaagagcctttgggccttaagtgaaaactggtggtaccctggcagtactccccatgggcctgcagtggtggtggacacagggagagactcctctgcctggggaaaggggaggaaagagtaggaaggactttgtcttctggttttggcaccagctcagctgcagtagaatagatcacaatatatgtttctaaggtttccgactccagacctggctaccagacagcatctctgaacccacctagggcccaggggaacacgccacccttaacagaaggatacaagcctggctggcctcaccacctgctgattgtagagccctagagcctcgagctaaactaaaaatagagctaccatatgatccagcaatctcactgctagaaatgtacccatatgaaaggaaatcagtatactgaagagatatctgcattcgcatgtttattgcagcactattcacaatagccaaaatttggaagcaacccaagtgtccatcagcagacaaatggataacgaaaatgtggtacatatacacatttttatgggtatttcagccatataaattatgagatcctgtatttgcacaacatgaatggaactgagggtattatgctgaatgaagtaaccaggcacagaacgacagcttcacagggtctcacttattgaggagctttaatacaatgaacttactgggaaggaacgccaatgaggttccacagcatggtaaggtacccttatgcttggaacgtggtgaactcatgtgttcaaacaatttgacgcctagcactacgcttcgtctgcacacacgggcctctcgctctaattctcttggcctcttcatacggctccgggctccttcccatggtcttcactcgcttaacatcttatgcccggaccccctgtatcttcgcgggccatttcataccctgctcgacttctacttctactagtcgtctacacgatcacacctcctctctctctccctctcgtctcctatctcttctcacatcctctatccgtgctccttacgctactctctttgcgctgctctctcccttacacacataccgtcctccgccacatccctccatatcctatctctcttgctcgcctctcctccttgttctaactcttcgtgttgctattgctctacctcgtttctctctgtcttcccgacgctctctcatcatgtcgctcgctgcactctcatgcactcttactcgatcctctcctctcctcttcctctctctctctcttagctctctctcatgtacgtacactctcgttgccttacagctctctgtacgactcttctcttgatgtccgttctcactcgtctaccgctccctgctgtgccgctctccctccg

SEQ ID NO: 524411 - DNA, 341 bp, Homo sapiens
cctctccatttccctgttaacaaaattcctactcgtaaggattccagtgaagtttaggtaatctaaatgaataactactttatataattcaagttaaggtatatttgactaacagacttaaatcctcaatgaattctaaaaggaactaattaaaaactgtcaggaaggggagggggaagaaaccatgagggggtgaggaggtaatgttttcccaaagccccaggactctgtgccacttcagattccttcacagacaggacactaagagtggagggggtcactgccaccttgaaccccacttccaaaaaagagagtcgatgctttatcgtctctggaattta

SEQ ID NO: 524412 - DNA, 477 bp, Homo sapiens
  misc_feature (37)..(37): n is a, c, g, or t
  misc_feature (68)..(68): n is a, c, g, or t
aaattaatcttaagtatgtgttctggaagagttttcncttagtatagtgccccagaatttggatttgncattctttggtcattgttcatacttaagtaggtggcttttgatgaaacgttttcatctgatggtcttttgaaagttaatgtgggacagctaatgtcaacccctcgtacatttaggaaaaccggttagagtggggaagagttccctttttttgtcagtggattgaacagttagatataggacctaccaaaaaacacttcttcaagccagttgtttgtgacattagagtattaagagtcaaaccatggtgatagacacagatttttgtggctgataaacaacatactcttcattcttattagtgctggtcctaacactagcagataaagtggaaattgctgtatgctgtaagacactctgtatatgtaagataaaatgaccatttgaagattaaaactcctgtgagactgg

SEQ ID NO: 524413 - DNA, 1076 bp, Homo sapiens
cacctcctgtgacttctcccaaggcagctctacactcacccgtctccgaagtggcccccgttaattcccccatcctctgcgctcccaccttcccaccctgatgcccgggtagtgggactccacctgcggccgccgaccactgctgcctccgcatgggcaccccggtgccccaaaactgggtgacgctggagggggactttgtgctcatgttggcatctcgcgcagccacctaggcgcctgacctggtggcaagaatccgcatgcagcgcattcgaccgacgtgcctggtgcaccatgtgcatagggatgcagtacgccggaaccatcgcggtgacatgcgactgcatgacgccatattacatttggcccatggaagcgtgggaaaaaccacttcaggccatggggcatgtccggcaacactggcctacagccagaagccgcccgatgcacactcccgccatagaagccggcgtcaacaaccatcgcgaggcagtagcatccacagaatgacacacgcgtgcagcaggtgcgacgcaatgcgccgactacaggccacacgaatgacaccatgagacatcgggaacacagaacccctgggccataccctgagctgcccggatgcggagaagcccctgaacaggaaaaacaagccaaggcaaacccagcacgggagagcagggcggacaacatataccagactggaagacagaagccctagagactaaggcgggtgtggaccatgcgcagcaacagcttgcagagagaagcgagaccaggcccccgcactcaggaacagacgccgaaatccaagggaacccagaacagcagatcgacgcacaggcaaggaggcagcacaatggcacaagagaacaagaggccgcgacgaggaggcagacactgaagaagaccacgcgacagacagagagccggacacgggcacggaacgccgtacgcagccacagccctaccaagcaggatacgtgagggcaacgaaaacagacacccaagcagacgaaacacggcaggaagcgaaagcccgacgagaacgacacaaagcaccagcgacacagacacac

SEQ ID NO: 524414 - DNA, 437 bp, Homo sapiens
agcaaaacactgtaagatgtaaactttgcctctatgccccgtctgtctgtctgtctctctctttcctctctctctctctgtctcctctctcgctgtgtacatgaaagagactggctggctgggtgtggggtcgcacgccctgtaatccccagcacttcgggaggccgaagcgggcagatcacgaggtcaggagtttgagaccagccctggccaacatggtgaaaccttgtctcttctaaaaacacaagaattagctgggcatggtgacgcgctcctgtaatcccagctacttgggagactgaggcaggagaattgcttgaacccaggaggtggagtttgcagtgagacaggattgtggcactggattccagcctgggcgacagagcaagactctgtctcaaaaaaggctgactaaatattgattatcaattctgtaa

SEQ ID NO: 524415 - DNA, 352 bp, Homo sapiens
agggcaggtgccggcagctaggtgatggcaagagatgttcacttgaagaacttgccctgattgaagggtttgcccacatgctggaagggccccttccaagaaaagtacttttgaaccaccgtctggggcttctcgctggcaggaaccaattttcgccctgggtatgaatcgtagtccacctgcccatttggactcaacggaaagggaagcttctggcctttgaagaacccaactcccaaaatggggctgcttttggtgggttcaaaaaggatgacactggggaagggattttttctcaacttggccaagcgctggaacatttcaatgatgaaaatgccgctcatgaaaggct

SEQ ID NO: 524416 - DNA, 655 bp, Homo sapiens
tttaagtgctttccttgagtgacagcttcactcaatttcttgcgttttcttcattcatgtctcttcgtccaggatgtgctctttgtcctccaggccattaggtatcccaggttgtgggattctagtcggctggatctctgctctgctggtgccgaagggcaacacagcagtatccgtgctcatagctgctggtcgcccatgctcttcactggcattgctgtgctaggaattgtcatgctgagcacggatccactccgttataccgccagcacaggtgccagctttcagaaggcccagctaagaatttcggctgctggatgtcttgctccaaaccctgcaggtcgcgaacacgcagctgccaatcgcagccagctggggctgctgaatatgccgtatccgggccccgtgacgcatgactaggatgccctggccctgctacttcgagggagctgatcttagctccaagtccctgaaggtctcctgggacttggagacatcatcacttaagctgatggctcctccgtagtgctcccatatcctatcgcatgactgctgaacctgaccaggcgtgtggggagatcacctgtgacgtagtccctcatacaggccacactgctgccacctctaaataccccagcgagcttccactcgttgc

SEQ ID NO: 524417 - DNA, 850 bp, Homo sapiens
  misc_feature (850)..(850): n is a, c, g, or t
tctagacacattgttaaaactgcatatttaggatctgatctcattcttcgtccttttatcttaagtcatgtctcttgcgtgagagccgatggtctctcgacgagcttggtggcacacatactgtgttagaatctccgtttgtagactttcagtggaacgagtggtcctaggagtcgacagtaatttcgcgacgaaatctgcaccgtccgattgtttacaatgccaaaacctctagagtacgctcccccattttgcaaagattgaaagatttagctcgtcctaaatgctgatttcatacctatctttccatgaagttgataaagagcaacggtggtcaggtaatttacagaattttcccatgttcctacgaatgaacttgtccttctatgctaggtacgcaccccttttatcccatttagtatccaataccatacgaatatagtaacacgaatccaggtatatagatgccggtatcggacatattaacgaggttaagaccgggaacccgagttgggtgcgaccgaaacgagaatcgcacgaagggtttgaaagaccttccataatagtatacgattttctggttcctactgcggaattatttttcgcatcttcaattatctgggggaatggtgtggcttttaacacacactaaagcaattgaatatggcaatcagatgtcaggcaaagtctactggagagaatgtcattttggcctggattatttggagttgctcttaggcttctgtgatagttactggtgatgatagggttataaaattaactggtagattattattaaactggttggatgttgaagagccaaaagataggataagctggcgtatataan

SEQ ID NO: 524418 - DNA, 402 bp, Homo sapiens
  misc_feature (87)..(87): n is a, c, g, or t
  misc_feature (155)..(155): n is a, c, g, or t
  misc_feature (157)..(157): n is a, c, g, or t
  misc_feature (164)..(166): n is a, c, g, or t
  misc_feature (260)..(260): n is a, c, g, or t
  misc_feature (322)..(322): n is a, c, g, or t
  misc_feature (376)..(376): n is a, c, g, or t
gcacgagtatccggtcaggttgtcttctgggctgtgtggacctaattgactgcttgtcccagaagcaatttaaggagcagtttccanacatcatcaagaatctgattctccatttgttttcatctgcaaaaatcctcaggaaatggttgtgaagntncctattnnnggaaatccaaaaatctggaaattggattccaagatccatcaaggagcaaagaaggggttaatgaagcagaataaagctgtctgacccaggaganaaggaactatacagcatagtgggagtttttgtggtacttaaaatttgctatcctacttggtnccttttgggaattgaaagttagttaggaaaccttaaaggctttgggcggttcanggctttgaaatattctccagaaactt

SEQ ID NO: 524419 - DNA, 138 bp, Homo sapiens
atgtactatttgaggatccatttcaggcaggtacgagggacggatatgaggaagacgaggaggattggctgtgcagcccgtgaggggcacccctctgtcctaccccagccctggcgtgagatcgtccctggctgagat

SEQ ID NO: 524420 - DNA, 1603 bp, Homo sapiens
  misc_feature (842)..(842): n is a, c, g, or t
tcttgtgttgtcttctctgactgcctggttgtttggtctcatcgttgattgttctgttcgtgcctgctttggttggttttttgttggcggacgacgcgctttgtctgcgacctattttgtggtgtgattccttccctcgccggtggttgatcgttctcttgttgtgcggtaattctctcctgcttgttgtccgttgatcgactcggtgtcttgtgctgacgagggtgggagcacatactatctctgctggtggtgaccaagttccttccgttttgttggggacatcaagcttttgtgtgaactaccggtcctgtcccggtagggtgtggcctcttgtgaccccccgcccctcccagatggggtgtgccccggttcctgttgtgttacattttgcccgcggcgctgtttcagccctcgggggggtatcctcttctccttccggccgggaggactttttttctcgggccacttctaccgcccctgctctgccggggggtgactatttaatcccctgtgtctgccgtttggttgtccgccacccgcttctttagagacgttggaacccgggttgtgttcgtgtcccgcccaagttagggtaaacattccgtgggcgtaccccccccgtggtggggaccatcagcgtgtgtgtgcgaaaacgacaggttctgtgttggtgatgggttgtccttggccccgtgttgggcgcaacgccgtgtcgagagtcttagatcccaagggtgggcccccctctcccagggatggccccgcgacccggcgcccccctccgcggtaccccctctgggaggcgccccggacgggcgtagccctctccagattctcgncgctcccgtgtgtgtaccacgaggaattgtgtcccgaaggggaaaaaggttggaaacccacacgccctttcgggcccctctctgggaaagccccttgcgccctctctgcggatttccacgcatcggaactctcccccctcgtgtgtggttgaattttctgagccgcagagattctttccctcgtaaaaaaagggccgcactctttaagctcttcgcggcttttctctgaaggggtatacccctcgtggggaccacaccccccttgggaaggcccaccactctgttctcgggggtttgttcgttccactcgccgtggtccccgcgagaggggccacagaattttcggctcccgcgccccaaggggttcttcgccctggcgcattcgggccttgggcccggcctctggggtctccgcccctggccccggaaggccctatgagaagcctggtgctgcgcccccgccccgcccgggcccccgggataggaagccacagtgcggccccccacccatgtgccctgaggccccggaacccgttctcgccacacccggcctgtcccccaggtccaggcccgttttagaagagccttttacacttgggccgcccccccgtcttcttggcgcgccgacacacacctggaaagccatagtacatactttatgtgctgtgttttttatttttggaaacctttgattttttccacgtaagtcccaccaaattacttttataagagccgtgaccttgtaataaagggtttaatga

SEQ ID NO: 524421 - DNA, 260 bp, Homo sapiens
  misc_feature (195)..(195): n is a, c, g, or t
gcatttgatgatgaggcaccctattactgcagacttcttcagaaatgaaataattccaggtaggtacaggttatgatcggaggatttttaaaatctagactagtttgtgtgtttttaagataattctgtataaggtcctcttaaatacatggaatcctctgttttaacttggcattaaaacatcacttaatagtntgtctaaagtatagcaatgactctacaaaatttgcaaagaaattaaggaaacacagagcaaaact

SEQ ID NO: 524422 - DNA, 912 bp, Homo sapiens
  misc_feature (43)..(43): n is a, c, g, or t
  misc_feature (72)..(75): n is a, c, g, or t
  misc_feature (77)..(77): n is a, c, g, or t
  misc_feature (81)..(81): n is a, c, g, or t
  misc_feature (112)..(112): n is a, c, g, or t
  misc_feature (118)..(119): n is a, c, g, or t
  misc_feature (122)..(122): n is a, c, g, or t
  misc_feature (132)..(132): n is a, c, g, or t
  misc_feature (148)..(149): n is a, c, g, or t
  misc_feature (156)..(156): n is a, c, g, or t
  misc_feature (201)..(201): n is a, c, g, or t
  misc_feature (239)..(239): n is a, c, g, or t
  misc_feature (277)..(277): n is a, c, g, or t
  misc_feature (294)..(294): n is a, c, g, or t
  misc_feature (298)..(298): n is a, c, g, or t
  misc_feature (304)..(304): n is a, c, g, or t
  misc_feature (311)..(311): n is a, c, g, or t
  misc_feature (327)..(327): n is a, c, g, or t
  misc_feature (333)..(333): n is a, c, g, or t
  misc_feature (538)..(538): n is a, c, g, or t
  misc_feature (659)..(659): n is a, c, g, or t
  misc_feature (736)..(736): n is a, c, g, or t
  misc_feature (738)..(738): n is a, c, g, or t
  misc_feature (740)..(740): n is a, c, g, or t
  misc_feature (743)..(744): n is a, c, g, or t
  misc_feature (779)..(780): n is a, c, g, or t
  misc_feature (789)..(789): n is a, c, g, or t
  misc_feature (792)..(792): n is a, c, g, or t
  misc_feature (794)..(794): n is a, c, g, or t
  misc_feature (832)..(832): n is a, c, g, or t
  misc_feature (838)..(838): n is a, c, g, or t
  misc_feature (849)..(849): n is a, c, g, or t
  misc_feature (886)..(886): n is a, c, g, or t
gtctcaaaatttaaagatcaatttcccgcagaaggtgtgcaangcatcataaaatggccctattttgaggannnnanaagnagggttgggcaggatggaatattaaattgtnccatgnnaancatgccagantgttatccaatctagnnaatttanatacattttgttggcataggaaaacgaaagcaatcatttgtgacnagcctataaagcttggcatatttacacatacttagganctttttttgtgcggtgggaattctctaattgtatcatntgggccttttgaaagtnacanacaganggccagnctgtggcaagtctgcngctgancatcacattccaccctaagaaaacacaaggtggattgcatcgaggggggataccttaccttagcacagaaggaaaaagtatgtcagtgcaaagtatggactaaactgctttcaggaaaaaagttgtaaaaattgatacaggttggaaaagggaattttccttcccggcttggagtcctcccaatttaaggcagaacccatccacnccaatttctgcagtttaaaacttctctctacttatttagttttctcctctgagttcaaccgctgctggattcgtttggcataactttgtgccatggagttaatgatagataggatgaagtnacacaccatgacaacgaccaacttttcaaacatccaggacaaccagttttctccctgtagaaataaatgcagaacantncnatnnaaaaggcttcattagttcagtagtaaaaagaggannatctataangcntnaagtgtgtacttacaaaacctaaagaattaaaaatganaagtangcaacccaacnactctgaaatctccattactctcctttttacacccanctatcaagatttcactttgttggatg

SEQ ID NO: 524423 - DNA, 394 bp, Homo sapiens
  misc_feature (28)..(28): n is a, c, g, or t
  misc_feature (30)..(30): n is a, c, g, or t
  misc_feature (65)..(65): n is a, c, g, or t
  misc_feature (68)..(68): n is a, c, g, or t
  misc_feature (81)..(81): n is a, c, g, or t
  misc_feature (88)..(88): n is a, c, g, or t
  misc_feature (95)..(95): n is a, c, g, or t
  misc_feature (162)..(162): n is a, c, g, or t
gcttgttggcagccaccagcacagctgnangccaggacatcaagcagattggctggctaactgancanctgcccagtgggnacaaccncatgggnccctgctaactgaaaaggaactgctcctctacttgtctctccccgagacccgcgagccctgagccgnccagcccgtactgccccactcatcgccaccagactggtgcactcaggcccctccaagggctcagtgcctacgatgcagagtctcttttgccctgcgcacgggcacgcgtcacggtgtggacactcacctgttcagcgtggagtcaccgcagaggctggctgcctgggacccgccagcttgttgaatgctgtcaacggggccgcgaaggttttgaagaagtttttaaaagcct

SEQ ID NO: 524424 - DNA, 1047 bp, Homo sapiens
  misc_feature (654)..(654): n is a, c, g, or t
cattcaggtcatgtgtgatgagccctcatgagatgagtggacgactcatgtgagaggtgccatgatggaagctgtgagctacacggttgagttctgcccaataaggacagcactgaatgtgaaggttcacaggctggggtagcatacctagacgttgcctgtaacgtcgttacagggtgggtgcgtaggctaaactgcgggtatgggtcgggtcgcccttgcctggtgagagcgttcgatagctcctcgaatatagtgtgtcggactccgtccccgagcatagcatcaagttactctaatggtacattgtggaatcgtccgatgacaatacagcatacgcggtgctcccacgtagaggtactctcacatcagagcacaaaagagtgtacggcgtactctagcattactttgctacgaagggtggccaagtattaggggcgtacgccagtcattaagttgatgggcacgtgggctgccgtttatatgagtgcgctatgatagggcaaggacagtgtaccgttgggtatcatagcgaaagggaacctgtgaaatactggtgcgtagtgagcgtaatctgggcgaaaggaacctatagattatgtgggaagtgactaatggctaggtacaaagcatactacagcagactaaagaggntctaaggttcactgacttaatgcattgccagctgcaatagctgtggccacacctgacactgctgtattgactgggaccgatattgaaacacctctgcgactcacggcggaatatgcatctaatgacaacactatcatagcaccgggacgctaacatcgacaaaaacaacagcacaaccacaaccgcgacagccacacaacacacccacccagacgaccaccacgaggaaaccacacgagagagacacaccacaccaaccaacaaaccagccgacccaaacatccaacaaacacaacacaacacacgaagcacacacaccaccaatgaaaactaaaacaacacgaacaccacgccgacaccacagcacacagaaccaaccccaaacacacacac

SEQ ID NO: 524425 - DNA, 161 bp, Homo sapiens
cggtacctttttttttcggagtagtacgttacaactatgggagattattccgaagcctggtaggataagaatataaacttcagtgctgaccgacaaaatcacgaatagtgtgttgtgtactagaactggggtctccaccctccttacatgataaacggcgt

SEQ ID NO: 524426 - DNA, 208 bp, Homo sapiens
gaatatgagttgtcatataatagtagtatcactgtacgaaattcttaattacgagaattaccaattgagaaatagaatgcagctcattatgcaaagagacggcgacattaacggcgtcttgaatagtctcctcggcgtaattactcttggccgagttgtagtggatcaatgaccaacaatttattgatcaatgaccaacaatttattg

SEQ ID NO: 524427 - DNA, 446 bp, Homo sapiens
accattggcatacttagtgttcacaatccatagtaaacagaagaaagagaacagaactaggaattaaagctgggtttgaaaattagatataacatatactacctggtgtctttggttaagtcagtgacctatctgagcctttttttcctcatctgtacagtgggaatactactacctacttcatatcacaaagattacatttaattaattaatttttttagacagggtctgttctgttacccaggctggagtgcagtggcataatcaaggctcactgcaacctctgcctcctgggttcaagcagttctcatgcctcagcctccctcccgagtgactgggactacaggcgtgtgccaccacatccggctaattttggtattttaagtagagacggggttttgctgtgttagccaggatggtctccatctcctgatctggtgagctgc

SEQ ID NO: 524428 - DNA, 134 bp, Homo sapiens
gatcctctggtcatagatgctcacagctccacataccattattcatcgagtacttttactccgaaaagatcaatgaccagcaatttattgatcaatgaccaacaatttattgatcaatgaccaacaatttattg

SEQ ID NO: 524429 - DNA, 1561 bp, Homo sapiens
cagttacactaagtaagtggagggaatgaaagtgtttcgaggtgcaatgtggcatcatacatttccctcttctgcattatttattcttcatttggttcctcaacagcaacactgggcaagcagcatagacattcatctcatcactttcttttttcttgtgagcagaaccgtttaaaacaattacacagcatcatcatttcaacaacagtcaacccagcatcaaaagtcagcaccatgtgcatttggttcaaacaatcacacaagttcaaaacagttaaacagttacaccacaatgcacagttcacaacagtttccatccagcacaactttcaccatcatcttttagaccaaatcatcatattgcataatgtggtcatgcgccattcatcacatcggcacaacatcaattcttgtgcagccaaccagcaagctcattatatcaactcacgtagcaaagcgtcaaagccgcagcattcacaaaacatgccctcattcagagtgttttcacaaacatgcggcgtctttgcagcaaaaaaaagacacaggcaacaccacagcaagaatttcaatttcaaaacatccaaaccgaaaacaaaacatcgaggtcatcccttggtgtactctgcatcagcaaccaacagcaagatttcaccttcaaaatcattaattagggattccctcggtaaaacttaaggcacgttccttcctccgcactaattgttcaccctcacatctttaaattacagtacaacgtatccaacgaggcttctaaacagtttcacggcttcgcagcgggcaacatggcaaaacaacacaaccaacacactaattcaacgcttggataatttacccttaacaagaagagtatcgccttttacaagttaaagagccagagtacctttaaggatctcaaccaacgaaacatcacaccaaggagcacgtacacagaacagtatgaccacgggattgcccgctggcgagggagcaaacagggacagtcccaacaagcgtgacgaacgacaaaggttagacacactaaagttgaggagaaccacgaagaataaggcaaacacggaaaatagcagcagcaaagccaaaacaacggagtcggcaccaaacatagcaggaaaaaccccatgacaatgggcgacaagcgacaggagcaaaagacaagtacgaccaaacaacatacgagatgaacacgaagagactaatagaagcagacgaagaagctcgcaccgagacagtatcgagacaccaagaggtaatgacagacagctactgcagcaccgtgagcacgacgtccacgcattagcgcacacggaacaacagtctcacactgtggaggagcaaacaaactgacaggagctggaccacgaccacacgaactgccaatacacaccaagagggaatacgacacaacgtggaaagagcagaaaaaacaacgagaaacaacgacgggacagaacaacacaggggcgagcaagacgaaaacaaatgaatagatccgtgaacgcaatgaaagacacacacacagagcgaagatcgggtcacaacgaga

SEQ ID NO: 524430 - DNA, 609 bp, Homo sapiens
tcaaaaaaaagaaaaaagaagagttttgtttttgccaaactttatatcagcttaagattcttgatataaataggatttcttttttgagacgaagtctcgcactgttgcttgggctggagtgcaggggcacgatcttggatcactgcaacctccgcctcccgggttcaagcaattctgcctcagcctcccaagtagctgagattacaggcgcccgccactacgcccagctaattttttgtatttttagtagcgacgggatttcaccatgttgaccaggctggcctcgagctcctgacctcgcgattcgcccacctcggcctcccaaagtactgggattgcaggcgtgagccaccatgcccagctgtaaataggatattttaagcagaccacctctggttgccttgcaccgtgcatcatgcctggaatcgtaccactttgcgatgccacggccggctcatcactttccttcacgcccttcctaccactgtatctcatttgtcactcccttacttcattctcagtaccaccctgtgttccactgccctttctctcttccttcttcctctttactgccataccttacttctaccctatctctctcttcacccg

SEQ ID NO: 524431 - DNA, 166 bp, Homo sapiens
gtgaaggtgtaaaagcagcacaagtccaataagagatatttcctcaaatttgcctcaagatggaaaccctctgtctcagggcatcctcttagctggcactcggttcggatgtgtaatcagtgatattcctgcagagctacagctcactctagcatcatgtggatga

SEQ ID NO: 524432 - DNA, 250 bp, Homo sapiens
cattagtatgtacatagcatcagatcaagagtcaactgttagagatcttccgtgcctgtcgtaataaaaatcggatcccccggtatactctgtctccgtcaaccggcttcatgtacctcagtggccttgccgctatggtgtatttcattcatatgtatatttcttctattgcctgttgctttcactggcaatgcagtccccacaagggcgggcatatcggtctgtgttcttccctggaatatctagggta

SEQ ID NO: 524433 - DNA, 1363 bp, Homo sapiens
  misc_feature (340)..(340): n is a, c, g, or t
  misc_feature (618)..(618): n is a, c, g, or t
ggcttctttgctacacaaccccatcagtgggctggtaactgacccactgaacccactcacatgctcatcttgggtgacgatgcacgacaactctactcaatagtcgcgaagactctcctagatgcttgcctcttgccaggagtattagctgttgacatgggatagcagatcgaacctgtagccattgtgacccatgctcctcacaaggatgcatgggccgaataatagcgcgacaaagcagacattcagagacatgactcgactaattgtgaccaatatgatgggaagacgcctttcccgtaggacctctcatctgcaatggaatgcacagaccggcaantaactagatcgagacaataggtacatgtgtccaaatagtaccgttggttggcggcctagtcggctctgaagacaaattgccacatataccgaaagaatctcttccaatctcgtaggcgtacaacctcgagaccggagcaatccacatctagtccatggttctctgtggcttgtaacagctcaaaatcattcacaatgtagttgtgtgtcacctctgggggacacggtagttctctactatcgtcaaaaatctgagagccggcaggcgcaggagtgacntgtctgagagtcacgtaacctgtgactttgctctgatgtgtgtgcatcctctcgctcgtggcagacgcggactgaactgaatgactgaagcgcctattacattgagacttcccatgtttgtcggaccaatgtgacggtcggttctgttggacaagacgtcttgtgacactttgcgcggagaaattaggctaattgttacacaacggccgattatgtgtcggttggaacagtttggcccgtttgcgggctaggaaatctgaagaccttcctaattccaggaatggcctttgcccctaaaggaggagccttccgcgttctgggataaccataccctttgacttgttcgccatttcgaacacgcaataggccataagtgggacctggtaggccctcggtgtaaggcccgttgctttgggcctaaaaggttccccaaacccgggcataggaatttgtttccccccaaggaacatttgttttggcaccccttaaatttaaaaaaacggcaattgacttccaatttgttaccccggtttatatggagaggggggctaacggtcgccccccgaaggcgccccaagaaagatttttcggccacagattggccattggtgcacaaagagtatccccagagaacacacaaacggaaaacgcctttcacttcagcaacgggggaaaccccttttttgaataaaaggccgttttgtaccaggacgaaccacaattgggggtatttccttctccccag

SEQ ID NO: 524434 - DNA, 170 bp, Homo sapiens
aaaaaatttaaagggggaaaaaaaaagaaacttattaactgccctggaaaggtagaaaaccttaccatgaatgcctgcctgtggaagggattttactgcttaactgacgtccattccttaagctgaaacacaaaaaattgcccgtggcactggttggacttttgggtacc

SEQ ID NO: 524435 - DNA, 959 bp, Homo sapiens
gtatttgtcagaagtaggggtctacgacgggcattgtgatccgtccccaggcagcggattaggaggccagaaggagatcccttccacggtgtctaggctgagatggatcctctcagggccccaacagctggctgcggagctggaggtggagatgatggccgatgatgtacaacagaatgaccagtgcctgccacacggaagtgtgtgcctcctcactacaaggaagcagagctctccaagggacgagtctgtgtgcctggacccgatgtgtctctaagtacctggacatccatgagcggatgggctaacaagttgacagagttgtctatgctaggatgacgagctgatgaagagggtgccaggcatgagactctgggccattgctatgaggtccctgtcagtataccaccctggggtgtaccccaacccttcccactttaatatacgtgctccctgttgggtgtccttcggtgaccgagacgctgtctcccacatggggcggccctcgcgtttaaaccgggttggtcgccagaacaccggtgtcgtggaaatactagaccctgaaaggtctcactgacgggcaaggcaacggactctttgcgaggtggtcgtcatgtggccgctatatgcgcgaattcatcacttcttggcttctggtcttaaaagcggtggactccaataaggacgctggaaacactttgaaagggggtgctgacatggaaagggcccctaagtatgggctggttaggataatgaagctgcgtggtaggggtttgcatgatttcctgtgattgaccgggtttattggcgtgtggcccggaccagtttgaagtgtagataggacgtggtcaattgagagtggattgacgtttaaacggaagtgacttggtagggaaagggtaagaatgcatagaatatggtatagccatttgtgggagagtggagtacacgggtgagcg

SEQ ID NO: 524436 - DNA, 584 bp, Homo sapiens
  misc_feature (235)..(235): n is a, c, g, or t
  misc_feature (240)..(241): n is a, c, g, or t
  misc_feature (255)..(255): n is a, c, g, or t
  misc_feature (259)..(259): n is a, c, g, or t
  misc_feature (263)..(263): n is a, c, g, or t
  misc_feature (269)..(270): n is a, c, g, or t
  misc_feature (279)..(279): n is a, c, g, or t
  misc_feature (296)..(297): n is a, c, g, or t
  misc_feature (309)..(309): n is a, c, g, or t
  misc_feature (311)..(311): n is a, c, g, or t
  misc_feature (316)..(316): n is a, c, g, or t
  misc_feature (324)..(324): n is a, c, g, or t
  misc_feature (326)..(326): n is a, c, g, or t
  misc_feature (339)..(340): n is a, c, g, or t
  misc_feature (571)..(571): n is a, c, g, or t
  misc_feature (580)..(580): n is a, c, g, or t
agcatacgccagcagcgagtgtccgctcactggcctacatgcggcactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccancctgnncctttcctccttcncctntganacctcnntgcaacccntgagccatcaggacaanncataccccttcncnttctntccacccnanttgtgccagtaanntggggtgttgagggtgggcctaggcaagcattagaatgcacttgatttatttcgtttcctcacactgttaccctgacgtgccgtgagaatgttcgaggagagtgtcacgttgactttcccgcatggtaacattacatggtgatgaacagactccactggggtacaaagttagaatgagcccagagtggaccgaaagaaaagaaataaaaaaaagaaaagaccgtatgcggnccgcaagcnttat

SEQ ID NO: 524437 - DNA, 714 bp, Homo sapiens
cggatttcttttggcccaacattaataagaagcttatagaaccaggcccatccctccttttagtgatcttgagggtcaacaccagtccctccctggggtatccctttattctctgaactctctcacaagcatttgatcagagctcattttgctgtaatgtcatcaaatgcaatgttttattttttcatccaaaataagtacattcatccctttaccatgagacctttaccacacccccattctcatgcctataacacttaagctccgtaaagttggttctcttagccatctacatggttctaaacagcagcaaaaacatctttatgtctaagataaaacaactatttggccaatatttgtgccctctggacattagtaggctttggtaaatgtgagaaaacttttgtagtattattatataatcaattttgtcatgctttcttaaatgtgttataggtgaattcccacacaaagctacaagctatgtaattttgccctacttaaaagattaacatatcagtgttctaagtagtgataatggatcctgttacaggttaacataatgtgtatatatctgtttgaaatatagtttatagtattttcaaatgtgctgctctattttgacatctaatatctgaatgcttctgaagccagcagtttgttttcatagacttcgattcctaaactttaaacaacttttaataaaatattttc

SEQ ID NO: 524438 - DNA, 144 bp, Homo sapiens
agtgctccagctataccgagtatttggacggtcagcacggtgctcacgtgtcgacggaacttgtacatgggacgtgcatgcacctgcagtggtgaatacacgtacgaccatggctccagtcttaaccgatattttggatggtca

SEQ ID NO: 524439 - DNA, 364 bp, Homo sapiens
gcgcgtacggacgctctgcccaccgtcaagccaccggaaagtgtcgttgccgacgctggctacggatctcaccactgatcacagccgcctactcacggataatgctgtctgtcaccaccgctggtgctgatattgccgccgatgctgccagcggaaatgatgatggtgtcagtatcaaaaccggtgaccaggttgcccaggatggcgcctccggacatgtcatagatgttctcggccagcttcatattcactcggccaatggtgccaccgctctggtaggccacatcgccgtcctcagaggcatcgacgaaggtgcctccctccatcctgaaggtgtcgtgcccatcgccctggaacagcgcct

SEQ ID NO: 524440 - DNA, 324 bp, Homo sapiens
tgcctgtaattccagaacctgggaggtggaggttgcagtaagccaagattgtgctactgcactctagcctgggcgacagagcaagactctatataaaaaataaaataaagcatgagtttatgggtgtgtgaccacataggtgtgtatgtgagtgtgtattgtgtgctcttgagcctgtgtttagatgttggcgtggctggtggcatcactgaatggctgtgctacaggggtcttagtacacagtgagcgtgtgtatgaccgctggtatctggccatgtgttggtcgagatgctacagcctcagctgagtgtctgcgtgaatgtg

SEQ ID NO: 524441 - DNA, 919 bp, Homo sapiens
acagtgtgagtggcttttggaacacccgctcgagtatacttgggctgctcttgcacaagggctgcctggggcaatgtccccggggacccacagtccctccagtcggggagggctgccatttcacaggtggtgctccacaaagtacctggtcccccgttgtgtcccacagggtcctcccgccagtctgtggccgaaagtgtttctaataggcagggcccccgtgggcggcccctcattagtctggcgggtgaccgaccatcgtcccccgctcgtttggaatgtggaacaaccttggtgtttacggacgcgcccaatattcggggcgtgtcggggtccgcccctcctcaatggcccgggggacaacacgccccccctgcaggggcctccacgcgcctcgaccatctttctcatcaggcaagctcgccgctagagcatgcttccgccctcataagttcctgggggtcggcgggaagaccagagttgaacctccaagcgcgccttcgcgcaaaggcgtcacattctcgactgcagccgcgaggcccacgaaccgcccctgcgcccaggaagccacagaccccgctcgagcgatcgtcatgtctgggtgccttgcccaacgcaggcctggcgcttctaagtgtcttgtatacccggctcacgcggtcatacgcgcgtggttgttcaccaacgcgtcccgcccgacccagcacggggattcgcccctctcgcccattcctataacggaagggccctcccctccctccggggaggttcaccaattcggcttggcccacgggcgttctttttgcacctcggaaacgaagttggtgttggtatcggactctttttggaaacacccaacataccccctattcaagggcccgccccaataaaaacacattttaagcgggcgaacataaca

SEQ ID NO: 524442 - DNA, 676 bp, Homo sapiens
  misc_feature (557)..(557): n is a, c, g, or t
  misc_feature (565)..(565): n is a, c, g, or t
  misc_feature (591)..(591): n is a, c, g, or t
  misc_feature (607)..(607): n is a, c, g, or t
  misc_feature (627)..(627): n is a, c, g, or t
  misc_feature (648)..(648): n is a, c, g, or t
tggaaagcttggcacgaccctcttgagccttcagtttaaaatgaaacgctggcgccagatgtggccaccacattgctgataagtccagtaccttccgtttgtgcaaagctttgtgatttaaggttaagtagttttgcttacttctctcatttgagccttataaagacagtgtgaagtctgtagtgagtaaaagccctattttaacagaaaaggaaccaagggaccaagttggaacttgaatctggggtctactgatgttccattcactacactgcttggtataactgcatatcaggttatttggattttattttatttttttctttttcagcctttattcagtaactactaccagattaggtaataggcacatagagacatgagacatacattccctaccttgctatgctgttcaacatagtagcacgtggtaatttaaatttaatgaaaagtcaataaaatttaaaattaactttctcagtacaactaggccatattttaaagtgcttcaggaggccattatgtgcctagtgggctgctgtattggggcaggggcngaagttcntacccggggcagcactgtgttctacnggcttaacattcttantgagggtttaaggacagtcntcacttctttttctgtccccntttggctacttccctggcagtttcattc

SEQ ID NO: 524443 - DNA, 185 bp, Homo sapiens
tggagctccaacgcccaacagagtaccttcggagactaggtgtttttcagaagtacctaaggccacaagtgtcccttccaacacaactggtgctaagtagagacctggatacagacacgttatctcacacgagtggccacctgagaacactgcaagatggccaactgacaacctaggaggtggcc

SEQ ID NO: 524444 - DNA, 159 bp, Homo sapiens
  misc_feature (113)..(113): n is a, c, g, or t
  misc_feature (154)..(154): n is a, c, g, or t
ctctgttttccaaacgcccatgtgtgctatactacaactcttctcgagtctgatcaatttgcagtagaccattttagttcttacgacgttaataacaaacacttcaacatcantgctccaatctgaagttcttgttgcattgttaaaagaaatntctaa

SEQ ID NO: 524445 - DNA, 167 bp, Homo sapiens
agagcaaggctgactggactccaacatcttttgtactctttcatgcttatatagaatctgagtgtcatgctgcagagtgtgcagccaatagatttataccctttcccagaaagctggaatcatttaccaaatacagcccagcccggaaattgacagaactagattcc

SEQ ID NO: 524446 - DNA, 153 bp, Homo sapiens
gaatattgccaccattctggaagcaaagtgtgcactgagatatatgattggagagctggtctactccaaaatacaggtcagcaaacttgaaagcagcctgaaacagagcaagaccagctgtctacattcagagatactgtttaaggaacaaat

SEQ ID NO: 524447 - DNA, 843 bp, Homo sapiens
tctggcccacacaggggttcacagccccagcactttcgggaggccaaggctgtggtgttgggaggattcgccgtgagctcaggagtttcaagaccagccgtgggttcattagcaagacccttgtcccttaaattaaaaagatacattcagtggccgggttgcggtggctcacgcccggaattcccagcatttgggaaggctgaggcgggtggatccccctgaggtggggagttcgagaacagccttgaaccagtgtggagaaaccccccattctctacgaaaatatacaaatttacccgggcgtggtggtgcattgcctgtaattcccagctactcaggaggctgaggcaggaaaatcgtttgacccaggaggtggcaggttgcggtgagcccgaatcgcgcattgcactccagcctgggcagcaaggagcaaattcccttctcatacataattacttacttatttacacaccaactgatgttgggccgtgtaaccccttggcgtatagtccccagcttatcaggaggtgaagaaggacgctccagtggatccagaaaccggaaggctgcagtgaagctatacggtacactgtacacctggggcgaagggcagaccctgcctccaaagaataaggcgaatttctgccccgggccccgaacagtgtgcctgtcatgagccctgcctatggggggaccgtcccgaggaacgctgttgataacccgtggcagcccacgtgtctctcacaggggacacacttgtccaatatagcagcacccctttttcagggggggttcacacatctacaaccacgcgcgcgcttagggggagacacggatagcagc

SEQ ID NO: 524448 - DNA, 503 bp, Homo sapiens
caccacgcccagctaattttttgtatttttagtggagacggggtttcaccgtgttagccaggatggtctcgatctcctgacctcgtgatctgcccgcctcggctcccgaagtggtgggattacaggtgtgagccaccatgcctggcctaacatgatttttatactggattttttaagattatgtgttctagctgggtgtggtggctcatacctgtaatcccagcactgggaggccaaggcgggtggatcatctgaggtcaggagttcgtgaccagtctggccgaattgtgagacccgtctctactaaaaatacactacacattacgccacagcatgatggcaggcgctgtaactcccagctactcgggaggctgagcacaggagaatcgcttgaccctggaagcgtggaggtagcagtgcgctgagacttgggcattgcactccagcctgggcaccaagagcatcaatccatgccaacaaccaacagcaacacgaaaaaaatc

SEQ ID NO: 524449 - DNA, 107 bp, Homo sapiens
  misc_feature (107)..(107): n is a, c, g, or t
gggttttcaattctgttttgagtgtctagtgtttgctcagatttcctcctttgtatctcttgaatattgatgtgggggaggcaactcttgggcccccctaagaaggn

SEQ ID NO: 524450 - DNA, 258 bp, Homo sapiens
cccctgcgagctcttgctttttttgttgttgttttttgtttttgttcttttgcttaagatttaaacaaaaaattaacttttaggttcaggggtacgtatgcagttttgtttttgttgtacagatttttgtcacacaggttctaagcctagtacccaatagttatttttcctgatcctcttcctcctctcaccctccgccctccactaggccccagtgtctgttgttcccctctttgtgtccgtgtgttctcatcattt

SEQ ID NO: 524451 - DNA, 333 bp, Homo sapiens
  misc_feature (43)..(43): n is a, c, g, or t
  misc_feature (54)..(54): n is a, c, g, or t
  misc_feature (107)..(107): n is a, c, g, or t
  misc_feature (114)..(114): n is a, c, g, or t
  misc_feature (246)..(246): n is a, c, g, or t
  misc_feature (295)..(295): n is a, c, g, or t
aacttctagagagggtcctacggcgccctgtcctcctcctccnccctctgggcntgggaacaaaggatgacgatgttcctttgatgtggcgtatgaagcagcatgtnagctgtnggaggaaggagttctgaatcctgagacgacagtggtggccatcttcccatctcccatgatgtatgctggaccaactgaggtccagtggcattgcagagacggatggttgcagggagccaacttttacattgntggacgagaccctgctggcaagcctcatccagaaacagggaaggatctntatgagccaagtcatggtgccaaagtgctgacgatagc

SEQ ID NO: 524452 - DNA, 645 bp, Homo sapiens
ggaaacagctatacaggaatagctatacctaggataccgctattacaggagtccgtatgaccgggagaccgctattatctgctgcacacgctataacgcgcatactgctctcaccgagaaaccattctaaccccaagacaaggtccttgactggaagaaattgttgctgcacacgccgatttcccataccaagagggattctctggagcctgaatagctcgtgaagtttgccttgatggggtaacggacttgcttgggccccagcaccctttcccagttgcctcttatctctcttttggaacgggagcgtctgtccagtgcctgcgatactgtagtatttagggaacatgtaacttgttagagttccgtggtttacggctggaggggagctcagcttcagggtgagcgaatcgcactctgagtcccacccagtcctgattcaagtgatgtattgtagagacttgggactacacaccttagcgctgatgctggaataagacttctggggctgttgggaatgggatgactgtatttgccatgcaagaaggatatgaataagggggaggccagggacaggatgtactctactgaatgtctccgtcccccaaaaatctgtgttgaagcctaaccccagtgtgattttcg

SEQ ID NO: 524453 - DNA, 652 bp, Homo sapiens
  misc_feature (2)..(2): n is a, c, g, or t
tntttttttttgatggaacagctttattagtggagtttcttgtaagagttaatctggaacacacaaagggagaactcggatttaaaacatgtaggcaagcattggtcaaggcggcagctgaaatactggactgtgactgggcctgcctgacacatgctcttactagtgcttctgaggaaccttgatgacgaccgctactacctatgtgaatgccttaagtcgattctaacgaagcttcttgccgactacagatgcgttaaccgattcaaatggggagtggtaggtgacaatataggaactgactactcacacggaaccgaaccgaagtgcctgcatgaatgacatggccttgactatatcctaggctaacacatactgagccaggctataactggtgtctgttgtactctcaaccacgatgtagatcttcttgaacgtgaacatgtgctgctcatgacccaaaaactgagctttggaaaactgtatgtgatacctgctctccccttaaggacatgcgacttgataataaaccaagcttccctaaggatagttaaacctgtgtaccgaaatcctgtaacctggggatccggacgcctggatctgtcgtccccgtaggggcttccgctttgaattctgtaacgagggtaattcg

SEQ ID NO: 524454 - DNA, 385 bp, Homo sapiens
cctcatataagtaccccagggcctttaagagaaaaccggaaaaatatacatctagtctctgcaattaaaaaaaaatcataacataaacaatgttagatataaattttgaagtccatatgttgttttctacatatatatgtaatcacggctctttaagccaaggccaggtggtaggcatatgatctgtacaaacttacagtagtgtatattccaaataaagggttttcttcccaactatggtatgacaatataactgttttctgagatgcaggtacccgtttaaaggcttaaggggtgtaacccctttggaaggcaaacagcttagtgggaaaaaattctggttcctttaaaaatggggtggggaaaaagtagggtaccgagctcg

SEQ ID NO: 524455 - DNA, 158 bp, Homo sapiens
ctttcatcatttcaccagaataaaagcaagtccttacaacgggctgcaagtccccacatgcccatcattcactcagtcttcaggtctcccaagacagtgtcctcagtttcccgttctctctgcctctgtttcgtggcagacgtctcctgatgatttga

SEQ ID NO: 524456 - DNA, 110 bp, Homo sapiens
cctgtgggcacggacgcacgccactttttctctgctgatccaggcaaatgtgcaataccaacatgtctgtacctactgatgggtctgtaaccaccttacagattccagct

SEQ ID NO: 524457 - DNA, 423 bp, Homo sapiens
  misc_feature (254)..(254): n is a, c, g, or t
gagccaccacgcccagccgcatgtacttttacacaaaatgcaaacaccattcttggatcataaaagtgataccacagctcccgtgaagttttgccaggtagtactcataattaccttgggtaaactttttgatgttaaactgtatcttcttattacgagtttttccattgtattaactgcttttacaacaacacaaataacaagttattttacaaaccatttagaaatttctgtactatggtcccagtaatgtnaaatatattaatgcctattacattcagataaattatacacttggaaaccacatacttatgacttacagaaacttacataaacaaattatagaaattatatgctcaatttttaggtatatagtcttaaattaagcttaaatatacattctcaagataaattaacagttca

SEQ ID NO: 524458 - DNA, 383 bp, Homo sapiens
gtaggcaagggatgaatcctagtagattgtacaatatgtaagtatatgatgtgtacggtatataaacactaaggttcggtgtcagaatgtgatgcaggaactaaaaggtatcccacaggcgatctgacacaaattccagaacttagccaaagaatggtttattctgaggccaggcaatcccagcagtttgggaagccaagttgggtcagatcacgaaggtcaggagttcgaagatcagcctgacataacatggtgaagcctcgctgggttcgggtgattctagctggcctcagccatcctgagtggttagggattacaggcatccgaccagcagggccagctaattgattgagtgatttgtcagtagagatgggggtttgcac

SEQ ID NO: 524459 - DNA, 754 bp, Homo sapiens
ggaaaaaaaaaaaaaaagttggtgcgggagggtttacgacttcagaaaagacgggctcaccaaataaaaataccatgggtatttttaaaaacaagccaaagattaccaagatggcagtccctcggtccagaggggaagcagcaccgttttctcacttgacgatgatcatctgtgtgagcatgggtcacggtggtttggcccaataatccagcattggtaaaaagtcaggggataaacacctgggtttttggttggtgggagttggtaatttcacagaaagaatccagggtttttcctggtttggaggactaatactatacagaagggctctattttttggagacagagtctcactctatggcccaggctggagtcgcagtgtcatgatctcggatcactggcaacctctgcctcctcagtttcccaagtagcgggggatatacagggcggttgtgccaccatgagaaggggctctatttttaattggcttttttgggttttggtcattaatccgtttatctccatggtcttggaatcctttatcccgggcgtgcaagattgtttaacctggtctatttctctggacttcggggacctgatatgtgcggtatgacaagtaaagactccaaactgccagactgggctcagggctcatgcctgtaattctagcctttggacggcctgagatgggtgaccctttgaactcaggagttccgaagaaccagaacatggcaaccccttgttccgaaaatta

SEQ ID NO: 524460 - DNA, 143 bp, Homo sapiens
tattcactacccacctactccagctgacacaggatgccattcaaccattacccatttattgatcgatagcttagcatgttctagacggctgatcaaccagatcgcgaatgatgtgaaccgcgttctggcgagaaagataatac

SEQ ID NO: 524461 - DNA, 1248 bp, Homo sapiens
aggtaataagaaatattcagtaattggctttagcatttgtaattttttaccgctgagttcctgctagatttcgtattctattagtcaatgtatctaacagtgaacaatgcaagaaatattcccattatctttgaccagttatcaactttttgagatcttaagctgcttgtcactttgaactcccggtgatgcgtgaatacatcgtctggctataagcaagcatctctgattctttcgaagtgtgtagcaccactctcttcatattttcaacgatgtaaattcttacatctcgtgcactgttctgtaaaaatcacctcttggaccactcaattcttacgattgcacgctttcctaagttcaatgtacctggcagcaatggtgaccctctctgtcgaaccaggaaaactgtccgcatgttactaacttctcgggctctcaccctggtaaacctatatcgtgggtttacttactcaccgtgtcttatattattcgtggtgaggagtttcaacgggtgtagccttggaccaggtggagaattacgccactatttacaacacaacgaaaagaaaccccctgtaagggcgcctccaacatggttgcaccagaacgcacaacgcatacccctccagcctcaccatcaggtcacgaactaccactatcacacggctaacaaccaacactggcaaaaataaccacaacaagcacaggagaatcggaaaccaaacaatcagccgacaacataaagacaccaacatgtgcaaggtccacagggtgcctataagcagacaaccttgagatcacgaaagaaaatacacgcctcccaacgctagcaagtgcgaccacagcgcacgccacaggataccaggaatgaggcgccaccatgacgagccaacaacgtgcggcacacacataaccaccatacaccaagaccacacagcaggcggaaaccccacactagacctacagagaaccccatagcaaagaactaggactccaactaagacagaacaactagagaggaagcacaaatgcgagccaaaggcgacacgaccacccccattgggtactctagatagaacaccacaacacagacgcactcatcacaatagcggccagacagagcaaaccaacatgaaattagcgatcagacgagtaaacgaagacaagagcagaaaggtggatacgaggaaagagcaccgactcaccatgtgcgacactggatactgtgaatgagaaatagacgcaaca

SEQ ID NO: 524462 - DNA, 186 bp, Homo sapiens
  misc_feature (47)..(47): n is a, c, g, or t
  misc_feature (57)..(57): n is a, c, g, or t
  misc_feature (69)..(69): n is a, c, g, or t
  misc_feature (75)..(75): n is a, c, g, or t
agaggttgaagataacagagtgcaaagtttccttctctccctctctntctctctttntctctctctctntctttntctctcttttaaaaaaacatctggccagggcgcagtggctcgcgcctgtaatcccagcactttgggaggttgaggtgggcggatcgcctgaggtcgggagttcgagaccag

SEQ ID NO: 524463 - DNA, 280 bp, Homo sapiens
ttgtttccagccatttgctaggagctggggacacaggtgaaccgggttgtgcccattgccttcccagatgactgctatggtaccgacgtggacaagatgctcgaggatgtagatgaaagacctttatcttatagaggtcaggcaaggccttgagaggaggtgacattggaactcagttggaatgttctggtatttgcctggcactgtgggaggggaacgggctcattctataagcccttttaagaagttaaaaagaaaaatctcaaagggctaaatttaa

SEQ ID NO: 524464 - DNA, 599 bp, Homo sapiens
  misc_feature (366)..(366): n is a, c, g, or t
  misc_feature (468)..(468): n is a, c, g, or t
  misc_feature (486)..(486): n is a, c, g, or t
  misc_feature (507)..(507): n is a, c, g, or t
  misc_feature (568)..(568): n is a, c, g, or t
aaggtttctttggcccttatggcttattcttggtgcttatgtaagcagagggcctgctgcccaaggagaacttggtgcatataatttttccagggacggaaatatcgtgatccaagtaaacagaattctgtttttactgttgagtcctagatcatggggggaatgaatgacatgatcatccttcagatatttgttcgtctttttgtttgggttgcacagcaaacaatacaaacagttactctcttgtgaagatttcctcatttctgtttctcatttcagttctcagtgttttcattttgtccttttcactttgctgagtcagtcagtaaagatgaccagtgatttaattgcagtcaaatccagcgngcaattcctagccccttcctcacaggaccctttgtctgcctttgacatccgttacttcgaaactgatattttctccatggagtctctcttttcttggctctntaaaagtccacttcaggntctttattatttttcttatgncactgaaacgggttgactagtgtctccccaaaatgatgccacctagaacctcagaatgtantcttatttggaatagggtctttgcagatgta

SEQ ID NO: 524465 - DNA, 1474 bp, Homo sapiens
  misc_feature (1)..(1): n is a, c, g, or t
  misc_feature (1200)..(1200): n is a, c, g, or t
ngtgtggtgttgtggagggaatgaatgaggtagttctcatggcagtaacgtgtttcgacacatggggtgggtgccacggtgtatggatgcgactcgttggtaaccaccacacaatgatggggccgactcccatacacacacacacaagtatggatgattggcaccagctacttagtggcgagtgcggatggtgtggcgcacacactacggaggttggacttagtctttattatttgagtgtgatgttcttgttgtttctttggtgttggtcggtggtgagatatagatgttgtttattatttagtggtgggtccaccatcattctgttctctagcttggcacgctacatctggcttgttctacacagcagatgttgtgcatcggctccacacaccagaacggtaagtggtggtgtgtgccagcgcgcactgactacatatcacgacatcaacagatcgtacgaggtgtgtgttcatcaaatagtttggtggtggggtttgttgttttgggttggccaaaacgaatattcctataggggtgcggccatcactattccgtagtagcggtagatagatgatgttgctgttggtagtgagaaccatcagcgtgttgttggtgtggtggttgttcttaagcagctcaaacagagtggcaccaccacaacaacaggcggtgtgcaccaccactgcggtggtgatgagaacagcagtggtgggtgcggtgatgagaggagatgatgtgctcctgtcctgagttgcggttgtctccacagctacttaagatagacgaacaacacacagcttgtgagtggtacgacagctggtgtggttaggtgctggatggtagttgtgattatatggatgaagggactgctccacaacacttcttcatcacaacaccacaagtgtatgatctcacaagaagacgacaccaagagtgttgtctaagatggaggtgtttgtagctacacacagtgtggagatgtgtgggtagatgtcactatctgtgtctctacacactgtagcaacttgtttgtgtgtgtcacacacacggtggcacacactgtgtgtgcaaacaacacacacagacagtcactcctgtggaatttttcactgaggaggagaaaaccagcgagattgttcgtctgttgttcaacacggtgacatatcaccgcacacagtctccacacacagaatatangtgtgcaagttctcatgcttctgtggtgtatgttctcccactgtgtctcatgtggagaagaggcacagaacagctgtgtgctacacaatgttctacttattgggttctaatataacaaaatgggccacacaggcacacacagtggccttcagctttgtgaggggttttctggccaccactttccacaatgagatataaatttttttgacagctccaaaaaaaaaagaagaaaaagacgtcgagcatgaactcggggacgagtaagagtagtgat

SEQ ID NO: 524466 - DNA, 163 bp, Homo sapiens
aggccagatctgttcaggctcgagaatctggagaagagctggagattggatcgtattgtctgtatgaggagactttaatttctgtgtgagaccaagggaggagagatgtgtaaggtgcagaattgagatgagttgtggtacactatcttatgtgacctgtctg

SEQ ID NO: 524467 - DNA, 1174 bp, Homo sapiens
aaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacggcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaatcatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaagctaagaagtcacaggaattgttctcaggtttttaaaaaaatttttcctgaattcaggaagtgtcttctgaatagcagctagccaaataaagcggtgtgtgtgtactgcagctgtaggtgaacttaaaaataataataaaaagaacaaataaagcagtgtgtaccagccgctgagccggccctgtctctgtcctgtgagacggaggggctgtgcctggaagtagaggggtgggcgttgctgcagcctgcagcccggcccgagtctgtcccagtgcctcctgtgtgcctggcacctcctcaggcatcttcctggctgccccatgttgcagctgagcctcagcgtcctgctagaactgcgtgtgggatttgctcactgccaggatgggactgtggctggaatggaggcagaaagaaacacatctcaaaggcaaaaatgacgcacgttgttgtctggaaaaatcttaagtgaccaccaaaaaaaa

SEQ ID NO: 524468 - DNA, 797 bp, Homo sapiens
aaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacggcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaatcatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaagctaagaagtcacaggaattgttctcaggtttttaaaaaaatttttcctgaattcaggaagtgtcttctgaatagcagctagccaaataaagcggtgtgtgtgta

SEQ ID NO: 524469 - DNA, 833 bp, Homo sapiens
agcgggagtgcgcggcggccggaccgggcgggcggagccgggcccgcggtggctgctgcggggcgatcgggccgggccgcgtgcctgcgccatgggctccctgtgtccagcctgagttccagctctcactgagtggcacagccccaaagtgctgccagccgagggaagcgccccatgtcactgaccatgtctattatggaccacagtcccagcacgggcgtggtcacagtcatcgtcatcctcattgccatcgctggcctggagggccttgatcctggtgctgctggtgctacctgcggctgaagcgcatcaggcagtcagaggacgaggagagcatcgtggcggatggggagaccaaggaacccttcctgctggtgcagtattctggccaagggacctgtgcgtggagagaagaggccacagctgatgactcccaatcggcccggaagtccacgggctgagtccagtgatgcaagtgtcctggtcctgtgttgcagccggccaagaggcgctgaggaggggcaaaaccatactggatgcgcgtgctgtcttgagaggacgggctgacacttgctggcgatggcctctgcgggcttccgatcatcgcattgcactgatgccggcgacctggctgtcctggggcttcccctcgggctccagggtgaggttgcccatggcaggcactgggcagggcctgaccttgcttggggctcatgggccctgtagctgctttgggttacttgacatggtctagctgaggctggttatcgatggaagctactaatggcaatgcgtggaactaacaaacctgtgaagctggcaactaggccctg

SEQ ID NO: 524470 - DNA, 158 bp, Homo sapiens
ggcccaccttagctagttttttggtattttttttagagagacagacaggtttcatcatgttgcccaggctggtctcaaattcctgggctcaagccatcagacttggcctgagtggattataggcatgagccaccgcacccagccgtcgtaggcagtga

SEQ ID NO: 524471 - DNA, 974 bp, Homo sapiens
aaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacggcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaatcatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaaaaaaaaaaaaaaaaaaaaacaaaaaaaaaaaaaaaacaaaagaacaaaaaaaacaacaaaaaaaacgacagaaaaagaaaacaaaacaaagaacaaatcacaaacaagacacagaagagaaacaggagagaagctagggagaggcggggagaggtgaggaggaggtagatatcaaaacgattgcaagaggtcgtggcggacatgtcccttcgcgcctggaagcgcgcgttgtcagcggaagagacgagggcgcacgctcatgaggcagtgagacgcgacgac

SEQ ID NO: 524472 - DNA, 154 bp, Homo sapiens
atcttacgatttgtacgtaggaccgctacggacctcaacaggagccacacagatgagccacccaaagagccacccaaagagccaccccaagagcctcgctgatgtgccaccccaagagccacacgatgagccacccaaagagccacccaaagag

SEQ ID NO: 524473 - DNA, 339 bp, Homo sapiens
  misc_feature (103)..(103): n is a, c, g, or t
agatcagtgtgtgggagaagaaagaagtttgagtatttatcacctaggaagggggacttccaggacactgtttggcagggatgctgggcctctactggagctnagttccgactgtgttgccctctccttcagctacagttacagttatagtgctttctagattctgggaactcctccctttcctgctcccttcaggcctaggaatggtaatacttcctaattgttgccaagtctagtgtattttacagtcctctatttttccgttttaacctttactgttatctgagtaggtcatttcttcctgccaagtcattaaactggtacaggagggagaaggag

SEQ ID NO: 524474 - DNA, 1060 bp, Homo sapiens
ggacgcggtgggccacagacaaaaagttgttactatggtatacttcaacaaatcagtcacctcgtacgcatgtaggtgtgtacagagattaaacagatgtatacactacatcgtagggtgacgtgactgctgatagtataatctacagtacaaaaagttgtacatatggtaaactaaagctagtttaacagctgtggagcatatgctgtaagataggtttttgaagactacacctagcttgggctaatagactaggtgagtacaacgtctaacttatacacatctagagtatgagacaggtcgtgaggaagaactgaagatatcaagctgaataagcaggagaggtgagaccttgagttatgagaaacaataactattagggaagaccatgtatcactactctatgaagttacaatagaacggtgctgctgtatgtcttcttattccgtacagtatccggataattatcgacgtaagattccgagggtcagtggcccattggtagtagatgaggcataatcttggtgaggaccggaaagcttgatacgagtaagcaaacagtgtagtaaacactggtatatgtccccactaatttcaatacggaagacctctcacgaaactttagtatacagctcggcagctaaactatacttgggttcactacccatggtcggactaggccacttctgtagcgtaacggtgttaccactcagacaaagcaaattagagactggaacacaacacctctgaagtagccacaaatggttgagagcatagataaaccggcactctagagcccaaggcaaccaagcagccacgcacggggcaagtagcggtcgtcaacccacgtatgagacaccacgacaaacgcagacaaggtggcacaacccaaccggtccgcacacgcgccgacacgagacaaaacaaccaacctagaagcacgtaccaggtgcaacaccgggacaacaacaagcagacaagacgcgaaccgacaccaaccagaggagccaaagacgacgacgacccccccaaagccacagaaaacgcaccacgccaaacc

SEQ ID NO: 524475 - DNA, 949 bp, Homo sapiens
gatcaccggaattttctgtaggtcaatgtgctgaccgacaagtggggtgaacggcgtagacatttgaaacagatctcattgtccaaatgtatgaatctggtatcactgatgatgtcaaccaattatgctctatagggccatccatcaaattggagaagatagcaaggacctgaagactctttgatagtcctaattagagaattaagcagtgaggcattcttcatcaatattacttagctttgacagagcatatgatagaagtattagttctctcattatttcctattaactgatagaagaaatgagatgagtggaagaagaaccagaaggagttgacaggggggagatgacaggcaggagattcttggactatataggtttgaggagcatggcatctgatagtattatttatagatatatttccatgaaatataatcagattagttactcctgtacattctagaaatgatgcataacagttcaaggaaccaacaaatgtggtgagatatgaatgcactgtgaatcagaagcatgctgtgatataatgttgtaaggaattagctgcttatgagctcttatgacagtgttgatggtgatcagtgggtttaaaaaccaggttcttccaggaattacagagtcattcacaatgaggtataaagggcattgcgaacgcagggtgattttgggctcatcggcagggggatgtctgtgaaattcgaagtctgacttaaagaacgcatggttgattgaaagcaatcgtgtaacttggtttcagatcaagaaggaagtgggcggaattggaaccaggggaaattttggacgtacccggggaagagatggattaggaaaaatggggtaacacggtttggtacgccgtttaaccaatttcgggtatggggagtcaaatttacagagggggtttgggggatgggggacaaagggctatgga

SEQ ID NO: 524476 - DNA, 289 bp, Homo sapiens
tgcggtccgtagcacccacaagcctcatcatactgccttacaaccttagttcctcttcatttctgtcttctcacttacctgcagaaacccagttgattcttgttctccctttaccacaccagccttgtaactgtgatgaatgaccctcgagctcactggaatctgaatcactcaggaattcaagcaaacaggatgttttaaccactgtacagctttcttatggcatgacagagcacttgtagagataacacaccagtttgcaggaagaaaggaagagaatggaaacagc

SEQ ID NO: 524477 - DNA, 275 bp, Homo sapiens
tgcccaggccgccgctcaggaatgaattcagagatggcttttgccatgttgcacagactggttttgaactcctgaccaagtgatctgcactccttggcttcccaaagtgctgggattacagatgtgagccacccctgcccagccaatgtaactgcaatatttcaaaattgccgtgtgtgtgtgtgtgtgtgtgtgtgtgtgtgtgtgtctatgcaatgtactttctaaatgggaattatctgtaacataaaatatatacaatatctggaagccct

SEQ ID NO: 524478 - DNA, 456 bp, Homo sapiens
  misc_feature (6)..(6): n is a, c, g, or t
  misc_feature (63)..(63): n is a, c, g, or t
  misc_feature (110)..(110): n is a, c, g, or t
  misc_feature (135)..(135): n is a, c, g, or t
gagtgnctgctgcggactgcctcagaccctgatacccgtactgatcttgggaactggatcttngagtcaggattagttcttacttaatacccccacctttgagaacgggnttgttaaggacgctatgtagggccntactactggcattgggttcgggaatgggattgacttggcttcaggctccttggtcataaaatatgggagtagaaaacaacaagaatggatggactcttaaaacatgaagagctttatcgtttgtccctgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctc

SEQ ID NO: 524479 - DNA, 355 bp, Homo sapiens
  misc_feature (11)..(11): n is a, c, g, or t
  misc_feature (22)..(22): n is a, c, g, or t
  misc_feature (175)..(175): n is a, c, g, or t
  misc_feature (192)..(192): n is a, c, g, or t
accctcaaggntccatcccccncgggcccaagaaccttccaaaatttaaatggaaccgggctgatcccctccatgaaatcccagacaaagaagaaaaaaacccccctgttattgggacctaaataatcaaaagcataatgttttccataattttcctatttgaaaatgtgctgantcctttgaatgttttantctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgctcaagttc

SEQ ID NO: 524480 - DNA, 433 bp, Homo sapiens
  misc_feature (23)..(23): n is a, c, g, or t
  misc_feature (42)..(42): n is a, c, g, or t
  misc_feature (82)..(82): n is a, c, g, or t
  misc_feature (90)..(90): n is a, c, g, or t
  misc_feature (110)..(110): n is a, c, g, or t
  misc_feature (149)..(149): n is a, c, g, or t
  misc_feature (189)..(189): n is a, c, g, or t
  misc_feature (270)..(270): n is a, c, g, or t
  misc_feature (375)..(375): n is a, c, g, or t
  misc_feature (426)..(426): n is a, c, g, or t
gaaatgggaaattaagtgccccntaataaggaaaaaaatacnaaaaagaaatggaactccttcctggacccataaagagganaccagtgnaaaaaacagacctctgcaanagagccgtcactgagaaatgaacctgctgccctcctgancttggatgggccagcttcagaaatgtgaaaaataaaggtntcttgtttaagccaccccaggcaatgatatgtgttatggcaccctaagctgactaaggacagctttcttcctcaatctcantcatgggcctcaggactatgagttggatatttttcatcagcatgctgatataatgcctttgtttaattttctgtgtctcgaatttttagctctaggtccagaacnttcctttggcttctatttgtgtgtgtattgcatctgtctcaccatatattnacaggta

SEQ ID NO: 524481 - DNA, 125 bp, Homo sapiens
tcaaagccatatatgtggtgtgtcgaatcaatacgaactcaggggcgagctgccttccttggatgtggtagccgtttctcaggctccctctccgcatagtattgtggtgtgttgaattcaatacg

SEQ ID NO: 524482 - DNA, 344 bp, Homo sapiens
gagatggagttttgctcttgttgcctaggttggagtgcaatggcaccatgtcagctcaccacaacctccacctctcaggttcaagcaattctcttggctcagcctcctgagtagctggaattacaggcatgcaccaccactcccacctaattttgtatttttgatagagacggggcttctccatgttggtcaggctgttctcaaactcctgacctcaggtgatttgactgtcttagcctcccacagtgctgagcttataggcaggtgcacgacacctggctggaatcatttatttcaacatatctctgggtccaacaacatggtgatgcaactttcctgcatgg

SEQ ID NO: 524483 - DNA, 1200 bp, Homo sapiens
  misc_feature (496)..(496): n is a, c, g, or t
  misc_feature (534)..(534): n is a, c, g, or t
  misc_feature (622)..(622): n is a, c, g, or t
  misc_feature (731)..(731): n is a, c, g, or t
ctgaccaggacaaccgttagccaaagccatttacccaaataaagtataggcgagtagaaattgaaacctggcgcaagtagatatagtaccgcaagggaaagatgaaaaatgatgaccaatgcataatatatgcaagggactaatccccatataccttcgtgcatacatgaagtatagacgtagtaaagtaagcttgggcaaaggacgagccagagagcgtaacgaccgccgcgaaacccagacagacgctcaccgtaagtaaccatgcataaatagagccacgactcgcggtcatagtcgtacgcgaatagatagtggggcaagagtttataggagtatgacggcggatcgaaagcctacactggtgccttgggttggatatggcttgggatcttggtccccataggcataatggaaatcgttccagtcttccgaactgtgtacacattctgaccgccacgagagatacaccgtgctcatagatctcgccctgtgntgagaatttctgagacatggtgttacgtggccagaagnacggtacatccagctcgttatgggaggcatctaggcggagaagatgaccttttgtacgaaggagacgtacagagatacatttctacancagcctcactatgctatgggggcctacagagagggcaagctcatccaacttagagggaagaagcggttcacatgctcaagcaggcacactgacctaagaagaatgccantaacatataagcttgaacgtcctcagcgagcgccaactgtgggaccaagtgctatcgaccctagtaggaagaatctagtgtaacgtactaagtagacattgagaaacatttctccatccggcatgaacgcactgggtcagattgaaagagcactggaaactggacaagttaacaggcccacatatctatcaatcaagtcgaacaagtcacttagttacccttcaatggtctagaccaaatacaggtcatgctccataagggaccggttcaccaaccacgtcacgaggaactcgggggaaatctttacccgggctggtttacccaaaaagcatcaccttctaggcattaaccagtattaggatggtcccggctgagccagctggcgccattgtttaccgggcgggggatacctaaaccgtgcaacggtggcaaaaacacgtgtgcctaagtaggaggctcgtataaatgg

SEQ ID NO: 524484 - DNA, 169 bp, Homo sapiens
ccgggtaatagggcctatgcaaagaacggagcggaaataaattctaggacgatgggcatgaaacatgtgggtatgctccacagattgcagagcattgaccgtagtatacccccgtggcgctgtagcgtatgcaacagtggtttggtttagacgtccggcgaatggcatc

SEQ ID NO: 524485 - DNA, 567 bp, Homo sapiens
gccaagggcctgggaggttttgtgtaagggaacctggggggcccttttgggtttcattgaccgggttcttattataaaattagcgggggaaaccgggggcttttgataaagggaaaaggtaaatttccaaagtgggaaccttcaggggtttccccctcggtcaggggggagattaaataggggcacctttcccaaaataaaaaggggggattttcccttgggtggaaaatttccccgggatatgggaggaaggggggttttcccctttttcccccgggggaaaaaaaaacctgggttttatttttagggaaagggaacccggaaataaaaaaatagggggaatttcttggggggaaggcctttaaagcttttttaaagggggtttttttgggaagcccttcctttttaagaaatggggttttaggccccggtttttaatcgggggggaaggggttttttaagaatttgggggggccccagtttttcaaaacgggaggggggaaaatgggttaccccccccggggttcctttgggggcaaccaataaaactttggaatttagccccca

SEQ ID NO: 524486 - DNA, 415 bp, Homo sapiens
taagcacagaacacagtatttaattttaatagaaggccagtctatcagttttttcttctgtggatcctgatacttctttcaagtactgagaactctattgaatagctctaagtcccacagatttacctcttaggtaagcttttaaaagtttgatggtcttatagtaacatttaagtactagtgatccattatagactaaacgattgagttaaaagatagtagaggattagctcaaggttctattttgtgtgtagtagtaggcctgtcgatagtccagtaactaccagcagcaattatagaaagatgatctataccttcattgaattgctttagcatctttggcaaaaatcagttgagcatatctgtgtgaatctgtttctggatattttattctgttacattgatctatgtatcc

SEQ ID NO: 524487 - DNA, 1670 bp, Homo sapiens
cgcgacggtgagcgacatcgagagacggtgtcttgcggctcgctcttggcgcagggcgtggatcaccgcggagtagctcgttggatgtccgtcttagggtctctgtagctgtctcctgtatcagcgtctatctgttacggctgacatcgtagtcgccgtcagtgggtgcgtttgccacaggtctgtttgtctcacatcgtggcgtgattacataggcgctgatccattcatggcggtggtctggcagtctcgccgtctatattcatcctcccaagttgctgtcttccgcatgtcccgtcctgacgctggcaatcgtggtctctactccgcttctttcggggtagcgtacgagtgcgttctgtgcatctctccggacggtgtatgcgttgggttgacgtgccttagaccctgcgtgatgttttcccgtgcggttgcgtgtgactctcgctgtgttgtgttgtgctagtacgcgtgggatggtttggatactgcgccctgtttagttacgcgggcttgctgttgctcgctagttacgtcagatgtggtgtactatgcgatgtttgcgcatggtgctatcgtggtggtcgctccaactagactttgccctgtgctgtggcgctgtgcggcggtgctatcagtcgtgtgggcgctgccgttgcgggtgtgtatttgtggcgccgctgtggactaatgcggatcacgcgtcgcgtttggcgtagcgggaaggctgtaatgcgtggttcgttgttggccgacacttgtgggcgttgtgtggggccctcgtttatgaggtgcgacgtggtgtgccggcggttatattgcgtgttgtcgggtcctgccgtccccgtgtggggttgtcatgtactgttttctccagagtgccgttcgttgttgtgcgcgtgtccgttgtgtcctgcgttgtggtggttgtttgggctggggcacgctcttgggttcgtgtcgttcttctccttgggtgtacgtggagaggcttgctgtggggtgccctggatgcgcagcatgtgtttggcccagggtcggtgactatctatgtataggcggtgtgggtagatgacggcgcgcttcgctctcttgctagagcgttcgatgcgagattagttattatggccagtgggtgctgtgtaatagcgcagatattcctagtgagagaggtcgttagatagcagagtacggatggcgtgcgagtagactgaggtactgttgagtttagagaggagagtcatgcagagcgtggtagaagcagttgatgagagtaactttaatggagttgctagttgttagtcttgtttgtgaagttggcaacgagttattagtttgttgctggcgtgagtagtaggttatgagagtaagttgtgttaagagtgtctatgcgttgaagagtagaaagtagtgtagttgttaaggcagctgcagcggcaaatggtaaagtgcacacgttttagaagtgtgtgtgttgctaagttttttgccagtaagagagttgtaaagcattgaagctgaacaaagtgtagcgctataagtggatttggttaatgacttatgagcaagctggtttggccagacagtagtacccaaacttgttatatgaagtatagcagaatggcgtagtcacagcgttgtgaaattctcttgtaacaccctggatttgg

SEQ ID NO: 524488 - DNA, 667 bp, Homo sapiens
gctcccagcaacgcctgtgtttccatcattggtttgcactgatgtgtctccgccgcactctcaggctgcagctgcaggactgagccgtgcacccggaggagacccccggaggaggcgaagcacttcgcagtgccgtgacccaagccccagtcctgggtagcctgcagtccatgggccagcgtgttcctagccccttgcgtggcagcccatggtcctggcccaggctcctgcgagcgtttagcagatgtatctggaaggagcacagctcagaggaccgctgcttttcgcgtgcgcatcgctgggcgacgcggctagctgcatgggcgtgcttcgtgctggctgccccgtcaagccaatcgccgttgcccatctgttccagctatccttgcggtacacacgccctgagcctgccggagcgtgtgccttgggcgtctcccgcggggtccaaggttggaccttttccttgtccccggggccggaggcaggtgctaggaacggctgcttgggttgggctgcggtggtatgtgccgcggtcgaatggttggacacctgagggcctacgcgggttctccgtggtttggcctactgccgtgcgttaccccatggagatctgcttcaccctgtggcgttcgtaccctgggtgccttgagtcggagtcttggggccc

SEQ ID NO: 524489 - DNA, 255 bp, Homo sapiens
tactgaccgtcttcatatactagccaagtagcttgagatcacatgtgttgcacacccacaccacccagcttaattttttttatttttatgtcgagacagggcttcactatgttggccagactggtctcgaactcctgacctcgtccatctgcctgcctcagcctcctgaagtgctaggattacaggcatgagccattgcccctggcctctttttttttttttttttttttttttttttttttttttttttttttt

SEQ ID NO: 524490 - DNA, 914 bp, Homo sapiens
gtggcatcctgaatgctgacaacattctggccgctatgtctcgctctgagacctaaactgggctcgggctactctctctgcctgggcctggaggctatccaatcgatacgtgccaagacgattcacggtttgatctcaacggtaagatccacgtcgaggagcatatgtgacgaagtcaatcatttgcgctgaatttagctgagtgttgtactggatgtactatcgcatccggacatggtagaagtatgcttgtactgaaataacgtggaacgaggagactgtggcctacaaagtggtgcgcactgcacgagatagttctgtcaagcccaatgatctgggtcttgtctattctcttgtactacatgttgttatcttacccccattgatgaacatggatgtatcttgtgcctgccacgatgtggacaccactgtttgcactatggtgcgagccgaccccaatggataatggttcaagctgggatgcggagacgattgtaaagccatgcattcatgagtacgccttgcgaggatgactcgggcatttaggcaattgcgatgaatagttgccaagtttctgcctgtggttcgctgtacaaagatatcgatatgcttagtactcttacactgtgttgcacctgagtgtgtgggcgtcgctaattgtatgtgaacgcttggacttggctctgcttttagtactcgctagctttggagttgctgtctccatgtttggctgtatctgagcggttggtgccacccggtagctcttggaggggtggcccccgtaatggtgggggagctgagacgttgcgccttatccagatcatccttttggtccgctgtgactccttcaaactctgcgctcaacaggctgtgccgatagttccgcgggcttattccttgcaggtcactactcg

SEQ ID NO: 524491 - DNA, 251 bp, Homo sapiens
ttgggatcccaaaaggcaagggacggaaaggaaggggggaaaggggaacgggggggttgggaaaggattgaggcggggcccttttcttccccggaaggaattggggggttgtttaaattgggcccttggaaggaattttggcaacaaagggcttggtttggggaaagggaagaattggggattttggggcttcccttcccccaaaaactttaaattatttcccaagagggcttaaaaaaaataaatatcac

SEQ ID NO: 524492 - DNA, 993 bp, Homo sapiens
  misc_feature (429)..(429): n is a, c, g, or t
  misc_feature (485)..(485): n is a, c, g, or t
agcggagcaccggcctccttcccagccgtgcggtttcctccagaccatctcgggcacgggtgagccctattcccagaggcaggtggtgctgaccctgtagacaccaaaggaggacaactagttgtgctgaagctcaatcattgttgactaggtgggctacccatgtccgttgtaagcttcaggcagagctaatgtgagacctaacaggagaatgaccccaaagatcctatcaaactctcggagtctctcatggagaatacactcaagcgacaggctcttggatgaaggaatagtcacgactgtggatggaccatgcttctcttaagatattggaccgattgctgtgccaggcatggattcgtagtagacgagcgagatggggcataatgcgcattttgttacaggatacgtcgcaattgaagcgcgccnatgcaccggcgctagcatgatgcaatgcgtgaccgacgaacttgggccgaggatgncatggccccgagagccaggaacccatgcgaacgaatcgaagcgaatggtctgggaagagctcttaagctctgtagcagaccccgaatggcgctataaagagagacaggcagtctgccatagtacagttggctaactatctttgaactaatgattacgtaacgagcgacgacttctatcgacaggcatcttcgactaccggggccgtctgtcgtcccgttgccgaagtgcccagggcggtccctgtggaaggctgccaccgaggtacacatgtccctattgggtccggcggtgtcaagaatctaacagtgacctgtcaaagctcttttggcacgttccacaaggtgtcaccaagcagctcagccaagatcaagttcagagagcaatgaagctgtcaggacatcaagaacggacgcttgacaccagatcaagtccaatagtcgattgccctgatgaaccggttgggcccagaaccgctggcagagccaaagggccatccagatggcagaa

SEQ ID NO: 524493 - DNA, 267 bp, Homo sapiens
  misc_feature (232)..(232): n is a, c, g, or t
gaggatccaccgaccatggaacactctcaatggctgcaaccaccccgtggcccccctaccagccccaatctccaaaccccgcacgtcgatcatgacgccaccaacagctgcagcccctgagatcttcaccttagaccctctcccgaagcccgcagccgcccctgcgaaccctccaactcgttcacacgcgccgaaagcctattcccaggactctctgcccctacgtgaccgnccctagctgctagtcgagaatccgaactccgctcc

SEQ ID NO: 524494 - DNA, 257 bp, Homo sapiens
  misc_feature (2)..(2): n is a, c, g, or t
  misc_feature (59)..(60): n is a, c, g, or t
  misc_feature (63)..(63): n is a, c, g, or t
  misc_feature (70)..(70): n is a, c, g, or t
  misc_feature (88)..(88): n is a, c, g, or t
  misc_feature (141)..(141): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (164)..(164): n is a, c, g, or t
  misc_feature (171)..(171): n is a, c, g, or t
  misc_feature (186)..(186): n is a, c, g, or t
  misc_feature (226)..(226): n is a, c, g, or t
tncagaggtaatgctgtggcatattgcttctgcctcagtgtatcactggagtcacaggnngcnggcccanctgagttcccaataaagnaaaacctccccttctgaggctgctttcccaaaactccccctgcatctttatcncttcatcctatcccnccnctngnctgaacntcccacctttatccngtgttctgcctttgttttaattttaactcatgttcatccnggcaacagaagcattctctaggtcccagttt

SEQ ID NO: 524495 - DNA, 222 bp, Homo sapiens
  misc_feature (3)..(3): n is a, c, g, or t
ganttaaagtctgtacctctgatcatcatcttcccatttcctcctcccctcagccctgccaaataccattctaattctgttctgtttctatgagtttgacttttttagattccgcatgtgagaacataaagtatttgtctttctctgtctgacttagcataatgccctcaaggttcatccattttgttgcaaatgacagaatttcttacttttctttgtcct

SEQ ID NO: 524496 - DNA, 915 bp, Homo sapiens
ggtacgaggactatatgtggatgaaagtaaaataaggatcaacctctacaggcatacttcttccagctcgatagcatagcatctgaatgggttggacttccagctctgccttcagccaggtgtctcttcggtctggggagaggtgggagtgataagaatctatgtagattgcgaaggctaaaggacacttctaaacagaggcttcggttggcattcagatatggaatgctatgatcctgtggctgcaaaatggaacgaagtaaagaaactccctatcaaaagtcatatggtcataattgtgattttcacataataatgggatgatatagtgtcgtaggaggaaagaagatgaaaaaagatgtagcaaaacaagggtgtttatcttatcgagaggccccgaaaataaaaggagagttggatagatgatctgtgggtcctaaatgagaaaatttcctcgtaacccaggttatggagtgacgctagtccagtaaaggcaaatatggtgatcgcgggagggtgtcagtgaagatggtctttgaggttcagtgtgaagctttaagaacttaccaaaaaataaatgggatgttatgaggaatttcgcaaagaaagaagctcattgagttgtggtcagctgggtgggatctctgtctgcaggggtgtttggtatgaatcagtgggagtctaaagaagtttgacgcactggagtcatgactatgggagtttgcgttataacaggatgggtggccggtggcagaaaaagtttgccaggaggggtggccaggaccgttaatttttcaacgggtctgtgccgggggcacaaagggggggggtgggaagggcaaatcgggaatcgaaccttcaattcaagttgtcgcggagacacgtttgggggaacctcacgaaaaaaaaaggggc

SEQ ID NO: 524497 - DNA, 343 bp, Homo sapiens
caataaattgtcaaagtggaattggaacgtgtttttaggattttgatatgaagcaggcttcccatgtgacctttctcacttcttgttctgaagtctaacactctgcttatctttctctccctctcttcattgatttgtatagtggctgctaaatggacattgtgggaactgagctttcatcccctgtattagccatagagatgaggactttgagggcaccatggaatccgattgctggaaataaatcattcataaaggaaaggaaaacctaaaaactcaggtgcaacaaaagcaaaatgagaaaactgttaatctttacaattttataaagaagaattgcata

SEQ ID NO: 524498 - DNA, 364 bp, Homo sapiens
  misc_feature (26)..(26): n is a, c, g, or t
ccttatgaatctggaatcccgaaaanttacgacacttctctgctactttatacagcaggattcatcagatgacattttgctgtgaaaccattcagtgttctctggactaagatttcaccccagaggttaagtgctttaactagatatggagctcccatcaattccctccctggccctgcaagcacatatccccatccctgaaggtccatgcacagagattctccttgttcacataaggctttattttctactgtcttagaagcattccttagctatgcaccttcctacggtttgattctgactccagtaattccctaattatagagacagattttctgtcttgttattctaacacggattccat

SEQ ID NO: 524499 - DNA, 442 bp, Homo sapiens
cacgaggggttgcggacgcgctccgccgttacctcgaatcacaccccaatgcatccgacagcctggagggggtgatgcgctggtggctggcgagcgagcgcatcgaagcgtcgcaagccatggtgcgcagcgctctcgcacacctcgtcgaggatgaagtggtggaggtgcgggtcctgtccgacggcacccgggtgtatttggcgggcgcccgcgccaggttttcgcgcccataggagataccgccatgtctcaactccgcgttcagctcagctcccgcaccggaaaatccttcgctggccatcgggtcgtggcttcgtttgctcagctcgtgacgatcgacgcagaatccgctccgcgcgaagtccccggtgaagcgtccaaggcggtggaagacggcggccttgcgctgatcgagctgcccgggaaagacaccctttcc

SEQ ID NO: 524500 - DNA, 589 bp, Homo sapiens
  misc_feature (46)..(46): n is a, c, g, or t
agtcggcacgtcttatgagatctggaactggatgacttctgccagnttttcggctagctggtaatcctgacttggggaggatggtgcaggtgcagcatgcctaccacatgtgtgtgcccatggttctgggcatctctagtccttacacttgttgacaagcactttaaccacagagcctctcagccaagaagccgtctctggaagagctttttttcttttggggttttcgagacagggtttctctgaatagccccggctgtcctggaactcattctgtagaccaggctggcctcaaactctgaaatctgcctgcctttgcctctgcctcccaagtgctaggattaaggcgtgagccaccacgtattttgttgtttttgagatggtctcactatgcagccccagctgtcctggagcttgctgggtagagcagactgccttgatctccgagatgagcctgtctcagcctccctcccaggcactgggatcaaaggtgtgcaccacctcagctgatccctgcacagctttcccacatcatcgtccctcagaatgtacatccactgttctaaagtacttcctgctgttaaaaggc

SEQ ID NO: 524501 - DNA, 257 bp, Homo sapiens
atctacagatccttagtgcatggctggccggagtgcaatggcttaccggagtgcatggctcatgccgtaatcccagcagtttgggaggcaaggtgggcggatctactgaggtcaggagttcaagactggcctgacccaacaatggtgaaaccccatctctactaaaaatacaaaaatcagctgtgcgtggaggcgggcacctataatcccagctacttgggaggctgaggcaggagaatcgcctgaacctgggtggt

SEQ ID NO: 524502 - DNA, 126 bp, Homo sapiens
ggctaggtgtaatactctgggtcgctacgagtctggtgagaatagtgttacatgtctttcatgatagaaggaagagaagtaagccgagggcgtctttgattgtgtagtagggtggaaggtgatttt

SEQ ID NO: 524503 - DNA, 191 bp, Homo sapiens
ctggcggcatgggtctgtagcgaagcaggtaggcagcgggcggtgggcgggcttgttgggtgccccgctgcaggggcacgggctggacggcctgtttctttccactgccccccggaatgagatgggccagggcgccgggtcggttaccggagtgcaagctcgaacggagacaggccgtccagcccatgccg

SEQ ID NO: 524504 - DNA, 176 bp, Homo sapiens
caggatctctgtgacgagacggctatactgtctgtctgaggcagaagataacagcatctcgaccagcctctgcttaaaggaatctttattaatcacgtgtggttcacagataattctttttttaaaaaaaccccaagctcctagaagaaggcacacttgtcaagagtgggctttcc

SEQ ID NO: 524505 - DNA, 1598 bp, Homo sapiens
gagcgggcagagcagcggctggagatgaggcggacacgtgtgcaacagcggtagcagcccgggcggcggctagcaacagcggcgtgcggcatcggccctgagcgcgccggccgccctcgccatacgtcgcgacggccgcgggcaggccatagcgagcacgaccaactgcgagcgcgcgccgtgtggccaccgcgtcccgacagtggcacgcgagcggccgcgggagcgacccatcggcacgaatgcatcgccaacacagagggcgaaacgcagcgaccggtagccaagacgaggccacccgccaccgactcgcgggcacaaggcgcgcacatgcgcagggaagagaacagacatcgaagcccctgccgagcctggccccacgcacccgacagcagccccgcgcacgaccgcaccgcacgcagaggaccaaagaatcacacccaccgcagcacgcgcgacgaaaactaacaggatgacaaacgcatacgcccgcggcgcacatagagcccatgacaccccatcaaacacccgcgaccgcgagccccggcgagctcggaccaccccttggtgcgcacccggagcacaggaaaacaccgatgacgacagagaagcacatcaccggccgccacatcacacgcacgcagcacacccaacggccgaccgacgcaaaaggcccacgcaaaacaggcccaggatcaaccaacaccacaaccaccgacccaagcgccccatcccagccatcggcacaaccaaaccatcgcggcttcgggccagcataacaacacggccccgcggcaccgtcgaaccgcatcaccacgacgctagcaaccacggcacccacgacacaccacacctgacacacaccgctaacgccccccacaagcccaacaccaaccacccgccaccacgcaccaccaccacaccacccaccacacaccagcccgacccacgaccgcgaccaccgacccccaccacaacgaccaaacaccagaccgacacgggcgcccaaaacaacaggaccaagaccagacgcaggaaacaccaccacgcaaccacagcacaacacgtaacacgcgtccagacagaagcgcctgacgccaccaccacaccgcagcacacacatccctaacagacaacgaacagccacgcacccccgcaccaagagcaaaccaccagccgcgcaaacaaaccaaacaacaacggagcaagcacacacacacggacgcaccagcagcaagaaacaagcaccagcacgacaacagcacagacagacagacaagacagaacgagcacagcgagcgacagcagaacgacgaagcgaacgaccgacaacagaagaagcaacacagacaacgacacagcgcagcacgaaagacaacagcagcactagagcagcgaacaacgcgcccacgcacgctacgacgccagacagagcacgcacgcgcaccgcgagcgcagcccgcagccacgacaccgccagaaccagacaagcaacagccgagccacacggcgcagacagaccgccgcgacccgaccacaccagcgcagcacgcgccacaccacgcccagaccaccagaccaccaccaccccaccaacc

SEQ ID NO: 524506 - DNA, 123 bp, Homo sapiens
gaggactcggtcacaagaggaagataggataccagggcagatgagtattatgaatataagcacgtaaaagccaaacggagactattagaggtcctcatcagcaagcaagatccggctgtctca

SEQ ID NO: 524507 - DNA, 135 bp, Homo sapiens
atttccaagttaccagaaatacagcagaccctaacttaacaccctctcactacccaactcatccccctaaattcaacccaactacccaccaccaccacccaccccctacttcctaatatcatgaatgcatttcaa

SEQ ID NO: 524508 - DNA, 611 bp, Homo sapiens
  misc_feature (586)..(586): n is a, c, g, or t
  misc_feature (588)..(588): n is a, c, g, or t
gagtaagggtccagtatatcatgttactgtatttttgtagcttcaatgttattaagaaaagactaattacttgtcaatttaccagaatttaccatacccggatcactcccctttgtattttattgccatgtaatgggatgttctttaaattctctgttgaatgaatgagactaggtctgagtgtacaacaattaaagtgacatcaacattctttaaaccagagttgttttggagaaattcccagagaggctctttcttaagacatgaggctagggaactagatgtgatttagtgtagaagtcctatccccttggaaccaaagcagaacctattattcactaagggtggagtcgacaggaggtaggtgacttaaaccaacaaatatttattaagcatctactaattgtcaagtgctggcaatccaatgagattaagacagatactattcctgccttgtagagcttacagcctggtggaagaattggaaatcttattactagaaataaaggtgagaataagatggaagtgatccccttaccacctcagagagaataaaggattatacagaagaaaactgtaagacttnanattttttgtttataactcctcgt

SEQ ID NO: 524509 - DNA, 512 bp, Homo sapiens
  misc_feature (487)..(487): n is a, c, g, or t
  misc_feature (489)..(489): n is a, c, g, or t
gagtaagggtccagtatatcatgttactgtatttttgtagcttcaatgttattaagaaaagactaattacttgtcaatttaccagaatttaccatacccggatcactcccctttgtattttattgccatgtaatgggatgttctttaaattctctgttgaatgaatgagactaggtctgagtgtacaacaattaaagtgacatcaacattctttaaaccagagttgttttggagaaattcccagagaggctctttcttaagacatgaggctagggaactagatgtgatttagtgtagaagtcctatccccttggaaccaaagcagaacctattattcactaagggtggagtcgacaggagagcttacagcctggtggaagaattggaaatcttattactagaaataaaggtgagaataagatggaagtgatccccttaccacctcagagagaataaaggattatacagaagaaaactgtaagacttnanattttttgtttataactcctcgt

SEQ ID NO: 524510 - DNA, 838 bp, Homo sapiens
  misc_feature (78)..(78): n is a, c, g, or t
gaagcttgaagccaatatggagtccgtcagttgctccgctgctgctgtcaggaccggagacatggagtccaggggacntgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggacgtggaagagcttctggagcgcgcggagtcggcacgacgcggctggacggaggcggcctctcggctccacgggctgcagaaacctaatcaacgactcagcttttatcttcctagccgccttacgacctgcctgccccaggacaacgaggcgctgcccgcggctgcaggcggacttggccgagcggcgccggtgggctgcaagcccaagaagacgtatacgcctttcaagaccggtagaaaggatgctgcttcgtctaccaaagtagcacgcggctcctggcatccccatcggaagttgaaagcatacacgactccaccgaatgaccaagaaggcggcaacagagacctcggacacagctgagtcctgcggatactccaaaacatggagtcccagagctctatggaaaaagagacgccaggagaagttggcaacaagcgacgacgtacctatatggaccagaactgagcaactgcacaggtcagacctgtatggaacatcgcaaccaccctggggctaacaaaggcacacagctgcagctgaactgcgaagtcggatgatacatacagtttacatggcacatgacgagacttgtcccagccagggcatgcaacgcc

SEQ ID NO: 524511 - DNA, 105 bp, Homo sapiens
cccgcttggactgcatggctctctattctctaaaagaagtacaacgagagctattcttactctcgataaccagtcaggggcacaaggtcggctttgcgcattcac

SEQ ID NO: 524512 - DNA, 436 bp, Homo sapiens
  misc_feature (110)..(110): n is a, c, g, or t
  misc_feature (315)..(315): n is a, c, g, or t
  misc_feature (343)..(343): n is a, c, g, or t
  misc_feature (393)..(393): n is a, c, g, or t
  misc_feature (425)..(425): n is a, c, g, or t
accaggacaagaagaactcacttagaccccctcattcctgattcctgagactaggatccagctccaccagcaaggcggaagttactctggcatgagtacgtcaatgcgangtagtaaaaacaaaccacgatagcgcaggaaatatgaaaagcaccctttaaaaaatatttactgttactgctcgttctttatccttagtattccttcataaaaaatagtagtttgattccaacctcaaagtagcaatcaaaaaaaagcattatcagggaagaagataatcaacgctggcaagggtgcatcttgaataaccataanggctcacaaattagtggcagcaccaagncacatttattggaatggtgaataaattcttacacactccaatcctgtttnctattaactaatgttttttaaattagttgggngccatcatccc

SEQ ID NO: 524513 - DNA, 106 bp, Homo sapiens
ggaccttctttttctttataaattatcagtcttgggttatctattatcacagtatgaaaatgaactaataggctgggcgcagtggctcacgcctgtaatcccagca

SEQ ID NO: 524514 - DNA, 305 bp, Homo sapiens
cgcgtcagcatcccaggcaggtgtcctgctctgggagtgctccgtaggcctggccctggcacctacctgctccttccaggcaatgggagtggagggtgcgaaggaggtccagtgaaagagagctgtgcccaggaagggctcgcactatctgggggcgcggggctgtgggtagggcgctgcttaggaagagagaggaggaggagcaggcctggagggaaatggagggaggccagccttagccccagtgctgggaaattaggagtcaagcgacaaacctcgttagcgaggagcgcgccggctgcagg

SEQ ID NO: 524515 - DNA, 100 bp, Homo sapiens
cttcctgctctgccagtggtcttggtgaggagggtcttggtgatggggcagaagcaggaagcagccattttgttaaagcaggaagggcataagcaggaag

SEQ ID NO: 524516 - DNA, 756 bp, Homo sapiens
ggagtgcggtggtgcaatctcagctcactgcaatctccacctcctgggttcaagaggttctcctgcctcagcctcctgagtagccggggagctacaagcatgcaccaccacacccagctaatttttttttttttttttggaagaggagtctcgctctgtcgcccaggcttgattgcagtgggcgcagatctcggctcactgcaacgctctgtctccggggttcatgccattctcctgcttcagcctcccgagtagtcccaggagtagctgggactacgggtgcccaccaccacacccagctaattttttggtattttagtaaagatggggttgtccaccatgttatccaggatggtttggatctcctgacctcgtgatccgccccgccttggcctcccaaaagtgctgggattataggcgtgagccaccgcccgggcaaattttggtattttaagtagacgatggggttccaccgtgttggccaggatgggtctcaatctgaccttgtgatctgcccacctcggccccccaaagtgctaggattacgggcgtgagccaccattcttagccttaaggccatattccttaaatatacaagggtagattggttatgaaaatggttgggggctctaataacctaccttttaggaatgagaaaattgcgtgggctaagggaagttcaagtatgaatcaagattgaaccattcaaatgtgggtggaatctgaatatttcaaaggaggggaactttctgaaaa

SEQ ID NO: 524517 - DNA, 100 bp, Homo sapiens
  misc_feature (56)..(57): n is a, c, g, or t
gggaaacacggagagttgcttctgccttgtttggatgctactaatatttgggtttnncctctctctgctgcctgagacttgaccgagccgcagtacccag

SEQ ID NO: 524518 - DNA, 310 bp, Homo sapiens
gttgtcccactttaagaaatcatcggtggggcctggtggctcatgcctggaatcccagtatttgtgggggccaaggtgggccaatcacttgaggccaggagttcaagaccagcctggccaacatggtaaaacctcgtctctaccaaaaatacaaaaattagccagacgtggtggcacgtgcctctaatcccagctactcaggagggtgaggcgggagaatcgcttgaatctgggagggggaggttgcagtgagctgagattaagccactgcactctagcttgggtgacagagtgagacttcaccaaataa

SEQ ID NO: 524519 - DNA, 704 bp, Homo sapiens
caattcctcgtgtctatcctcctacttcaatgtgcaccaaacctccccaaaaatttgttatatcctccaacattataaaacgctgcccataattaatatcggcggacccaaaattatcgaagaatccacaccgctgcgttgttacgccccctaattactataagaccacgttgctctctataatgaattattagatactacccaccgcccaattttttataaaaaacagagtgttactataaagattttaatcagcaccccctgtacgccctctctctctctttgtataaatatatacatacaccgtttgcacatgctttattataatcacacgcggacgacaatataatatattcctgtatgcattgatcaataacaacagagttcttctgttacacccccgcacccacgctgatgtaacaattcctccgtcacgtagaacacccctctgcagtggtagaaaaatgttttccaaaccctctgtaaattattgtttctcacatactctatacccattctccctttttcgtgtagggctcccccacaccaccactatttttccccaagtgtgtgtaccgctcaatatatgttttgcctccacttttcacgcccattacccccatatatatgtgagcagaacacacccttatatatatgcaaaaatatcagtactcttcgcaccacatcaatgatacaagacaaat

SEQ ID NO: 524520 - DNA, 523 bp, Homo sapiens
  misc_feature (12)..(12): n is a, c, g, or t
  misc_feature (38)..(38): n is a, c, g, or t
  misc_feature (78)..(78): n is a, c, g, or t
  misc_feature (92)..(92): n is a, c, g, or t
  misc_feature (102)..(102): n is a, c, g, or t
  misc_feature (472)..(472): n is a, c, g, or t
  misc_feature (484)..(484): n is a, c, g, or t
  misc_feature (490)..(490): n is a, c, g, or t
  misc_feature (501)..(501): n is a, c, g, or t
  misc_feature (517)..(517): n is a, c, g, or t
ccacatcggtancatcagatagggctttccatgttganttcattagacccagtcacgttcctgtgactcttgtcaccntggatgccatggcngcagcaaatnagataatgtttccccagatccagtctgagctactccaaccatatccaaatccactgagagcaactggccagccctgagcttgaatagcagtgggttcagtaaagttctgccttgcaatcacatccatgacattcgcaggaaagtttgcttcataaaaattcagaacaggttttggacagttgtgacctctaactgtaatttccttgcttcttctgtatgtatctacctcttgtgcggtgcgccttgccaaatcagggtgttcttgataaaaattcttctcaaatttgggcagctcatcaagattccacttctttttaactagtttctccccaggatttccaaacttctttccagagaggggtcctgttcnactccctcccanatccgngttgcaccaanccctcgattcccggcngcggtc

SEQ ID NO: 524521 - DNA, 176 bp, Homo sapiens
tctagcggatgcttataaatagccgacggggcgtgcagaggagttgtctttaggttctccgagcggaaaactcggctccgctcatcttgccttgaaagccagcggggggaaatgcgtgtcctcagttagcattagtccgcgtgtttcttgccgatggagcgcgctggggattattt

SEQ ID NO: 524522 - DNA, 672 bp, Homo sapiens
  misc_feature (482)..(482): n is a, c, g, or t
caacattgatgccacctgtaaaggaggctcaccttgaaaggattatgtgactccctagccataggtgcagaacagagaaacggttgcattctcattagacatttgagtacactctccacaggaggcaagcaccgatgaattgagctctaggagcacagggcctactgtaatacaatgaccgtctggagatccctaaacaaggtcctggtggactacatctttgaacgttgatattccagccgctcctgagatgcttgttctgccagacggaccgcacccaggctatgattacagctcaatccatgaggcagatggtcactcatccatcgagacattggcttggatgatgctgctccacagattctcccagaaacctggcagtgctcacccttctcagatccgtgcatccgtaagtgtcagctcacaggcgcaatagtcaaatgcaatgttgagcagctcagaaccatctacatgtacagtgngtttctacagtgcccagctacatgtagcactcaagagtaccgtcactgatgtcactctctcacacattatctgaaagacgcccgttacatgtaactgccactcaagtatttatgcgtcacgactgcttgtatttgcaatacagcttacgttttcaagtgagccgtcaatggaccacttgcgctttggtct

SEQ ID NO: 524523 - DNA, 181 bp, Homo sapiens
tatctgggagatggagatggagagcttgtcagggggaggtggttcctactgaatgaagaagcctaaggacgcaggcctacaggaagagcttgaggatacggggagcagggtctggaggctgcccgaggagggccattgggtgatcttgttttccaacttttgttgcccaaggtgactacag

SEQ ID NO: 524524 - DNA, 708 bp, Homo sapiens
attctagaggccgaggcgggccgacatgtatatggtgtgcattatccaagaaaggaagtttgtcgctgatggatcttcaaagctgaactgaatgatacttactcgggagctggctgaagatggatactctggagttgaggggtgcgagttacagcaaccagtgacatgaaatcattatcttagccaccagaaaccacatgaatgttcttgcgtgagaagggccggccggattcgggaactgactgctgtagttccagaagaggttggctttcctagcagggcagttgtacaggcttttattgctagaagaaaggtggccacttaagcgtctgtgattgcctatttgccctagtgcaagaggtctctggcgtgacaaaacgtcctaagcgaggggctatgcttgatgccggagaggcctgcttaatgggttgtgccatggcggtctccatcatgagagaatggggccccaaggcgtgccagaacgtttgtgccggtctgggaaaactcccgaagggacagcagggcttaaaattcccatgacaggttcggtggactgggcctgtattgattccacagtgggaggaacctttgtttaactaatctaacgtttgaccacttgcattggtgcgccccgtgttgctccagaacaagagccggtgccggggcatccagggttggacggatcttggctgggcccttgtggacgca

SEQ ID NO: 524525 - DNA, 964 bp, Homo sapiens
tgaccaccgaggcactaccagagatgttatccacaccaggtcgaactgtgtggatattagcttaacatctacatggggtgagattgacttttgcaaacaaaagggaaaagcatgcactagaaaaacagtacaagtaatgaccacaaaaacatcgctactgactgaaatccagctagctaaacagaatcctcagcatcactgacaggaagagcactgaaacactaggaaagaagttctggctgcatttcatctgagggcaaatccccaggcttaggcttatgacattggattcagcggttggagcgtctatacacctcttgtgtgatccttgataccagcaaactggttccaaatcccaggagttatcctcactccaccatggactcactgtagttgtagcacatattagtattcccagtagttaaatgctacctgtgcagctgacatcactggactagatctgggaatagatgaaataatgttgacaacaacaacttaagcaggtagccttctggtatcagcatgctgcaaggccttgcacgcaatccagagtgtgtccacgtcccatctactgtatcaacggccagagtgtggctaccatgctcttacggcacaggggtacacccaatacacggagaccaagaggacccaacagcgtaacacactaacccctaatactgctaatgcaccgaaaacatgtaacatctggcttcccccagacacaggctcacacacaactgcagaacgacacaagtgtacctgcgacaaaaccccctatcaccaggcgtgaggaccaaaaccatagacacaacaaataaacagcaagaaaaaatccaacacgcaaaaacgataaagaccacactgcccgacaacacatgagcgccacaagacccaaaaacatcccagccaaagacaacaggacacgaaacgcagcaacacaccgcaaactcagacacacactaaa

SEQ ID NO: 524526 - DNA, 873 bp, Homo sapiens
ggggagtggcgtgctgggcgtgcagcggactgcgtgtacggcgctgttggatcccaggcgggttcagctgatgagtaggtgacgctgcctgtaggccgcgaatagttatccggcgtgtttggatctgtggatgaggaagaggatcctgcggcgggaaggattgtactgaattggttcccatctgagacagacgcaatacgcgaggtggcaggacaagtctggtcctcggtgccagatgatcccagtcacaattgatcaccgggtattgaggtgctgggaagatagacacttctgaactatgattcctgacagagcggacctagtaaacagagtagggggtcatttgaaagtgaatctggggaagtgaagtgcggctggggaaatcactatagctgtctagcgcaaggtggagagctctatgaagagtggctggaatttatgaaacggttgcctcgtgctgtacagtgaagggacaatggtcttaagagcgtatgtgagaatatgagtgccgaaagaagggggaaagtcgagtgagcatagtggttaagaggactcactgggattacgcagatccgtgggtgtagtgactttctatgtaaaggggttgactgcctgaagttaggagagttgataattatctttgatgggcatcataaactattaggtggaagtcaaaaatatggatttaagaacattttaatcaggacagcagctaacccctgatgggcgcttattcgaatggaacgctacctaaggccaaggtaggctttagcaggagtattcacttctccatttatacacatgtgtgactgggttccagaaacgaacgattgttgacgacattcaagaagggacaatttaaatccatacatg

SEQ ID NO: 524527 - DNA, 923 bp, Homo sapiens
gtgcaccagcccagtcagattaacatccaaaggactgaaccctgaacagagttaagttaccttttaagcatttgtggggccgcgggggtggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaatggattttcttacatgcaactgaatttctgcttacacatttttaaatttcttttaattgcttttccaatgcaatagcatgaattattattctgttgacctattgccttactatgagctgagggtagttcaatatgctcactctttttttttttttctctggagatgaagtttggctctgtccaccaggcggagtgccccgggggaacgaaaagcaccaaacacctcagaaaaccacaaagacagccagtatgaaggaggtcaacacacacacacaccgaacgaagacaggacacccgacagccccacgaacccacagaacgaaggaggagacaaatcgacccaacacgacacaacaatgaagacaaacgaaggagaaagcgacagccaaaacgaacgacacacacgaacacaaacaggaaggtgaaaacatgaaacaacaagaacacacgtaagagaggaaaaacacacaccaagacaggagccaaccgaggaagaaagacatacaagaaaacaacaggaacaaagcgcagacaaccaaagagggaaaaggaaaaaagaaga

SEQ ID NO: 524528 - DNA, 938 bp, Homo sapiens
  misc_feature (2)..(2): n is a, c, g, or t
  misc_feature (108)..(108): n is a, c, g, or t
  misc_feature (112)..(112): n is a, c, g, or t
  misc_feature (116)..(116): n is a, c, g, or t
  misc_feature (163)..(163): n is a, c, g, or t
  misc_feature (172)..(172): n is a, c, g, or t
  misc_feature (182)..(183): n is a, c, g, or t
  misc_feature (190)..(190): n is a, c, g, or t
  misc_feature (333)..(333): n is a, c, g, or t
  misc_feature (352)..(352): n is a, c, g, or t
  misc_feature (354)..(354): n is a, c, g, or t
  misc_feature (356)..(356): n is a, c, g, or t
  misc_feature (369)..(370): n is a, c, g, or t
  misc_feature (378)..(378): n is a, c, g, or t
  misc_feature (401)..(401): n is a, c, g, or t
  misc_feature (409)..(409): n is a, c, g, or t
  misc_feature (412)..(412): n is a, c, g, or t
  misc_feature (420)..(420): n is a, c, g, or t
  misc_feature (429)..(429): n is a, c, g, or t
  misc_feature (451)..(451): n is a, c, g, or t
  misc_feature (457)..(457): n is a, c, g, or t
  misc_feature (469)..(469): n is a, c, g, or t
  misc_feature (526)..(526): n is a, c, g, or t
  misc_feature (871)..(871): n is a, c, g, or t
  misc_feature (916)..(916): n is a, c, g, or t
gnaactacgtgtttagcagcagagctgaataattatgaatataaacaattactattgggagaaaatacattacactcattgcttggaaccatgaataatacttatatntgtncganatatagaaaaataaaataggttaccataataaggatataggccattnttttttttnattttttaannccttttntttttccttaccaactggggtagttaggggccctgataatagcttttttattttcttggccccccagccacttacttttgtgttccttcttgcattatctgttcccgatcctagtccagttttcccattcgttttactaagcnagccaaattttttataccncncngggtaaaatcccnncccatgcncctttgtttttggatggccatcnggggccanatncccccacnttaaccccncccccctttgccaccccctccncccgcnaccccccttgcngcgtttcccgccatatgccccccgggttcgttctcccttccccccatcctctgaccngtgcctttgggtctccggcccttgtcccgggggtccctccggctccgcctttccggaggcgggagcggggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttgggtggggnagacccctaagcgccgcagaaagtcccaggcttcagtttccttgntgggtgttgcccttcataaaga

SEQ ID NO: 524529 - DNA, 539 bp, Homo sapiens
atgggacccaggctgaggcaggagaatctcttgaacccaggaggtggaggttgcagtgagccgagatcacgccactgcactccagcttgggcgacagagtgagactccatctcaaaaaaaaaaataaatctggtgtggtggcatgcacctgtagtcccagctaactcaagaggctgaggtgggaggatggcttgagcctgggaggtggaggttgcagtgagctgagatcatgccactgcactcagcctgggtgacagagcgagactccacctcaaaaaaaaaaaaaaaaagaaaacctctttaatcagtacttggctagtgcagaagtaacgggggacacagagcctacctttaaaagcagcatggggaaaatattagccaaagcaacggtgccgggcccggggcttagggcaacctcagagtatccctatcagagggtactacggttatcccattttacagagggggaaagtgagggcccaggtctagggtcacctagtggtgaacagggcacaaagattcaagccatatttagagaa

SEQ ID NO: 524530 - DNA, 764 bp, Homo sapiens
gaacaacacccgtccctcactacaggatcttcactgtgtgactaatagtaaacaaacctttgaaagttagcattgcaaagagtcccattttgtgtcgtaccacactgtgcaaaggagaaattgttgatctctccttccattctctactctcctctcttatgtgacagaatagcaaagtgtttagataattacagatatatgctaagtatgaaccagctgtcgaataagtagtgttggtccatcactgtgtggctaccgtgcacatgtactggctctgtactccagcggcttggatcagctgtgaaccctcgacatgtggggactttcgacagtgtgatctctccaccctgtcttggaaagtccttcataaagccggtcttccttaggcctgggctgtgaggaagtcctggtgaaactttgcggttcaacattgccaatagtgtcctgaatgaccttttcattactcgtctttcgtttatctgtgttctgtgtccttcattccctccttttgttcttcctatcctgcctaatcttttcttcttgtcctttcttctttcttgtaattcgttcctgttcttcctattttcttggtacaagtggaacaaaaaccaagcacatagttttaagctacacctttctgcacctgatgtaaaatgacattaatcactatttaacttctaaaattatttctgaatacagtggagataggctggtttcatgaggaagtgattggtttagtcttcctttaattcttgaaagtggcc

SEQ ID NO: 524531 - DNA, 120 bp, Homo sapiens
cgcgaagctagtcatgtggggtgaaatgcatatttttccaccctttgctggatcactggccttctcttcaaaacgcgtataatagccagtgaagcacacatcactatggagtctctataa

SEQ ID NO: 524532 - DNA, 113 bp, Homo sapiens
ccattggagatgtagcgaagaacatgggagagatgtaggaataacactgctagcagatagacaagcagccttatgaaaagaaggctgcgaagataaaggaaaaatatgaaaag

SEQ ID NO: 524533 - DNA, 302 bp, Homo sapiens
  misc_feature (297)..(297): n is a, c, g, or t
tcattgatttcttccctgatggcactatttttttcccatggagggattgggatttgatttgtttttgtttttccaaggccctaagttgtatcattaagtaaattcatttgctgtctttaacttcttactggaggcaccaatagctgtaaactgcccacttaagaccaccgttcataatttttccatggattttggaatgttgtattttcatttttctctaggactttttaaaaaaaattccttcctggtctcaagttattccgttcatccgtccaagcaatggtggggtgcagtaancatga

SEQ ID NO: 524534 - DNA, 365 bp, Homo sapiens
  misc_feature (33)..(33): n is a, c, g, or t
  misc_feature (147)..(147): n is a, c, g, or t
  misc_feature (201)..(201): n is a, c, g, or t
  misc_feature (206)..(206): n is a, c, g, or t
  misc_feature (225)..(225): n is a, c, g, or t
  misc_feature (241)..(241): n is a, c, g, or t
  misc_feature (245)..(245): n is a, c, g, or t
  misc_feature (248)..(248): n is a, c, g, or t
  misc_feature (251)..(251): n is a, c, g, or t
  misc_feature (255)..(255): n is a, c, g, or t
  misc_feature (258)..(258): n is a, c, g, or t
  misc_feature (264)..(265): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (289)..(289): n is a, c, g, or t
  misc_feature (346)..(346): n is a, c, g, or t
  misc_feature (354)..(354): n is a, c, g, or t
ggggatttaggatgcggtaaggaaaaaaaggcnccacatttaacctttcagacacaaatggtggaagacataaaataactagactgaaaatctggagccacaaggagatgaactttgccaggataagaaaaaaaattactatttaanataacaaacagtcaacactgattacgatcaactctgcccaagaatttgattacnttaanggaaagagggtagtttcantgctctggctgttganaggnggnggntggnggncacggnncngggggngcaccncngngtatgnggggggttcgggccagggcaccataatttaactattccagtggaaggagggcttggnaaccctcnctggggggtaa

SEQ ID NO: 524535 - DNA, 790 bp, Homo sapiens
gggtcgggtggccgctgctcctggatccgtgggacattgcgggagattcaccccttcagcgtcgctagccccagtctcagctcttactgcgggcgctccgagcggggtccatcctgtcaggcactatgcggcgcgaaacatctccttcgccaaaagcaggcgccgccatccggcgcatcgtgtcggtcataggcgcaaatgcgtggcagcgctccagtttgatgagggactaaacacccaattctaaatgcccttggaactgcaaggcaggagaccagactggtttggacggtggcccagcatttgggtgaaagcacaagtaaggactattgctatggatggtacagaaaggcttggcatagaggccagacacgtactggattctggtgcaccaatcaaaattcctgtcgggtcctggaggactttgggcagaatcatgagtgtcattggagaacctattgatgacaagaggtcccatcaaaaccaaacaatttgctcccattcatgctgaggctccagagttcatggaaatgcgtgttgcgcaggaaacttctggtgactgtatcacggttggtacgatcctgatagctcccttatgccaagggttggcaacactgggggcttgtgggggtgctggcagcttggcaaagactggtctggctcatggggttcactcaccactggttgccaagcccatggcggcggacctgtgtttgccgggttgcgccacggaccgcgcacggccacctttttccctgatggcgaagcggggttctcacctaacaatgca

SEQ ID NO: 524536 - DNA, 1135 bp, Homo sapiens
  misc_feature (465)..(465): n is a, c, g, or t
ggtcagtagataagtgcaccagatcctacgaggtgagtaatactatctggcgtggcgcttggatcctgctggcaagaccacatcttctgaagcatgcttgaattcgtgcacgacgagtcacgtccggcaatcacgactctacacgggggctttcgagagcactcgaacacacgtgctacacatcgacaacggtgtgttagaacgtgcagatgtagtggggacgaattcgggtggatccagatgtgagagacattcaggagcacagtacttggtagacgaattgtaattgtggacacagagtagcgcggattatttcatgtattgatgagtgctagaatcagaccagctgtcagtgacgagtaacacaccacgtagtttgtacaggagtggacgggtgtccacggtaatgcctaggcggaactctcactggagagcatagaagagaggactatagtttgatggtgncctaatgctgccgtctatctccttttggtcataaagatcgagactagggggagttttccggctggcaatctagggcgacgtcacccggtggactcgtgcgttgtaccagatttgtcttatgcacattgggaggcttgaaatccgtagtcgaactagcgcgaattctccgtccgcaacaccgtaagtgcgtgtgcacgaattcaccagttctttttgaccttcgatgccttcgtcagtcaagggaaaagaaaggggcctgtgtcaaggagaatgggacaatagaatccatgcgggctctgtggcagacaaacattgatcataattgctatatagggaaattgacacattattgaactcgttaggaatcggaaaattgcggatgagttgccaaagcgaaatgcctgggcccggtgggagcgccgcggataattttgcgagaggttccctttttggaaaacagaggctatcgtaaaaattttctgcatggccctattccttggaagcggctataaaagttgtggtcatatatttcccaaatttcggtaaggttggttaaatcaagcggcgtccactccaccgccaatattgtattttggatcaatgcaacgcagggggcggaaaaccaaaagccatcaggggattttttcacgtacacacttgaacaattcgg

SEQ ID NO: 524537 - DNA, 243 bp, Homo sapiens
ggtgcttacggatcttaccgactagccgactggtgtctcgcattacggacactggctctgctattgtccaccatgtcgtccctccgcagctctacctgcgatggtgctgccaggtgcagacttcgggctgaaggactcctggccctggggagtttgcgcctcctgtctctggcaggcttgccgctgttcaccaccaccgtgctgtcgggctagtcggggacccttgtttggggctagtcgagg

SEQ ID NO: 524538 - DNA, 365 bp, Homo sapiens
cgtcagcaagatagtcgtgtacccaggtcatacatgggaagaacaaatacaactcctctctggaggaaagcagcgaccacccgatattcaaggcattactgaaggccagcaaaacaggaaaacaggtaaaggattctcaggcaactcacaggacataaacggtacatcttgattacgaaataatctgtgtaatacgcgttagaaaatagcctgacgacgtaataagtgctaagtgaacgttagctatgatgatgctggtgacaacaatgatgatttcaagtctttttaattctctcctattaattgatttctcttgctttgttaaaatcacaccagtttaattaacacttgccgaagcttgatca

SEQ ID NO: 524539 - DNA, 132 bp, Homo sapiens
ctgtccactatgcccacctactgagcctctgtccatctgccttagcatgaagccaaagtgctaccagtggacccacaggcctcgatacagaatatgacctacatcgatcactgccacgcacaccatctcatc

SEQ ID NO: 524540 - DNA, 141 bp, Homo sapiens
tcgttagggagttataaacacaagtactttgtgggcttatgggaaggagagaagggataaggagaatgatagagaaggatacacagagttcttttcttttttctgtctcccttttttaaaaaaatagagaaagggctcact

SEQ ID NO: 524541 - DNA, 112 bp, Homo sapiens
tccgcagcgttaacgtgacaggacagaagtgtgaagcctgttgcgcttcccggtccaccagaaggcgcgcgatgtgtgtatcatcgagaaaggagcagaacactgtggacat

SEQ ID NO: 524542 - DNA, 103 bp, Homo sapiens
  misc_feature (14)..(14): n is a, c, g, or t
aacactgtaggcancttgcacagtgacctggagtacacggtgacctcacatgaaggagggcctatgttctgaccttgcagtggaaggaaccatcggagacttc

SEQ ID NO: 524543 - DNA, 180 bp, Homo sapiens
  misc_feature (11)..(11): n is a, c, g, or t
  misc_feature (120)..(120): n is a, c, g, or t
  misc_feature (153)..(153): n is a, c, g, or t
  misc_feature (176)..(176): n is a, c, g, or t
ccttccctggncccccggaggccgggagggagcagggtctccctcagggttgcaggggcaggttgccagaagccccaggatgggcctccccggagggggagggtgggggggagttctgtnccttggtgcccgaggtggggcagccccttctcnttttatacaataaacattctccnccta

SEQ ID NO: 524544 - DNA, 200 bp, Homo sapiens
agagggtggttcaggagataaagctacttctagcatacttaaatagatctctcaagctgtaataagtatagatataactaaactggaaagataaaaagaagcttttacagatatcctacatacttacaaggcacagttccaacagttaccatattccaaagaatataccattgctttctgtagaccagacagtatccttt

SEQ ID NO: 524545 - DNA, 1401 bp, Homo sapiens
ttctatctattcctgtgctgtcctggcaggaccctcagtgacttctgtggggcagtggtgcgaatcatgcatggcctagatgaccccatgcctagaaaaatgtgcacgtgctgtcgggctgtgtgtgctggtgctgcactgtgcctgagtgaacgcagatagctgtcccctgcgggcctgcgagccctggtcaccacgggcgcgaagactggacacagttgacgtccagtgccctgcgcctagctacccctctcctctcgtgatactcacactgatcttgaacacgcacagcctgccccccaccaccccccgccctatacccacgctcccaacgtccacacgctaccagctctccctctgccacgcaccacccagacgccgccccgcccgcgcacggcccccctcggcaaccctcggccccgacaactcacaaaccgctgcgcctgcgcctccactcgctcgacacccacctgcccaccacacgacacgcgcctcgacacaccgaacccgcgccacgcgccactcggcagcagccgaccgcacaccacacacctacaccacaaccactgcacccgacccgccacaccgcccacccatccgcacaccccgccccaccccaacgctcaaccccaccaacaccaccccactcccccaacactccacacccgcacctgcctccacctggcaaccgtggcccaccacacccagccacgccccccccccccccacccaccccccgccagacagccaccgccacccccgccccccctccggcccgcgcaccgcgcagctcgacccacccggcccagcgcacccaccccacacgccccccctcccacttcccgctcaggacccatttcccaagtgaccggccttcccgtaactcaaaggcacctcggcccccctacctacccccaaccaccgcacctccccgtctccctccacctcgacttgcccatcccaagcacagacggcctacaccaccatcctccccacactctccctcctgcccccacgcgacacgcgccccacaccccactccgccccgcaccaccacagcaccccgcccgatccgcacccacccaccgaagcccccaccacccccccacacccccccacaaggcaactccgggcccgctctctccacccccacaccgcgaccgggggtaaacccgccagccaaccccgaacgcgaaacgcgcacaccgcggccagcccgcgcccccctcgcctccccaccggagccgcaccgcgcacccccgccacccccacccccaccccccgccccagcgccaaccgaacctcgccaccccacctacgccgtacacaacccggcacccaccgcacctacacgacagcgtcacacaacgcacccacacccacccccccccgcccccgccc

SEQ ID NO: 524546 - DNA, 184 bp, Homo sapiens
cagtataataatttttaaataaaggtatgtacatagtgctatgcaccacttaatagattacaatagagtataaacataacttttaacaattaaaaaacaatattttttttgggtctttttttagggccacacccattgcatatggaaattcccaggctaggagtctaataggagctgttgttgc

SEQ ID NO: 524547 - DNA, 455 bp, Homo sapiens
gtgttcagtttatctcctttcattgggagatttttttcattagatttattagggaagtatagtattgtgctttagggttgcttaatttgtttttgttttcgtaattaatagacaatgtcaggagctgctaaacctgggtttttgtatagcaggtgaatagaattagaaccatggccaggcgcagtgtcttgcgcctgtaatcccagcacgttgggagcctgaggcagatggactgcttgaatcaaggagttcgagatcagcctgggcacatggcgaaaccccaactctacaaaaaaatgcaaagagtaggcaggggtggtggcacatgcctgtagtcccatctacttaggaagctgaggcagaaggatcatttgagactagaatatggaggctgcagttagcttaggtaaagccgccattgcactctggcctgatggcagtttatccctgtctca

SEQ ID NO: 524548 - DNA, 126 bp, Homo sapiens
  misc_feature (76)..(76): n is a, c, g, or t
acccccaaattagcatatgccagcctgccaaggtaaatagcaaaaactttagactgctcaatctgtaattaaccanaagattccttctaggagatctttaaagagaaaaaaataacgcgggcgtac

SEQ ID NO: 524549 - DNA, 335 bp, Homo sapiens
ggcagtcaatcaaaccagacacttctgatcaccaggtgtttttaccacagggagcaggaagattggaagcttccttaatgggctgaaggacttccacctgtgacggccaaggggtgggtgggcgctaaagcccttaccttcaatgggcaagaatgtcccccacattagggaacaggtttaattccacctggagatgacagacttaagctttgggccttaggagaggtgacaggcccttaggatcttctacttaccctggctggggtgactgccccgctttacaacaacttgttcaaagatagaacgtggtgggtagccaagagccggcttggctt

SEQ ID NO: 524550 - DNA, 249 bp, Homo sapiens
atgactggctttcgattaagacaggcagacgagaataaagaaagaaagaatgaaaatgagtgaacaaaacctccgagaaatcagggattatataaagagaccaaatctcacgactgactggggatacctgtaaaatgatgtcggagacatggaaccacagttggagaaacatacttcagtgatatcatcaacagagaacttccccaagcctagtcaagacaggccacagccacggttcaaccgcacggt

SEQ ID NO: 524551 - DNA, 1501 bp, Homo sapiens
tttattagtatgttagtacaaataaagagaaaaagaccctgcactttcatcaagcagggcaaaaaaaagaaaagaaaaaaaaaaagaaaaaaaaaaaaggggcggggcccgtctgcccgtagcattatctctcactgaagaggtcacatactaggtgcaccgactcccgcacatattaaaaaggcatagaagcaagaggcgctcctctacaatgggagaacgctcttctatatatgataatacctacacacgcaccgctggcccagcgccgctatatcacaaccacatcgagacaagtagtgtgagaaaaagaagcgaaaaaacccagggagagacctctctctacgagcaaccacaaccaacgcacacctctctcatacttcatctctctgcgctgcgccagctgaagagaagcacacacacacacaagagagcacacaccacaacaccctccacactcaatcaacaaccaatctttataatatatacacaccctaactcccatgcaacccacacacaacaatcacaacacacatctgctaaccagacgagcgcagccaacataatagacagcggtgtgatgatcagcaaaaacaacgccagctaggcggcgcactaatacgagacccagacgcgagcccgagacgccacgacgagaaaacgacgcccatatcactgctcatcccacacaaatacaacgaggagaagaaaaaacaaagacaatgacagctcctcactactctgatagaagacaaacaaaaatgactggctatctataaatccgacgccgcgcacgcagcagacgccactactcaacacatcatgaacggctcgaccaatcaataacaccacccaacactggcagcaacctcgcgacgtcaatcatactgctacactcgacaaggcaacgctagcactcacacgaaacagcgacacgcacagccacagagacagcgaaagccacactcgagccgacaccaagacgcgtcacatcacacacagcacacgactacacacacgagagaacgacagccgcacaacaacacacaacacaaacacacccacacacacacaagcatcgaaccaacagcacacaacacaagaaagcgataagaaaagaaacgaagagcatgcggacagccacacctgcatgacggcggacacagggaaccataatgaccagcaacacgacagagaagcagagatgcaacgtgcggagactagccgatgacgcacgcacagcaagactcacgcaaaggatgatacgcaagaggaagaaagagagcacgacgagacgagcatcacagatgtgtcagagcgcgcgacacgcgagctcgagagtgacggtcagctgtcgcgagcgccagcgaacgagagaaacgaaggaaaaagcggcgacgagggagggggcggcagacagcgcacacggacagaccgagacggagagcacggacgagacagtgagctcggcaggcggcctgcaggtcaggaggggcgaggg

SEQ ID NO: 524552 - DNA, 301 bp, Homo sapiens
gcgcacacccagcccgcctaattttgtatttttagtacagatgaggtttctcaagtgttggtcaggctggtctcgaactcccaacctcaggtgatccacccgcctcatcctcccaaagtgctgggattataggcttgagccaccgtgttcggcctcattatattgtcattgtggttaaacacatgcttccttccctatcattcccgaagggaggcatgtttatctccattttgttgatgtgcaaaccgagacctggtaagggaagccccgtgcgccagggtctgcatgcttctctcttacc

SEQ ID NO: 524553 - DNA, 113 bp, Homo sapiens
  misc_feature (89)..(89): n is a, c, g, or t
  misc_feature (98)..(98): n is a, c, g, or t
cctctctaaatccgtgttactaatttgttacgttaaacagctataatctggtattactcaactaataattcatgtacatttaaacatcntggtgaaantttcaaagggatgac

SEQ ID NO: 524554 - DNA, 368 bp, Homo sapiens
ggacgcgtgggtcgacccacgcgtccgctgacactaaaagtgagagaatggagctgggcgcagtggttcacgcctgtaatccctgcactttgggaggccgaggcaggcagatcacctgaggtcaggagttccagaccggctgggcaacatggtgaaaccctgtctctactaaaaatatgaaaaaaagttagccaggcgtccgcgtgcctgtaattccagctactcaggagactgaggcaggagaatcgcttgaacctgggaggcagaggttgcagtgagccgagatcacgccactgcactccagcctgggcgataagagtgaaactctgtctcaaaataaataaataaataaataaataaataatctt

SEQ ID NO: 524555 - DNA, 364 bp, Homo sapiens
tccctccacagcagcacaagccatgaatcttcagctcgttccttatccacgtctcacgctcagcatcgtcctcgaaagcatcgaagtggtcatcactgtcctcttcctgcgcctcggccatcttacgggcggtgagaaggcatgcttcgtagtgatcaccggcaagaacatactgagagtagtcaccttgatcactttgcggccagcgaagggtcacagaaaacagtggttgggtatgttccgcggggatagctggttgagtcatgttattcaccattcaaatagttgagtcgagagagcagcgatcgcaatcgagagacaatgtcagtgcgccagcgcgctggtggaagggagggggatcctc

SEQ ID NO: 524556 - DNA, 480 bp, Homo sapiens
  misc_feature (128)..(128): n is a, c, g, or t
catggtggcagatgcctgtaatcccagctacttgagaggccaaggcaggagaattgcttgaacctgggaggcggaggttgcagtgagctgagatcgcactactgcactccagcctgggttgacagagntaagactccatctcaaaaaaaaaaaaaaaaggaaaaaaaaaaactttttgggcggctttgggccttgggaaaagtttttataaaccatttggtttgggggcggggccccaggttgggttagtgtgttgaccttgtggtcttgagtcgtgttcctaaggcaaatctcgggtcaatgtactagtgtctgggtttctcaacaattaaaaaaggcccgggggggacgaccggaagggtttttgaaaaaattctcagaagggaaagttccgaaggctcatcaagcaaggatctataaccgggaagttcaagggagagctgcgaatttcaatttacgcgcgctgtgggaaaaacagcg

SEQ ID NO: 524557 - DNA, 282 bp, Homo sapiens
ctcggtacccacactcctatagatcagtgatcataaattatccgcatatctatgaattttccaacaaattcctacttcctgattggattggtttttgccgctagatgttcaagtgccagcccagcttcttcagttccaaacaagcaattctgcagtcttttccaacaccactcagtctcagcaggttggaccatttgtccagggtgttcttggcacatcggtgacccagtgtgcaccttttttggttgccagttggtgttgcccttgtcacactccattcag

SEQ ID NO: 524558 - DNA, 786 bp, Homo sapiens
agtctaggtaagagtttgttccctgtggttgcggatgtggtcaattgcccacacccggaaacctagctgaggtaaagttgcgtcttggttgtagatgacgacaacttctccgcttcctcggtgatggcggcgtcctgtggagcggtatggcccgagaaaacctgtgtgaacttggccaacgaacagtgcaggaagctcagagtatcgatgaaatctacaaatacgacaatgaagacatgcagcaatgaaatcctggctggcgaagccctgtgactaagtgatcaccattactttaagtacttgcaaaatctcagcatttgtgctctgctgaagatgtgtgatgcattgccagatacgggagggaactttggtaagtgattgggtcttgatgctaggaaaggtggatggtgaaaccatgatcattatggacagtatatgcttttggctgtggagggcactgaaaaccgagtaaattgctcaggcctgtctgcatattgaagtaccactgttggtgcctatcatatgaaaattgccaaacagtgttgtgccgtcttgagaattgtgcctcgggtgggatcataagcaccctggggtaaggattgctgaggttctgggattgatgttatactccgatgcgccatcagcaggtcccaggaaccatttgtaccagtgtgatttggtccacaggacacatatcgccgggcagtgatcttggtgcttatgaataccaatggtaaacctctgttgaggcttctgtcaaatcctaaaaaacactcggtctgacat

SEQ ID NO: 524559 - DNA, 193 bp, Homo sapiens
tagtactgtcttgtttactagaaagactgtggcagtatcacagtgctttgtacaagtagcccttacattacttagtaatggccccaaagcacaagagtagtgatactggcaactcggatttgccaaggagaagacaaagtgtttcaacgtgaacaagatgaaacgttcttgcacttaactaaacagaacaaaa

SEQ ID NO: 524560 - DNA, 109 bp, Homo sapiens
caactgtcacagcgcgtcaactgcaaagcgcgttcaactgcaaagcgcgtcaactgcaaaggcgcgtcaactgcaaagacgcgtcaactgcaacagcgcgtcaactgca

SEQ ID NO: 524561 - DNA, 390 bp, Homo sapiens
atcaaagggtatgagtcactttttgacaatataaatgctgctgcaaagatgagaggtgaagtaaaaccgatacctgacctgcaggtctaaaatttgaatggaaattcatgcacaagtactggggacacatcaaagtgtggtggatggtttgactggagatgccacgttgaatcatgtgaatctagattaacattaaatagattgagcataattttacaaggatatttttaaaggtgtgatatatgagagactttgataaagagcctagattttgccagacttaatccagcttgacaagattgagaggcccatgccaacagtgtaatctaagagattagcctatcaaacttaccatccagttgcctgctacagaataactcttcttaactt

SEQ ID NO: 524562 - DNA, 177 bp, Homo sapiens
actccgtgccgtgtcgatgtggtatgcctggccagcctctcccctgtacccataattctgcctcttccataatccgtggttcagttgactttgtatataaagtaggggttttctttttttttatttttttttatttttttttttttttcttatttttttttttttttttcccgcgct

SEQ ID NO: 524563 - DNA, 802 bp, Homo sapiens
gcaaaacacatcctgggattccaaatggagggtcttaggcctgtccctgcccgaactgcgttagaggcaaccgaaacttgtgtaaagttccacactcctatacgggttcacactgtcaagtgttgcagcagggccgcgcaaacatccgttgtaagggacaaacaagtctcttcacgccccaatgtgccccgcgcgatcccgccccactatgtggcgacgtaagtgtccccagaaactagattcgcggaacattatcacacagcaatatctctaaattatcgaaatttcgcccaaacctccgtcaatatgaagaagaagaacatcttctcgcccccgaaaatattttgcgacaaatccccccacgtcctcgggtgaaatagccactcctccccctccgagactcggctaccaaagatggtccttttcaaaaacttgagatttcttcgatctgttttcttctccccccgcagtagacaatctacacagatctatgataactcgcctagacgtccccgcccccaaacagacaaaaattctatattatctctaggagcaaacccctctttctgtaatagatatctcacgcgtcatttataattctcataattgccggaacaaaagtttaacttatgtaaatgaaactattatagcacttgctaccactgaacaagaaattttacatcgcttttctggaactaacccattaaaattgagactcgagagaactcacccccccacatacgacaagtactaaaataattcaaacattaacccccctaatcttcttatcaatacaataaca

SEQ ID NO: 524564 - DNA, 155 bp, Homo sapiens
  misc_feature (46)..(46): n is a, c, g, or t
  misc_feature (130)..(130): n is a, c, g, or t
ctggagtggcatatactcctttaggaagaaaagtgacgctggcagncccctgttgatactcagtccccaaatgtgtgtccagttggcccaccggaatttatgtacaattgtgttaccaattttttggttncaaattcttaattgtttggctacat

SEQ ID NO: 524565 - DNA, 495 bp, Homo sapiens
cctctactggtgttgttaaaatatgtacagtggctgcgtgcaggtgtgtcagctgtatcctagcactttgggaggacaaggtaggtggatcgccagcctgggtgacatggtgaaccccgacctgattagtgttcaagacagcctggttcgagacctggtttgagaccagcttgggcaacatggtgaaactctatctctacaaattataaaaaaattagacaggtatggtggcacatgtctgcagtcccagctatttgggaggctgagatgggagaatcactttaacttgggggggttacgggtacaatgagctgtgattgtgcccctgcactccagcctgtgtgacagagtgacagcctaggtgactctgtgtcaaaaaacaaaaaacaagccaggtacagaaagacaaataccacatgatctcatttatatgtgcaatataaaaaaggtaaattcatagaggtagagagcctggcaaggtagagagcctggcaa

SEQ ID NO: 524566 - DNA, 162 bp, Homo sapiens
  misc_feature (45)..(45): n is a, c, g, or t
  misc_feature (52)..(52): n is a, c, g, or t
  misc_feature (77)..(77): n is a, c, g, or t
  misc_feature (157)..(157): n is a, c, g, or t
ctgccactgccacagtagctcaaccaagcagttgtgctgagaatngcacctngttgagagcctgctgtgtgccaggntttgtgctgagtgctgtacgtgtattagttcctttactgctgaccacattgtacccatttcacagagaaggagcagaganattaa

SEQ ID NO: 524567 - DNA, 818 bp, Homo sapiens
ggcttttatctcaggttgcccaatggataagtacattactttttaactctatgcctgattgaccaaggtaaagctgaaagagtctcatctgaactataacccaagtgggtaagccagtcccttggcactgcccaggaagaagatatggatgggaggactactccttcttgaatgcacgaggatacaagttatctgggagctcttttacgattgtggagaagataggagaacgtgacagaacgggaagacgagaaaaaaacagagaagaaagaccaggacaaagaagcataagagggacaagtagaagaaggaacaggacaaggaaccacgcaacggaaaacaaggatacgctgtcctcttttgactagtaggttcaaccaactcttctttaccatggaagggatttcagtaggaccaaaggcttttcccatgaaatagtaattatcttgataagaacctagcacattgttaccaagctccttaaatttgattccctcaaaaggaagaaaagtgtattctggacaatcctctgaagatttcccagagtccccccaaagaccagttgctatttctaaccagggagagaaaagccagagtctctttgtatatatagggttaggaggcaaagtaaaaatttctccttccccttttcccacaaacctgaagcagaaagtttctcctggagattcaaaccagtaaaaatcagccatataatcgaattagggctcccgggagaagtcttaattgcaacggggaagctctcactaatcaagcaggaaagaaaggctgagaataaaaatcacatacgggaatcaaag

SEQ ID NO: 524568 - DNA, 87 bp, Homo sapiens
gtggacacagccacatactactgtgcacacagacgggacgattacggcagctcctaccgttactggttcgaggcctggggccaagga

SEQ ID NO: 524569 - DNA, 182 bp, Homo sapiens
  misc_feature (65)..(65): n is a, c, g, or t
ctcgattcggtacccggaaagtagctgtactgtaaatggtatttaaaattttcatggttcaattnattgtggcaagtattatagaaaaataattgatttattcttgttttctcttttctttcttttttttttagactgtgtcttgccctgttgcccagtctggagtgcagtggtgtgatctc

SEQ ID NO: 524570 - DNA, 1068 bp, Homo sapiens
cttgaagcgtccgacgtgcccgtggttgagagctgattggtacatgtactcagcctctcgaggtaggtgacatacagagctatgcccacggtcggtgtgattgcagatccttctgatctgtgggataatgccagctactgtgtcgtgggtaacaacgtgattctagtgccctgaaacatcccctgtaacctgaggattaccaggatttgacttctataaggactcttcgagcggtatggttgcaggcaagcaaaacccggagagaggtaatgtagcgtaaggtagacaaaaggcagtgagaggcatggacttatactcagaggagtgtagtgaaatatgactaaatgtgggcatacgaaattacttgtacagggagggatatgggaaaatggcgtggaagcactgatctagaggaaacagtaataccagaggtattgtgtactgtgtgggagaattcttatgtctaccgtggtgcatactctggacaggagttttggactgttgcttgatttgaacaattcttatcttgagactccgagagctcaagagatcctcctcagtctcccaagtagctgagattacaggtgccaaacacatacctaagttatggcttttatttttaagattgtggcatatgtgtggcgggcttggtggtcacgcctgttatcccagcactttgggaggcaagtggggtggatcacgaggtcaggcgatccgggacagctggcaaatggtgaaacccgtctctactacaaataccaaaattgaggcgggtgtgggggctgggccgtggtccagctcacggggaggtgaaacaggaggtcactgaaaccggggatacggaggtgcgatggtaccagaaacacaggggtttgcctgggagaatgggaatctcacgaagaaattaatagatggtacaaaaaacataaaataaataaaaaaaaaacaaaagaggggggggttataagcgggcgagacaccttataagaaaagatgaaaaaaaacgcagagaaaaagcgatgagaatttgtggtacaaaaaaattattttttattgactaatatgagg

SEQ ID NO: 524571 - DNA, 460 bp, Homo sapiens
atacacatcttgctgccccacacccgcaaataaatagtgtagtggtgtgggcttttggagagtacagagttacagcttcagagtttacagggcttatatgtaagtgttatttttgggaaaatattttatatcagtggtttgggaatttgctgcaccaaaatatttcccagtgcccttccctcagcacagcccgctgcttctcttcccctgccagctaggtctgctttaggcattgttttcttccttcatttttgttagattgaatgaactataagaaattaccaatatttcatcatatttgacttataaaaacattttcatatggtttaacataattgttctttttttttttttgagacagagagtttcactctttcacccaggctggagtgcagtggcgcaatcttggctcactgcaacctctgcctcctgggttcaagtgattctcctgcctcagcct

SEQ ID NO: 524572 - DNA, 152 bp, Homo sapiens
actgatagccagcccagaactgaagcgctgcggcatggcgcgcgcctgccaccaggccgtcaagatacctcatgtacgccttcaacctgctcttctggaacttcctgctgctgctgctagtgtacctgctggaggccaccgtcgcctacgca

SEQ ID NO: 524573 - DNA, 166 bp, Homo sapiens
  misc_feature (1)..(1): n is a, c, g, or t
ncggggttgggggggaaggcccccccccttttttttatttgtggggggggggggccccccttttttttttggggggggtttggttcccaggccccccccccccccccttttttttttttttgggcccctttgggggggccccccccctttttggggggggggggga

SEQ ID NO: 524574 - DNA, 294 bp, Homo sapiens
gctcgacgaataaaattagaataacttagcagaacttccgaaatgacagaagttaaattttcagtgtccctaagggtcttgagcatttaacctcacctcacatatttccaaaggctttgattaaagtagttcaaggaccacagcttatggtgagcagatcagaggcctccagcatgctactatttaattcaatttcccttctgaaacactaggtactaaaaagtgccgggtgacatttagaaactacaaaactctgcagttcaattccatggactccttcaatctggcctgctt

SEQ ID NO: 524575 - DNA, 704 bp, Homo sapiens
ataaatcagtcttgacatgcatacagttgagcactctccccagagggcatcgcgtcacctgactactctcacacatctgggtcttgctccgagaatcctacttagattcaccttctctgcaactacaattggtgctctggatgaatcctagataataatgtatttgaatgaccaatctccaaaacctgattaggctatccctttgagacgtggagactcttgacagacagaggctttcaatcatgagctgtcgagaactgtccactcagtcagcattccacctctagattgtcgctggggggccttctttcatcatacagttcttaaagatgcagggtccatatcgtgccatggtctgatataaatctgctggtcgcgcacacactgttgcaataaatagactgccattaatgtttcttatctatatctgtatctatttatgtagatattggtatatggcagatttataaaaattgcattatgtgtttctgctaatagaggaatcatagccatttgagaattttttttaaattctgtagaaaaggcttatataagttttctttgctgaattggatggatgttctcctgtagtgtgatctgatatgccagttgtgttaaaacatttgcaacacattatgaagttattaaatttaagggacagaggtagtatagttagatatactttctcttaggaaacaataatg

SEQ ID NO: 524576 - DNA, 215 bp, Homo sapiens
atacagccaggatgatcagaaagcaccccggtcgatcaccgagggtaccagtcccggtcagacagcccccgggggtcccgagtcttcacggagtcagagaagaggccactcagcatccaagacagcttcggggaggtatccccagggggcccccggccccgggtccgcctgggctcggagatccgggactcgggggggcgtggcggatcatccaa

SEQ ID NO: 524577 - DNA, 260 bp, Homo sapiens
gaggatcccccagtttcctgccttcttgaaagccttttcctccctgtcgtcaccgaggtcgctcgcgtgagagttctccgctcgtctccgatcgtcatacgccgctcgtgatgcgctacgtcgcctcctacctgctggctgtcctagggggcaactcctcccccagcgtcaagggcatcaagaagatcttggacagcgtgggtatcgaggcggacgaagaccgggtcaacaagggtttcaagaagcaggaactgggggta

SEQ ID NO: 524578 - DNA, 1038 bp, Homo sapiens
ggccttctttgtctctttgatctttgtgctttaaaatctgttttatcagagactaggtttgcaacccctgcctttttttgttttccagtttcttggtagatcctccatccctttattttgagcctatgtgtgtctctgcacatgagatgggtttcctgaatacagcacactgatgggtcttgactctttatccattttgccagtctgtgtcttttaattggaatatttagtccatttacatttaaagttaatattgttatgtgtgaatttgatcctgtcattatgatgttagctggttattttgctctttagttgatgcagtttcttcctggtctcaatgatctttacattttggcatgattttgcagtggctggtaccggttgttcctttccatgtttagtgtttccctcaggagctcttctagggcaggcctggtggtgacaaaaatctctccgaatttgcttgtctgtaaagtattttatttctccttcacttatgaagcttagtttggctggatatgaaattctgggttgaacaacttgttttctttaagaatgttgacatattgcgccccactctcttctggctgtagagtttctgccagagatccgctgttagtctgatgggcctccctttgagggtaacccgactttactctctggctgaccttaaccatttctttccttcattttaaactttggacaccatcacacggccagggtacgtccaacagaacctgcagctgaggttcctgtcctatcagcaggcaaaactagccaaacaggaaaggacatacacagcaaaagaggaccacatctgcgtaatattcaggcagtcatccaaacgagacccaacgctaagaatcaacatcaccaaagatgggggaacaacacatgcgagccacacacaacttgggacaactccataagaaacgcagcgatggccttacctaccttcccatgggaacggtaagtaccacaccagagcagagcaaccaagctgaaaggagaaatgcctttgagacagtgagagacaac

SEQ ID NO: 524579 - DNA, 136 bp, Homo sapiens
ttatgccttaactgagctgcctaactgagcgtctgtaactgatgctgcctcctaacactgtctgtaagagcgcttcctgtaactgatgctgccccgagcgcttcctgtaacgagcgccagaaaaatgactggttga

SEQ ID NO: 524580 - DNA, 273 bp, Homo sapiens
  misc_feature (87)..(87): n is a, c, g, or t
  misc_feature (194)..(194): n is a, c, g, or t
atgttaagttagcaatgtctcacctgccagatctcttaaacatgagaaattttacacatttttataaatagtgttatttattttttncttttttttaaaatagagactgagtttcaccgtgttggccaggctggtatcaaactcctgacctcaagagctctactcgggaggctgaggcaggagaatggtgtgancccgggaggcagagcttgcagtgagccgagatctcgccactgcactccagcctggggcaacagagcaagactctgtctc

SEQ ID NO: 524581 - DNA, 355 bp, Homo sapiens
acagattcccctgcggttatctagctttgctgtgtgttatgcctgcttagttctgcctggattgaaagtgtccatccacgttctctgtgtggtccccgtagtgtcctacttagggaggctcaggtgctgaggatagactcatgctgtgtggtcgatggagagcagtctccgcgaagctcatctgtcgccttctccgccttcataactcaggggtcatggcccttcctgatcttctgtcttgaatctgtctctgtgccgttctgaccgagccactatagcctatctaagctccctccagccttaagccttggattctacagtcattggggcgaagctagcccattttttgccctgg

SEQ ID NO: 524582 - DNA, 251 bp, Homo sapiens
  misc_feature (66)..(66): n is a, c, g, or t
  misc_feature (120)..(120): n is a, c, g, or t
  misc_feature (140)..(140): n is a, c, g, or t
  misc_feature (234)..(234): n is a, c, g, or t
cggccccggaggctctcggcgagcgcggcgggttaacaagtgggcgaggatgccgtacgagatcangaaggtgttcgccagcctcccgcagtggagaggggcgtctccaagatcatcggnggcgaccctaagggcaacanttttttgtacaccaatggaaagtgcgtcatcctaaggaacatcgacaacccagcccttgctgacatctacacagagcacggccatcaggtggtngtgggccaagttatgcg

SEQ ID NO: 524583 - DNA, 868 bp, Homo sapiens
  misc_feature (115)..(115): n is a, c, g, or t
gatcatctatagtaccccaacagtggtcagtctacagaatcctccccatggattcatcgctccaggataaaattatgcccatctgacgaccagcctagctctccacctcctcttngagtcacaagtactctctcctattcccttaaacttacccgcatccctgaaaaagaacaataacccctgtatacctttatatttacagtagacctttacacagtcaccccatattaaaaactctgtcatacttatgcccctaatcaccattctcacctacttcataaatgccctgtttgggtctatactgccagttcacggcttttcctccagaccaatggtagctgataccctcatggagtcacccttcagttgtaacccttaaactctctctaagagtgatagatgaccttctgtggcaaaagtactctccaattcttccatcctgaatagaagttctttctctttaatacttactcttgtgtcttactcccgttctcctgccaccctctatccctccctaattatctccagaatacatcaactcacccattccctcttcacatctcaatctttcctattgcattccctctcttcctccttataataaaggtgtccttgccctgcaagcccattggggaatttccccccattgccctatacttcaaaactctttcaggggcccaatttaacctcctgacaagttttattcctagaaaattaggagaatcccttggtactctacaaagggggggtgctccaatacagaattatttccaggattccgacctgggtgggctctataaaataccctgggcttgtgtccacaaggggctcgtgcccctttcttttccacggcgcaatggttggtaac

SEQ ID NO: 524584 - DNA, 768 bp, Homo sapiens
gcttgtacgatggcggcgcacgagtggagcgcgtagggccccgtggatccgggaagcggcaaggttgcgggagtctcttcactctcgtctcaaagccatatgtgccgtggccgtgctctacggcatagatgcccggagattagtggaaagctccgattccagaaatgggaagcaagacatgaatgaacggtgcctgggtgtccacaaacgctgtgcaactggagagtgcaacgaaatagtgcggtgttcgacacgggggagctgcatgggagtccacacccaaacggtggttgcttagggcactgagccggagtaatttctccaccaggacaagaacctgtgttggtctatcaaatagtgccctacggtctcccttgtgctatggttgtccctgggggtcctagctctgccatcatcgtgattggtagctacctatccgtgggacaatgatgctttcatgtggcacaaaggtgggagcccttgcagatttgtgtgccaccggttttggacagaaggaacccacgaggtgtatagatggatgttaggctttggggaacaatggagcagtgggcatcgattccaaagtcccaagattgttgtttagaaacctcgttcagcgtggatagaaatgagcgtactgtgagccatcaattgtgcattgttccccaatgccccttctggcactggaaaatcgctgggacattgccccattggttgaaggcattgaagggaggcaaggcaccgttttgtaaccacatatatgacgtg

SEQ ID NO: 524585 - DNA, 245 bp, Homo sapiens
tcctcttctcatgcttgagcttccctgtttgcacgcatgcgtgtgcaggactggctgtgtgcttggactcggctccaggtggaagcatgctttcccttgttacggttggagaaactcaaaccttcaagccctaggtgtagccattttgtcaagccaggaagggcattgtggtactggcaatgacaccaaaagcgtaggaatattgtaccattaaacaaaaataaaactataaaaggaaaaaaaaa

SEQ ID NO: 524586 - DNA, 221 bp, Homo sapiens
aggtgaggtgtcacatgaacagtcacaaggttcacaaatctggggaggagagcttattatttagacggagtcatcagtctgttgcccaggcgggagtgcagtggcgcagtctccgctcactgcaaggctccgcctccgcgggttcaggccattctcctgcctcagcctcccgagtagctgggactataggtgcccgccaccacgcccggctagttgttttt

SEQ ID NO: 524587 - DNA, 342 bp, Homo sapiens
  misc_feature (70)..(70): n is a, c, g, or t
  misc_feature (119)..(119): n is a, c, g, or t
ggcacgagatggtgaagaaactccacacagcaacaccaccaaccttcggagtagatctcatcaatgagcntggtagagaattttggcaggtgtccaaaatggtctggtcggcaagcccnttgtctttgtctgccagactgtcattgaagacgactgcctccccatggaccagtttgctgtgcactttgatgccacatttgctgaccttggcaaatgacagggttcccaatgttagagtgctgcttgcgaaaaccctgcgacagactctgctggagaaagagtacttcttagcctctgccagctgtcaccaggaggccgtggagcagacaatcatggccctgc

SEQ ID NO: 524588 - DNA, 1050 bp, Homo sapiens
  misc_feature (572)..(572): n is a, c, g, or t
agcggagagcgagatagcaactgcacatcctagaacaccgagtgagggtgctgaacgctggcacgctcaccgggtctctggcatctacaatccaaccgttcatcacgctgctcttcctgccccgccggagccggtgcgagcttcgttcaggctgacggagcagccccgtgatggattacacgcttagtggatgcgaccgatgcgcacgggctttaagagagctgcctccctagtcttgaggttcctgcgaagctagcgtgacggccagcactgtgcttggtgcgtgaagcgtgtcgctctcatcgagccgggtcgcggcatgttgccccgagctcgctcggggtcgaccgaattgactccgccctggttcgcgtcgatctgctgccagccttgcgtcggacgacacctcacgttgtccttgttgcttggatcgcattgtaccacattatccacggacggacgttctattccattgagtgccggggaggccagcgaccctcgttcccgtcggtggatctcacgacgtcttggcgcgcaggagttccgacgttttgacccgtgcaaggctgtgncgggaagagccctgtgccttgtgaccgaagggatgcattccacgcaagtggcttttcccccggcactcaggcattgggccccaggccccaacggtggcatccccaatccaagagccccacaagaaccgcttactgtagtcctccacactgggacccctgagaccgctttcccagccaatcgccaacaccgctcataggatgtcctcgttctacatcgcacaagaaccccaaaggaggcagccctctaagcagtccttgaaaccaggctccatcaccgttctttgcctttctcccctcatcgagggtaattatctcccatttgtcatggattgcttgaaacaccgcacaagttccccagtgaacctcctgcttgaccaggttcctcgggggagcttgtggacggattggtgcgcatcgagtgggaagccccctggggctttgattgcattgtggatcgtggccacgcttcaggtccccg

SEQ ID NO: 524589 - DNA, 242 bp, Homo sapiens
  misc_feature (172)..(172): n is a, c, g, or t
gttgactcagtggttggcggaaacagcaaagatagattttagagcacagcagcaggggtccctggtcagccccgctccctagagcaggagatcttgagtgggagaacattcttgttgtagccacagctgaggccctggaccagctctctccacaccgcatgctccgagttgngactctaaggagtctaggaattttcattcaaacttggccttacaggtcactcatcagaaaaatacttttt

SEQ ID NO: 524590 - DNA, 134 bp, Homo sapiens
ggacccccccccctttttcatatccccggccccgggtgtgaatgcccttttttcccccggctgtgtcccctcccccgtttgttccctaagtggtgggccccggccttttaaaaatggttggcgggccttttgca

SEQ ID NO: 524591 - DNA, 122 bp, Homo sapiens
tctagaggatcccacaagaaaactaataatactcaacatctcagacgctcaggaaatatgaaacctgtctgaactatcctgccctgcatcatcctagtcctcatctgccctcccatccctat

SEQ ID NO: 524592 - DNA, 162 bp, Homo sapiens
ccccccccccttttggtttttttaaaccaagaaaaacgtttggccccttttttggggttcagaagcatttaagaaaacccgtcctccattataattacctttcaaagggcaagtcaaaagttgtttataaattccaaaaaaaaggcctattatgacctttta

SEQ ID NO: 524593 - DNA, 1200 bp, Homo sapiens
gctgtttattttgcacgattacaacatgcgtgacaaacccagtgcgagatgatgcgatgtctactgtgttccataacccacctctgtgctgacaatggtggtggccccatgggtgccggatgcccatgcccctgatggctggacctacatccatcactccatctccctgaagactctctctcgaactgtgtagtgccatgaatgcaatgctgtctgtggtctctttgtgtgtgacaatggtggatgcccctgtgtctccacaatctcaaatgcccaaaaatgctgaaggttctggagcaaggcgtggatcatgtcctcgacggtatcattgttggaagcaaattgaagacattgtgtctgtgatctgcaagctgtggtcctcagatgaactccatgtggagaacttgcaaatgctgtgtccttgctcccctctgggacaatgctgctgcctgcccggggatctcagactgtagagaggcttgccggccaactcaggcactgtgttcgccatgattaatgggcgttagtggagtctgggattgacgccttggacctgtgacggttgacgaatccatcgatactagtggatacgaagggacagttaagattccttcctgttcacatttacagcccgattcatcggagatagaaataacgtatacgctgacaacgacttgtgatcccttctgactaattacctcgacccaacttgggatcttcagagggttggggtgcacggggacatcacgggaagcaccaacgaggacccggaaacccacggagtcaccacacaggcaaggggaaggggaggaccctggggaaccctcaataggatgagaagccaggaccgaggattgtggcagggcacaagcagacacgagaatcgaagcacgatgggcatgtgaattggatggaccacagagggaacacccaatcaacaccactggacaacagaaggtacacttcgcggagacccgcgatagaggagagtaataacaacacggacacgagttggagatccagaaaactggaaaaccacaaagaggtatatcactagatcaagacagaacccacaaaattagcagagcaagtaccaaaaataggtaacgaacatagaacaacgttagcaacaacacagctaagtgcgcacattctgcctgttaaagagtagtacactactaatacgaaacatactataag

SEQ ID NO: 524594 - DNA, 425 bp, Homo sapiens
atcatcttagaggattccccccgccagtctggggtctggcaggtgggctgacggatcactggcccaagccgctagggaagtcctgcactgacagctcagatctgcagctgcaccgccattgtacttaatacggccagtgatgtgctggcacaaggccagcaacctcattgaggaccgtcgaacaaaggcagctggccatccaggccaccctcagagccatccccggcttgccctggtcgctttcgctgtgaccctggctctgccccgctgtgtctgctgcctacctggcctgcgcgtatgttgaattatgccctgtagcgtgcagttgagacatgcccgccagcgactcctgagtgacttgcttcctcctccccctgggacatttcacgacgctctgagccggttgaactgactgctgctgctgg

SEQ ID NO: 524595 - DNA, 489 bp, Homo sapiens
taatagtgagacatctcagaagcgactattgcggtggacgggagcgtccagtagcacatctatgatccatgtagagcatccaagacatctagccagaagttcttcttgagggtactacaggtcatcatccagctccgggacgacacgcgccgggctaacaagaaagccaagacagacaggcaggctagagtacctccggtaaaggctcagactaacagaatccaggcagctgttcgagagctggaggctgaggctgatgccataatacaactgtcggagtctagccagtcagaggcgtctgtccggagggaggaatcacccatggatgtggaccagacatctcccagtgctcaagatactcaatccattgcctccgatggaaccccacagggggagaaggaacaggaaggcagaccaactgagttacccatgctcagagagcagctgagtttggacgagctgtgggacatgcttggggagtgtctaacg

SEQ ID NO: 524596 - DNA, 382 bp, Homo sapiens
ccagggatcctcaaattaacacgccagaaaaagtagagaatgaacatttgttggatgggtttcctcgattgtttgtatagatcactattgtcccatgcctggatatagacttcagttattccacaagccacagcttaatcctgccgctgcttcctgcccagtcctttccttctttcactccctgaacattccctggctatccactgagcagcaatttgttggcattaacacgggcttcaaagcaatagggaaagtgtgtgtgtgtgcgtgtgtgtgtgtgtgcagggcagggcaggtacctgaggagttcctaagaggatgacacactccctggagatggagctccagggtcgacgcgcccgcgaatttagtagtagtaggc

SEQ ID NO: 524597 - DNA, 1037 bp, Homo sapiens
  misc_feature (792)..(792): n is a, c, g, or t
  misc_feature (1037)..(1037): n is a, c, g, or t
ggggtggcagtttgccgcgggtgtgtgcacgggagacagtgtggaggccacaagggtactcgcaacgatgagcagcaccttagctaagatcgcggagatacgcacgcagagatggctcggactcaaaagaccaaggccacatgaaaccacttagggctgcttaaggctcgtctgtgctaaagcttcgtcgagaactcattactccaaagggtgctggtgcttggcggtccaggacgacaggtcttgatgtggccaacgacaggtgatgctcgaacttggcttggtaggtttcccatctgtggggaagtcaacactgtttagtaacctggcaggggtatattctgaggcggccagcctatgattcactactctgaccattgtgccgtgtgtccatcagatccaaaggttgccaagatccagctcctggatctcccaggtatcattgcaggtgccaaggatggcaacggtagcaggtcgacagtcatttgccagtggcccgaagcttgtacactagatcctagagtggtccgggcatgtccgtgcaaccttgggaacactacgcacgctcactggacactgcgtggcaggtttgggcatttcgttagaccaggcaaccccgaaagttgtgttacgagcacggcacgggaggatagttccacatcatttgccccagttagtgtgttcatacgggcacgctctgggacaaactacacgccgcagtgccaaggtctgtgcaacggagcctatgttgtagagccgacatctgctcattagaagggtccacgggggctntgcgtgcttccatccttgttttttttcgcgtctcctagcttctttgtcttttgacgtgcagacgagcgcagtacgcaggatcgacgaagtacgaactagtagcgagaaggcgcaacgtcaggacagagctgcagcgttaggcagcagctagcaacacgcgagtagacagagaaaggcagccgagtcagctgagcagagagagcatgcacacacgaaagcaggatagagcgccgacactgtacatn

SEQ ID NO: 524598 - DNA, 709 bp, Homo sapiens
gattctgtacatgagtgatagccatcataatcggaggcttagggaacctgtctaggtaaggaccagatctacagaggttatcgtcacagcgcatgcattggtaataatcttctacatagtagatagcccatcataatcggaggcttaggcaactgactacattcccctacagtacaactcggtgcccgcgatatgggcgtcgcgccgagataaacggacgataagcttgtgactctgttacctccctcgtctccgtagctgcctgcttgcgcgtctgtctaatagtggtaggccggagacaggaacgaggttgaacagctctaccctccctgtagacagggaactaaagagaagaaaaaaaaaaagataaaaaggaaataataaaaaagagaatactcagaaaaaaaaaaaaagaaggatggcgtgcgtggttttggggtgaggagggatgaagacaaccgacttgtcctgggcgtacgtccatgcaggggactctgccagtcttggcttttatgaagtctggaaagtctgggtatacgcacatatgctgggagaggagaatacttatctcgggcgcacatcactatataaggctcgcctctgcagtgctgaatactttcgctgacattgccctggctcctatggaagctgctaaggttcgaatgcaaacccagcaggtgatgccaacactttgagggatgcaagacca

SEQ ID NO: 524599 - DNA, 131 bp, Homo sapiens
ttgtgtactagcaataattttcatcatctacttgtagctgagaaaattcttgctgggctacctgttcaactgatgctacgaagatcccagggatattccattttattgtgaaccccaagtcagactcttcc

SEQ ID NO: 524600 - DNA, 276 bp, Homo sapiens
gcccatgacagcaccagcaggatcgtgcaggcggcgagaaacccgaaggcgatctgaaggccatccttgcggctgaaggcagttgccatcacgatcggaatgagcagcagcttgacgtaagggccaacccatttgaatgcgacggggaggggttcgctcgaccaggtcacgccaatcaggatcaacgcgaacagcgcggccggaagccatgcggccgggcggcgtgccgttgtggtaaagcgctgaaggtcgagggttgcgatcgcgagcaccacg

SEQ ID NO: 524601 - DNA, 184 bp, Homo sapiens
gttcgggagcttaacctcaccaagctgaccctcagctcaccccagtgagtggcagtggaagggcaagctggagggtcgtggcactggactatgaggcccgatggcccatctatgagcctctgcacacgcactggtctcacaacttttcttggtctcttcctgctcacggtgggcagcgagcatc

SEQ ID NO: 524602 - DNA, 749 bp, Homo sapiens
tggtaacccccccgtgcccagccctccacctgcaccggaacccccatggcactgtggaaaccggggtagactgcggaaaccggggagactgtgggggacaggggaaacaagcagcaggccatggcacggggtcggggcgcctcaatgggaaacagaggcgcccgagggggcaacctagggtagactgggcacacagccgttccaggggaggccctgcaggatccttccaccctgtgccttgccaaatgtcgcctggccagccagacctccgccatattggtcataggacgggcagcaaacgttggccacgtggctgcatgtggcctccaagccacatactttcttcccagcgggggcatttggccatggctgctgccgacacttcgtgggacccgggggttcacccggtgaccattacgcctgctctatgggtgccctcaggggacgcatccaggtaaggatgccacaaggtcaggagagagctcaccttcctgtggaaaaagcttgtaatacccctcagcccggctactcgcctaaaacccttcacgagctcagtggatggccagagggattctcctccttatgatgaccgggttcagtggttgacccctgtgctgcagagacgcctgtgggataactggtctccattgaccagttccgggacccggccgaggactctgcgaaggtgctgcatcatcagagaacgcctgcctgccttcctttggtggaccctttgtcccgtgcccgtc

SEQ ID NO: 524603 - DNA, 235 bp, Homo sapiens
cgtctccgtggggccccacactgcacactgtctcccccactgtcctggaagccctcggggatcaggggcttctttccttatctgagcaccacagctcctcagcaaatgcttattgtgtgcatgagagtgtctctgtcctaccctagcagaccctctggagggtagggcctgttttttgggaaatgccttcttctctgtaactcaggtgcaagccctcgggacaggtgcatcttct

SEQ ID NO: 524604 - DNA, 940 bp, Homo sapiens
ctgtcgtcggtcctaacgcgtcaccagaaaatggttctgtcaacccgagcactggcgccagccgaaactgttctctgttgggcccaaatttttaataccccgtcccccagttagtggccttctggggattcacactgcgtgccaactacgcccggagtcacaacaccctgaagaaaccaggggcctggggaccacgcgacaacttgcctcgggtatctcaaccgcccgcacggccccacctcttctcacgaaattaaaggggtttcttaaatgtcttgtaagctatttctcttacaggggccctttttcattcctctgtctattaaagggttttttttcgcgccgcacgttcccgttttgaatgagcccctcccccctgttgggccccgcctctggtttgggatggaagaactctttggagaaaactaagtgttcaagcggccccttcgcagtttgcagctggagcacaacaaccgggggaatgtggggccccacccagcggcgtggtgaaacctgtggcccgtgatgacccctcccaggcctcgaggtgtccccaagagccccacaggataatttttttcgccgaacgccacgaaatggagcgcctgtggccgctttttttatgccccacggttcccgcgtgggcaaccaccagaggagcccaaaccttcttgctcgtaaatgtgttgttgttgcaccattagtgaaaaacaccagaccttgcagagttccacagccgcgatttgtgggtgtgtactacaaagcacggcctcttcctacaacagggggtggaagagaaccacacccctttcttccctcttggtaggaatggccttgaagtttggcgttgtgggcacggctactcggtttgtatgaagtatttagtagagccaccgccctaattttttttaatttttattaaaactgaaccgagaataaa

SEQ ID NO: 524605 - DNA, 1206 bp, Homo sapiens
gctacgaggctgcggtactcttcccacgggaagaaggcaagagagagtgagcgcatatcaccggagccacagaaggccgagcccaagcctctggaatcagccagaaccagcgagaccagaaacagctgacagtaattctttcagacgtacgctcagacacctacaggctgggtaggacatgggcattctggctgcttgacactaacagcctggcgttccgcgcacgtgtctatgctgtatcctagagggggaccgagtggggctgatcagtcaggtcttcctcataagaacgcagcaactctctggggatgcaacgctgagccctagctcgaaggatccgacccatgtcgtcgcttcgacttggtagccagcacgcatagctgtgtaccgacggatcagcactgacgacattcgaagccaggcgcgagcctccgaacgggctaatagcacgggtaccctccctctcagccgcaaccgcagaggcagaacccacaccgagtttgagtggcttggggccaaccttgaagcgcggacttgcaccgacaagtcacggacgacgccgggtcttggcgagacgtggcgcgctttcttgcagtgaaaacctggcgtgtcttcccgtttatctttgcgacgaaccgagcaagacgctagcggtcccggcgaagagagggcgtttggattctcacgccgttatggtcccgaaggatgcgacagggagaagggcttcaccagaacggggcccacaggcaggtacccgtgccaaccaatgggcatttgcatttccttaagcagggacgcttttcacaccaagggcccattgggacggcaccggtgtttttccccccgaggattggcgttacgccatttcgcccaagcgttttcacagcgccaacccttaaatggcggaaaccatttttggtgcgcgcccaatgggcgcttagtgacacccgcacacggaagacacaccaccacactttggcgtcttgcacgttacgagcctcctattcgcgggcgtccacgacgacggaatccaacctcgggtgccctgataaggcccccaatggagcgcgtgagtacgtttttccccccaaaggaggcgttccgatgcggtctcggtgcggtttcgagcccacgagagggccggggtgttcatttttctcacagagatcttctgaatttgcccccgtgtgttctaagacccgttaa

SEQ ID NO: 524606 - DNA, 429 bp, Homo sapiens
atgctgtcagtctaattattgactttttgtgggtagtcttatctctctggctttttagatctcttcatcttttgtgttcagtttcaaaacaatgtgtttaagaatgcaatttccttttatcagcttaagatgtgtgaagcactctaaattctaggatttgccttcaatctggtctagaaaattctctaaaaagtcaagaagctttgacttttctcattttctatcactctctatagtaaatgctgcattctggattatttcttcagacctatctttttgctcactaattctctcttcagctgggcctaatctgtttatccattctaatttcaattgttatatttcattttcagtccttcctgaaatctgccttgaccttctttattgacttattcctttgtcatacatttgattcagtcactgcactct

SEQ ID NO: 524607 - DNA, 1252 bp, Homo sapiens
  misc_feature (555)..(555): n is a, c, g, or t
  misc_feature (579)..(579): n is a, c, g, or t
  misc_feature (602)..(602): n is a, c, g, or t
  misc_feature (708)..(708): n is a, c, g, or t
  misc_feature (828)..(828): n is a, c, g, or t
  misc_feature (833)..(833): n is a, c, g, or t
  misc_feature (836)..(836): n is a, c, g, or t
  misc_feature (862)..(862): n is a, c, g, or t
  misc_feature (911)..(911): n is a, c, g, or t
  misc_feature (913)..(913): n is a, c, g, or t
  misc_feature (932)..(932): n is a, c, g, or t
  misc_feature (934)..(934): n is a, c, g, or t
  misc_feature (974)..(974): n is a, c, g, or t
  misc_feature (1040)..(1040): n is a, c, g, or t
  misc_feature (1058)..(1058): n is a, c, g, or t
  misc_feature (1069)..(1069): n is a, c, g, or t
  misc_feature (1196)..(1196): n is a, c, g, or t
ccctgcgaactactcatcgtctgtgtttctcttcaccctgccgttcatgtctatacttcacgagtctccttaggaagagacccaaatcagctgagcgtagaggtctcttgcatatgtggaggtgctctgagactttgcaaacgacatcgtgtatgagcagcctgacggagcctactctcctgagcagatgtgggcatctgctactacggcacgtgctgctgcgctaaatgacgccagattccgatcaactagcgctagaggcgacttcgcgacgggccatgttggggtgctttagttctagcgagtagtgccgcagcgtgctcgagaagagcagagtcggtagtgccatgccctatagcacacttgcacagggaccaccactataggaggtgagtagtgggaataacgatgctatgctagagcatagccaaacaggaacgatgcgtagctacatcactatctaggacagcacttcatccatatacgtaaccaagcggtagaggcctcgactctgatagcgtgctcgcaagaaagagcgagtcatctctcgatgtntggcttgggcctagtatcacaggnaggagacgcacccaccttggaanagcacacccaataaaagcccttaacgcagggagtatgaattgtattgaaacctaccgatgaatttgtgcatacgatatcattgtagcaacgccttgtacatagganacaactccaagtggcacattgggatttcccgggattgggggcaccgattgtcgcccaaagaaggcaaccagaagggcgtgggggtcctttctttgccccttaatttgccggctttacatncttcntcntgcaaccgcaaaccctacgttgcacnttccgttgctagtggaagttacacttgcactggtgatccacctttcgangnaccaaactcaccgcccaanangccgttggtcggcaaacaattgcggtcccacgcaaacggntcgttagcagagcgggttcttatcgcaccaccaccaaggcgcgccctagttccaatagcgggctcntgaagcatcggtcggtantttgtgccttntcgatgtaccccattggcaccccaggaaagaagagctccctcgaaatggtaagggcgtatctctcggtcgacaacaattccgtatgtccgagaaattgggggttagcgctcccgatttgtgagacangtcggattgggcgatattttgccggcggcctcgagcgcagaggtttggaaccaatc

SEQ ID NO: 524608 - DNA, 365 bp, Homo sapiens
ggcctatcttgtcgggttgggactagactgtgcagcattacgtattaggtctatatcctacagaaccacgtgaagccaggaaagtgttttaagctggggtgtgacaatgaaacccatcaagttcgtgttttggcacagattgttgtggcttacgggtgggtgtggggaagcacgagagaagcactagagcagaacagccggaagctggtacgcggtggtggacactgtgactgtgaagactgtggggtttctgtcttgggtttcttgtatctcctccatttgcgactgggcttcgaccacattgtttggcatgaagagggcgtctgcatctgcttagtcactatggcaagaactaggtcattttg

SEQ ID NO: 524609 - DNA, 908 bp, Homo sapiens
gcgaccgtggactattctctacaagaacacaaagacattggaacatctatagcctattattaccggcgcatgagctggagtcctaggcacacgctctacagtgctcctctgagttcgagccgagacgtgggccagagcagggaacctgtctaggtaactgaccgatgatctacaacgttgatcgtcacagcccatgcattggtaataattcttcgttcatagtaatacccatcgataatcggaggtcgttaggtcaacatgtactagttacccctaatagtcggtggccccgatatggcgtttcgccgaataaacgaacataagcttctgactcgttgaacctccctctctcctactcctgtctcgcatctgctatagtggaggccggaacaggaacaggttgaacagtctacccgttcccttagcagggaacggagtcccaccctggagcctccgtagacctaaccatcttctccttacagcgctagcaggtgtctcctctatcttaggggccatcagagttgcattgcacagacaatttatcaatataaaaccccctggcataaccaataccaaacgcgcctcttcgtctgatccgtgctaatcacagcagtcctacttctcctatctctcccagtcctagctgtggcatcactatactactaacagacggaactcaacacacttcttcgaccccgcggaggaggagacccattctataccaagactattctgattttcggtcacccctgaagttatattcttatctaacagctttggaataatctcccatattgaaataagtactcgggaaaaagaacctttggcactacgtatggctgggaagaaataacgggtcccaggtatcggggagcccatttaggaatattagagattttcaccacaat

SEQ ID NO: 524610 - DNA, 220 bp, Homo sapiens
cggagtatgcgcggcactgccactatcttaccgctggcggggacggcacctgccttaccaaccttactgagccccaagaccctaccctctgggcttggatgactatccccgggtcttcacacccttcagtaaccgaggcggcacctggtacctgctcatgttgtggtggcactgtgttgcccggtgtgctgacagcggctgtgcagacgcatcgtgggtg

SEQ ID NO: 524611 - DNA, 315 bp, Homo sapiens
  misc_feature (302)..(302): n is a, c, g, or t
ggagtttgagaccagcttagcaatatggcgagagcttgtctctatgaaaaaaatttaaaaaattagccaggcttggtggtgtatacctgtattcccaggtacttggtaggctaaggtgagaggattgcttgagcctgggaggcaggaggcagaggttgctgtgagccaagatcgtgccagtgcactccaccctgtgtgacagagcaagactccatcaggaatgaaagaaagagagagagagagaaggaaggaagggagagagagagaaagggagacagtggaagagtgagacttcgtctcanaaaaaaaaaagta

SEQ ID NO: 524612 - DNA, 248 bp, Homo sapiens
  misc_feature (142)..(142): n is a, c, g, or t
ggcccccccccccccccccttttttgggttttttttttttcccccaaaggggggccccccccccccccagtttttttggcccccccgggggggggggggttttgccccccccggggggggttccccacaaaaaatccccttncccaaaatgggggggggccccccccccccccccggcccaaggggttttccccggttttttttttgggggggggaaacccccctaaagggcccttttttttttttta

SEQ ID NO: 524613 - DNA, 184 bp, Homo sapiens
atgagggacaaggggagggtctcgtggcaggaacacgagtactgccaacaatcaggtgagctccgaagtggagtctttcccagtcgggccggactggcatgtagtgaggacagaaccaactaatcacagcagctgtataagaaaaccaaaccccagagtggaaggtaagtggggtaccgagctc

SEQ ID NO: 524614 - DNA, 215 bp, Homo sapiens
cccccccccccccccccaagggggggggggggttttttcccaccccccaggggccccccgtgaaggaccggggtttttttttattaggggttttttcccccccggtccccccggaaaggcaattttcccaaaaaaacccccccggcttttgtttcaaaaggcccggggcccccccccttttgccttccccccaaaaaaattttttttttcgggga

SEQ ID NO: 524615 - DNA, 154 bp, Homo sapiens
gtctgagcagctgggaaagtccactgaaatttacatagcagtgtatgcaagcattcttacataattcaagacctaaaaccaacctgcagtggatggtttcatgtcctctgttcagtgtgcttagacatgaagccatacagctgatgagctatga

SEQ ID NO: 524616 - DNA, 1140 bp, Homo sapiens
ctctttgtttggtttttccccccgccctctgcgctctctccgctgagagtgtgtgttgagttgggtcggcaccgcgttgtgttgttgtggtggggcagcagcgcggcggtttcttcttattgtttttgcacacagccttttttgttctctgcgctgcgcgacatattagataagagtatcgtttgtgtgcgtttgttttcgtgttggtgtctattctcgcgcccatgcctgtctttggtagagtgcactctcttcgggtcgcgggagagagagagagagcactgtttgctgcgcccgcgcgctatattatcgtagaagatgtgtgtgagcaccttctctttctctcgtcggtgagagacattatagcacaacactctctctctcttagtagatatttgttgtgtgtgtggagcaatcttcatatctgtataaaggagagaggagaggagatagtacaccccccctctctctgtctgtgtggcgatgggttttccactctctttcacacactctggtcgcgcgctgtcttgtcgtctttgtgtgtagtaaggactctcttgtcatctctcatcacctctctgtgtgcgcatctctggtgcgctctctctgtctctctctctctctgttgtctccacacgccccttctgtgtgtgtcgcgcgcgcaaaggagagactcgtgtctctacacacatgcagaatgctcgtgtcctatcgtgttggctacaacaccgtcgttgttgtggtgtgcgcgcgtcgtggagaaaatataattttgatatatgtgtgtggtgtgtgtgtgtgtgtgagatatatgagagcgggtgttgtgtgtgttatatgggatctgtctataaatgatttatgagagaaacacacaccgtagggccgctcgtgtttatgtataatatgctcgcgcagacatatcaagagactctgccgcggagtggaggagatgcttatatatgagcaacgaccttatttttttggcaagcctccccgtggtttcctataattggtgaaaaagagggggggaacacacaccctgccactctttgggcccctttttttggggccctttttttttataaagacaaaaaaaaattggggtttataaacggtggggatttatttttaacccca

SEQ ID NO: 524617 - DNA, 982 bp, Homo sapiens
  misc_feature (1)..(1): n is a, c, g, or t
ncgcatgttagtgtgccgagcgcatcagtcacatacaacacacaagcaataacagcacagcgcgcagtagagcaccttccacaattatatgccgagacatgctgtttcattgggagccacaccagataccgtgcccactggggtctcgcccccgtgttaagacaatcgggcgaaactgggaatcggccccacggggcccgcattaacgacaccacactgggggcactcacacacaaacagggggcaaacacagcccgtgacagaatccgctcatgatggatgcggggcacaacattttgaatgctagcggggcatgcacggtctctccacaccgccgggtctctgctcccgccccatagccacggagattttgtgccatagccagctcttgtaactcaccggttgtttcccccggccagtgttttagcgcccgcggtgccacaaaaacttggtagggcgcctggccagatcgagactaggtggacacaagggcctttatattttcttgcacgggaacaaaaccttggatttatctgctgactgtccaactcctccaagagtcgtcccacgtcgcttagtgtgggggcttgtcctgtattaaatcccgggctaacaatgttggatggcaaccttccttctctctccgtcgaggcaagtacccgcgaaacatattttctctgcgaggtcttccactgatgggaggggcgcgcaacatttactcattaggggcgtggtttatagccgaccccacctgggtttctcgatgaggcgagccaccaacgaggatgtgttaccccgaggtatgtgatggtgaccccccgcgtaaggagcaacacgctagtgtggtcgctaaacaccaggtagcccaaaaaacagatgataatgggtataagacaaaccgtggctgccagaagcataaaaccccccaggtatagtgttcaggtttgaaaccaaaaaatagaccctttcccccaacatgaca

SEQ ID NO: 524618 - DNA, 437 bp, Homo sapiens
gtgggtttaggaagttcacttttttttttatactttacatacatgttaccaaatttttaatgtatttaatgtttttatcaacgcataataaatataagtggtgttttgttttttgtgtttttttttttttttgagatagagtctccctctgttgccaggctggagtgcagtggcatgatcttggctcactgcagcctccgcctcccgggttcaagcgattctcctgcctcagcctcccaagtagctgggattacaaggcgcgcgccaccacgcctggctgatttttgtatttttagtagagacagggtttcaccatgttggccaggctgctctcgaactcctgaccttaggtgatccacccgcctcagcctcccaaagtgctgggattacaggcgtgaaccaccacccccagcctaattttggtttttttagacagg

SEQ ID NO: 524619 - DNA, 147 bp, Homo sapiens
attatccgtaaatgaatcttctttattaacttgacttgctatctcagcagataattacaaaaaacaaataagaatcctgcagtgtatacggaactcttatatggtaaatcacggacacctcattatgcaagaactgaggggcgggct

SEQ ID NO: 524620 - DNA, 114 bp, Homo sapiens
cgtggcttgcatgtgcgtggtggtgatgtcctgcccacagacctcagacagcacattgctgcagaagataggggccatcctggacaacagcaccttgcagagtgaattcaagcc

SEQ ID NO: 524621 - DNA, 183 bp, Homo sapiens
atctggggagcggacccactcgcctcacattccacaggcccatgggactcacttttgtgaacaaactcctaccaacacgtgcccaataaaagaaaaatgtgggttttttttttttttttttttttttgttttgtttttttttgcagcttgggcgggtgtttgtgtgatttgtatgttttgtta

SEQ ID NO: 524622 - DNA, 310 bp, Homo sapiens
  misc_feature (194)..(194): n is a, c, g, or t
  misc_feature (231)..(231): n is a, c, g, or t
  misc_feature (233)..(233): n is a, c, g, or t
  misc_feature (237)..(237): n is a, c, g, or t
aatacattgcgccatgatggctacgacataggaatttttcagctccattataattttatgggatcaccgttgtgaatgcagtgcattgttaaccaaaatgtcattatgtgttatatgactgtatatataatctcgacttttatttgtaccaatatatacaatgggaaagtttgtaccatgtcaaataccagttnagataattatcattttgttattgttattaatacatantncaangtttttttcagggcaaggattattaccaaggtgtgtttctagagggttaattaggtcatggcatgggggggac

SEQ ID NO: 524623 - DNA, 881 bp, Homo sapiens
  misc_feature (46)..(46): n is a, c, g, or t
  misc_feature (121)..(121): n is a, c, g, or t
  misc_feature (143)..(143): n is a, c, g, or t
  misc_feature (156)..(156): n is a, c, g, or t
  misc_feature (158)..(158): n is a, c, g, or t
  misc_feature (179)..(179): n is a, c, g, or t
  misc_feature (189)..(189): n is a, c, g, or t
  misc_feature (196)..(196): n is a, c, g, or t
  misc_feature (208)..(208): n is a, c, g, or t
  misc_feature (239)..(239): n is a, c, g, or t
  misc_feature (257)..(258): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (319)..(320): n is a, c, g, or t
  misc_feature (356)..(358): n is a, c, g, or t
  misc_feature (369)..(369): n is a, c, g, or t
  misc_feature (371)..(371): n is a, c, g, or t
  misc_feature (373)..(374): n is a, c, g, or t
  misc_feature (378)..(378): n is a, c, g, or t
  misc_feature (388)..(388): n is a, c, g, or t
  misc_feature (390)..(390): n is a, c, g, or t
  misc_feature (415)..(415): n is a, c, g, or t
  misc_feature (417)..(417): n is a, c, g, or t
  misc_feature (429)..(429): n is a, c, g, or t
  misc_feature (435)..(435): n is a, c, g, or t
  misc_feature (437)..(437): n is a, c, g, or t
  misc_feature (472)..(472): n is a, c, g, or t
  misc_feature (474)..(474): n is a, c, g, or t
  misc_feature (492)..(492): n is a, c, g, or t
  misc_feature (505)..(505): n is a, c, g, or t
  misc_feature (566)..(566): n is a, c, g, or t
  misc_feature (569)..(569): n is a, c, g, or t
  misc_feature (572)..(572): n is a, c, g, or t
  misc_feature (577)..(577): n is a, c, g, or t
  misc_feature (598)..(599): n is a, c, g, or t
  misc_feature (610)..(610): n is a, c, g, or t
  misc_feature (622)..(622): n is a, c, g, or t
  misc_feature (625)..(626): n is a, c, g, or t
  misc_feature (628)..(628): n is a, c, g, or t
  misc_feature (640)..(640): n is a, c, g, or t
  misc_feature (644)..(644): n is a, c, g, or t
  misc_feature (647)..(649): n is a, c, g, or t
  misc_feature (655)..(655): n is a, c, g, or t
  misc_feature (658)..(659): n is a, c, g, or t
  misc_feature (662)..(662): n is a, c, g, or t
  misc_feature (667)..(667): n is a, c, g, or t
  misc_feature (673)..(673): n is a, c, g, or t
  misc_feature (682)..(682): n is a, c, g, or t
  misc_feature (686)..(688): n is a, c, g, or t
  misc_feature (706)..(706): n is a, c, g, or t
  misc_feature (718)..(718): n is a, c, g, or t
  misc_feature (725)..(727): n is a, c, g, or t
  misc_feature (732)..(733): n is a, c, g, or t
  misc_feature (740)..(740): n is a, c, g, or t
  misc_feature (742)..(743): n is a, c, g, or t
  misc_feature (753)..(754): n is a, c, g, or t
  misc_feature (756)..(756): n is a, c, g, or t
  misc_feature (762)..(762): n is a, c, g, or t
  misc_feature (764)..(765): n is a, c, g, or t
  misc_feature (767)..(768): n is a, c, g, or t
  misc_feature (772)..(772): n is a, c, g, or t
  misc_feature (779)..(779): n is a, c, g, or t
  misc_feature (803)..(803): n is a, c, g, or t
  misc_feature (813)..(813): n is a, c, g, or t
  misc_feature (816)..(816): n is a, c, g, or t
  misc_feature (827)..(827): n is a, c, g, or t
ccacccccctcccgcctcccgtcccaccttcaccctcagccaagangcttgggtgactctgagtaatacgttaacaaaaaacaaagcttctttgaagaaacagcatgacttagtgcaaaanattctctgcagcaagaaatgangcccacgcagggnancccccgcctacctgcccaggncgtggccgcngcccggnctcatcagaggncatccacagaagctgccgataaattagagancacggtttacggccagannttttttgctttctctacctgatttagggtttttcaaaaagtttctcttccngtggcncncnnctgtcctcttggctcctgggccactggtccgcctgnnngggtagggtcncncnncccncccttgcccngngtgtggggacatggatttgaggtgncnctggggttgtcngtcccncnccctgtgtcctgctctagggtagcctctgcctgtngnccttgcaatcattattcngggccccctcccncttgcccccaaagtcacacggccatgggcagtccaccatagtgctgccgtgactgcaaggntgnggngcagngcaaggggtctctgggtgacnnctcgcgccccntggtcgcccccnctnncntgaaaaaaaggnaatntgnnncaaatnaannaanaaaangaaaanggtgacaangatnnnggggaaaaaaagaaaaanggaaggaaagangggagannnagagnngagaaanannaaaggggggnnanaagatngnngnngggngaaaaanaggggtatgggggatgtgtttgangaaatgaggnatntgaagaatganaaggaaaattgggaaaagagtttaaataatggataaatgaagaatagataaaaa

SEQ ID NO: 524624 - DNA, 1056 bp, Homo sapiens
attctaatcgccaatggcattccttaatgcttaccgaacgaagaattctagagctatatacaactacgtcacaggccccaagcgtgtgtaggccccgtaggcgggctactacgaagcgcttcgctgacgccataaaactcttcaccaatagagcctcctaaaatccgccatcatctacgcgatcaccctctacaatcaagcgccccgatgcattagactctgcaccagtcgtctctctcgtagctatggaagccactccgaatgccactataacaccgaagcctatggtacaggctcaatgtgaggtctcctatttgtactagttccaaacctactgagccgtaaaacgtgtgctacttcaaagccttctgtatctaagggttgtagctaactaaaatcttcgaagtaacaaccccctagatcagtgggctactggcttgagtcatgttaactctcggagggaaggtgcggtgtgggagcccggcgcactccagcccatccaagtacctcagtttattcaaagccaatgtcagttcataccacatgctgggcatcccgttgtaaaaccgctgacgtgaacagccacctctcatcaactacaccacctgacgtagacattcctacttgccttttatccttcgagccacaagcaaatgggctcccatcttgtgtccgttacatcaattccggcattattgttcacaccatttaaaaccagaaggatggcatacgccgaaatcgggccacatatacgaacactatagcccgaaggggggggacgtgcctgcaaaagtaaaggtatcctccagggcgtatggaggcactcacggaattacagccccgaaagagcccgccttttcgacgccttaatcacctctgcagtatcccccgaatataacggcaaaaacgatttacttcagtagcttaagacaaccccgtgcaacgccacgttataaaacattcgctaagggacaccaggcaataatggaggacaactctcgggccatgcaaagtgcgtaaaagaagacactataaatgacgaggcaaaggagccct

SEQ ID NO: 524625 - DNA, 582 bp, Homo sapiens
ctatgtctatgagataatcatgtgtttttttgtcttcagttctgtttatgtgataaattacatttattgatttgcatatgttgaaccagccttgcttcccagggatgaagccaacttggtgggtggttgataagcattgtgatgtgctactggatttggtttgccagtattttattaaggatttttgcatcaatgtccatcaggcatattggcctgaagttttctacttttgttgtatctctgccaggttttcgtatcaggatgatgctggcctcataaaatgagttaaggaggagtccctccttttcaattgtttggaatagtttcagaataaatgctaccagctcctttttgtacctctggtagaattcagctgtaaatccatctggacctgggatattttttagttggtaggctatttgttactgcttctatttcagaacttgttattggtctattcagggattcagcttcttcctggtctagtcttgggagggtgtatgtgtccaggaatttacccatttttttaggttgtagggaggtgttttcctactgggtgtattagattattttatgttacta

SEQ ID NO: 524626 - DNA, 270 bp, Homo sapiens
agctatcggttattgggcccacatatgttgcacgatagggttctcaccacagctagaattgagtactcagactggtcttcctatctctcaggaacgtggggccagcggtgtggaggcacatctctgcatgctgtggggactgagagccgcaggacgtgcacttcggtggggtgcatgtagagctggtgagtaggctctacgctgctagctgcggaggagagcccgtcatggacctgttaacgatgttattgaacctggataagcttgccg

SEQ ID NO: 524627 - DNA, 205 bp, Homo sapiens
tcacctcccctgtgtgttacttgggagaggactggcccattctccttagagaggagagtggtggcttttaggatggcaagtgcatgacacttctgtgtactgaaaagacaggagtgaccatgccatgcggctgacaggactgaatgaattactaaagtgatagactcatcttaccagagagatagcagctgatgaagtaggagaa

SEQ ID NO: 524628 - DNA, 433 bp, Homo sapiens
  misc_feature (2)..(2): n is a, c, g, or t
  misc_feature (65)..(65): n is a, c, g, or t
  misc_feature (86)..(86): n is a, c, g, or t
  misc_feature (93)..(93): n is a, c, g, or t
  misc_feature (101)..(101): n is a, c, g, or t
  misc_feature (105)..(105): n is a, c, g, or t
  misc_feature (119)..(119): n is a, c, g, or t
  misc_feature (133)..(133): n is a, c, g, or t
  misc_feature (136)..(136): n is a, c, g, or t
  misc_feature (140)..(141): n is a, c, g, or t
  misc_feature (143)..(144): n is a, c, g, or t
  misc_feature (148)..(148): n is a, c, g, or t
  misc_feature (152)..(152): n is a, c, g, or t
  misc_feature (157)..(158): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (170)..(171): n is a, c, g, or t
  misc_feature (175)..(175): n is a, c, g, or t
  misc_feature (229)..(229): n is a, c, g, or t
  misc_feature (247)..(247): n is a, c, g, or t
  misc_feature (258)..(258): n is a, c, g, or t
  misc_feature (404)..(404): n is a, c, g, or t
cngtcatagctcagggaggcaaacagccacgggtcagccgaggaccagtccacggcatagacgcngtcctcgtgctcctcgtaggnggcgatngcgttgtnctgnaggggctccttgcncttctcttcagaanggnggtnntnntggncacngaggnnatcgncgncnannaagnggccgaaggctccgacgagatggacaccatgttggaaaggatgactctgctgtnactgctgcccgtgaggancagctggtcangagagtggttgtagcggacgttccacacccagtgggagtgctcctccagggtcttcacgggttcggtgacatttcgggtgtcccagaacttcaccttacagtcgtctccgcagctggccaagtagtactgcttattgggattaaantcaaggtcccgcaccagctgtccgtgggc

SEQ ID NO: 524629 - DNA, 246 bp, Homo sapiens
  misc_feature (58)..(58): n is a, c, g, or t
accgacgcgttcttcacgacaacctgcttagcctggagactgcggtctgagaacagcnaccttgtattctggctagatgaagtggcgaggagcagacgcagtcttccgttgcccggagcaggatgtcccgtttgacggcagctccctggacgtggggatggatgtcaggccctctgagcccccatgggaactcctggcgatcttcccagatctttaggtgaagtctgagccatctcctcctcagct

SEQ ID NO: 524630 - DNA, 264 bp, Homo sapiens
  misc_feature (49)..(49): n is a, c, g, or t
agaaaagaatgggctaatggtaatcgaggtcccgtgcgggtttttaagnttgggcacgcaggagcagcagcagcagcagcagcagcagcagcagcagcagcagcagcagcagcagcagcagcagcagcagcagcagcagcagcagcagcagcagcagtagcagcagcagcagcagcagcagcacgcagacaggcagcagaaataccagtagcagacatatagcacgcatctcgagacagaaaacggataaagtcaactgattat

SEQ ID NO: 524631 - DNA, 359 bp, Homo sapiens
atatgaaatagtgttcatcgtttaatttgaaaaagcattaacatttgggcattaccaaagtggcaaagatattaaaactttatggtgaaatgggagtattgattttgcggtacataattagaaaatgtccagcaaatgggagaacaggccaattattacctttaaaactattttttagggccaggcacagtggctcatgcctgtaatcccagtacctttgggaggccaaggcaggtggattgcttgaatccaggagttcgagaccagcctgggtgacatggcgaaaccctgtctctactaaaaatacaagaaataagtccagaatggtagcctgcacctgtagtcccaactacacaaaa

SEQ ID NO: 524632 - DNA, 366 bp, Homo sapiens
ttttccctcccccccagccatcctgtccctcattgggtttgtgctttcccctatacacagtccccgtcccaatgagaaacaagaaggagccccctccccatggatttccccctgcaagtgggcaacgacattcagtcctgccctgctcccctggggttaattaataattcctggctgcccccccatcctctttgatttgtgagaaacaggtaagctgctgtgacttccctttagggcaatgttgggttaatctttgaagggccccccgaagacctttttactgtgattttttacccctttccctcttggcttttttatgttgctttcatgaatggaatggaaaaaaaatgcctcagtttaggcccc

SEQ ID NO: 524633 - DNA, 149 bp, Homo sapiens
tgattgttgtgcttacatgttggaggtaacctgtgatgttgtcacgtcacgtcatttgcgcagtgcatgcattgtgtgcgcctgtgggtgtgtattgtggcgggcagtgaggggttataagcccagaccctccaggtaacaaccacagc

SEQ ID NO: 524634 - DNA, 144 bp, Homo sapiens
ctcctcctggcatacccttcaatgcattgcatacagttgtgctgccatggtcaattcaggtgtcaacatggtcaagccagtccaccatacacatgtttttgtcaattggtcattaattttgcagcaggcaaggggcatcctcta

SEQ ID NO: 524635 - DNA, 945 bp, Homo sapiens
  misc_feature (535)..(535): n is a, c, g, or t
agcggaggtggagccccaccgccccgcctgaaagctggttttctggccaatcagcgacttgagagttccttcaagagcgtgctagctgcgcggcgtgcacatcgctacatctgctgcgcggctgtgaaactggaccttgacatttggcccggcacggaacgtagatgaatgtggcatgtaacaccgttgacgtacggaacaacggactttcctgtcttcctagacggctcctgtgaacacgtggcatgagactacctgagccgctgtagtagtgcatcgcgacacctcccctgctcggcaccagctgtcgggcggtgcccggtaggtctcatgtgcatgctatgcgtgaggcgctgtattggaggcatggttgcacaggtcgctgcggtgcgcgcattcgtgtatgccggaactcgtcatgtggtccgcaggcgtgcgcgcgcgcctcagggcgtgtgggcccctgttgcccaatgaccggggatgattcgtcttggagccacgatccttaaaaggctcttcatctccctggaangctctagctggttgatttatattcacggctgcttacctgccgagagacatgtccttctagtcaactagagctccgtggagcgtatcatatggatgccttgatatcttccactttctgcgtcaaaaaatgtggagtttacgagtatggcgccaccatgcattgtagaatactatgcgagagaaggcattagttcagcagcagtaattataaatcttatgattattactccgtttcctccctaagctcatctcttgtaccgttcaacttttccattttcaaagcagttataattttactttcgcccgagagtattattgaagtcctgggcacaaaattagagttgcccattgagaattttcccaatgaaaaacttgatttggatcacagcatatcgatcattaattccccaa

SEQ ID NO: 524636 - DNA, 578 bp, Homo sapiens
ctagaggatcctacgctggtcgcagtctagggaaaagacagcagagtctgcacatcggttttcatctggtgtgtagagaattcacatagtagcgttttttggacttggacactaattcatctttatctaatagttgattgcagatcctcaataaacaaattggtgggacattatgggagccatctaataaacacaggaatttgacagcacaaattctcacataatggtcttctctcttagtattttccataacaatatttgccgcacaagtcatgtccaaggttttctatgaaggtctgtacatcctgaacaagtctttgatcacgcctaaaacacagttccaaatatacaagcctcaaggataagttcgctataatttttagcacttgataaagatccttgggacacatttgaagcagacactatccaagactgacagcagtaacttatcagtgtattgaagactccagtctttatagcagacatttcaattatcttgtacataatctcttttattttgaaatatgcctggcccttgattttggcagcaatggtaagaactttgttatcaaaaacaa

SEQ ID NO: 524637 - DNA, 142 bp, Homo sapiens
tatatcttaaggaggtagacactactatactagtcaactatatctctatcctttaatcttatagctccaatcctcagaactacgggaagctagatacacaggacaatgtatctaaatagtaccttaactacccgtggctacc

SEQ ID NO: 524638 - DNA, 384 bp, Homo sapiens
  misc_feature (23)..(23): n is a, c, g, or t
  misc_feature (94)..(94): n is a, c, g, or t
  misc_feature (107)..(108): n is a, c, g, or t
gtgtattgcaaagagggctttgnagcgcgagcgcggggcgcgggcaaccccccttattaaatcggacaccccccggcccgagcgcgaaccgcgngccagcgaccggnncggcggccagccacgaaccgaactaagccgagctaggtagcgaggcgtgcgcgtgggccggggcggcggcgccccccatccccagcaccgaggggcgagcatggcccgcccgcgggggggctggaccgccgcgcacgccgcccgatccccgcgccctacccagcccgggtcgccgccgctcgcacccgccgcttagcgctcgggcgccgctcgcttctccgggcatcgcggaaatcccgccgcagacggacacaatggcggcggcggcggcggccg

SEQ ID NO: 524639 - DNA, 715 bp, Homo sapiens
ctcacccacacctacattctctgtaaagttggaggtggaaataatcggtaccctctttttcctgctggtcgacgggccctccaagagtttggggcgcggaccggagtaccttggggggagttatgtcggggtcggtagggtctgtcatttcgcggttcttagaagagtacttgagctccactccggagcggctgaagttgctggacgcgtacctgctggatatactgctgaccggagcgctgcagttcggatactgtctcctcgtggggaccttgcccttcaactcttttctcttgggcttgatctattgtgtggggagtttcatcctaacgggttgcctgagaatacagatcatcccacataacaaatcggatttccaaggcatcttcccagagcgaggctttggtgattttatctttgccagcaccatgctggaccttgttgtcatgaactttgttggctgaatgattgtcatttacttaattgaggagtaggagactaaaagaatgttcactttttgaatttcctggataagaagtcttggagatggcagcttattggacacatggattttcttcagatttgcacttacttgtagctttgctttttatgcaggagaaaagcccagagttcacctgggggttagaacaactttgtaacaaacatttattaatccaagcctgggctttcaataaaaggaaacctttggcttttt

SEQ ID NO: 524640 - DNA, 278 bp, Homo sapiens
tgtagtcgctcttgggggggggaaggggagagggagagcttttatatcttcttgagttcttgtttaattcatccgggctcctcggtggtgccatcttcattaaccggtttggcctcttccccatcgctgatattatggctaccatgtatcttggccccatgagtttcctgtttactctgatctggggtgccctttctacttccgggcctgtttacaggtcttccagctggggatataagggccatctttatcattagaaaccaagagcgacggacagg

SEQ ID NO: 524641 - DNA, 468 bp, Homo sapiens
  misc_feature (26)..(26): n is a, c, g, or t
aacggattacctcaagatagattatncctaacttaagactgaaactaaaaacatactagaagaaaacctagaaaaaaatattctagacattggcttaggcaaaaaatttattacaaagaccccaaaaaatgcaacaaaacaaaaacagacaaatgggacttaattaaactaaaaaccttctggaaaacaaaagaaatgatcaagggaataaacagacaacctacagaatgggatcagatatttgcaaattaggcctccaaccaagggctaatatcaagaatctataaggaattcaaataacttaacaagaaaaaacaaacaactctattaaaaactgggcaatgggcatgtacagacatttctaaaaagaagaaataaaaatgggcaacaaacacataaaaatatgttcaatatcactaatcattagaaaaataaaaattaaaagcacattgaggtaatccgtgaggg

SEQ ID NO: 524642 - DNA, 209 bp, Homo sapiens
  misc_feature (1)..(1): n is a, c, g, or t
  misc_feature (3)..(3): n is a, c, g, or t
  misc_feature (15)..(15): n is a, c, g, or t
  misc_feature (91)..(91): n is a, c, g, or t
nanttcggcacaggngaattgaagtctggcttaaatcttcagaaagttatatatctattttattttatttttttgagacagagtctcgccngtgtcacccaggctggagtgcagtgccacaatcttggctcactgcaacctctgagtcccaggttcaggcgatactcgtgcctcagcctcctgagtagctgggactacaggcgtgcacc

SEQ ID NO: 524643 - DNA, 113 bp, Homo sapiens
ctttgccattctgatgggcaaggggtctggccctgtatgatgtcgggtgaccattctcgctctccatccagagccttttaggagaaccaaacattgatagtcccttgaacaca

SEQ ID NO: 524644 - DNA, 633 bp, Homo sapiens
  misc_feature (155)..(155): n is a, c, g, or t
  misc_feature (234)..(234): n is a, c, g, or t
  misc_feature (249)..(249): n is a, c, g, or t
tggaagttcggaatcctcttttgggaaatcatccttttggggaagtgcctatccaaaaattcccctaaaggacgtgtcccctcgggtggaaaagggctcaagatgggatgcccccgccggctgccccgcccgcagtctataaagtcatgaaaaantgctggcacctggacgccgccatgcggccctccttcctacagctccgagagcaggttgagcacatcaaaacccccgagntgcacctgtgacggntggcctccgcctgggtcatgggcctgtggggacttaacctggaaaatcatggacctggtgcccctgctcactgggcccgagccttaaattaaccccaacggggtggcgggccttttttctgggttccaacctgcacccctccgggccccgtttttttttggacccacctgtgggggcctggggagcccccttaggggccagggaagaaagaggccccggaacgggaggcagcgcccccccacgttggggttccctggcctcccccccctcgcctttttaaagttttattcctttccttttttgaaattttttttccgggggtttattttttattatttttcaaaataaggaaaaaaaaaggacccaccaaatgggcctttttca

SEQ ID NO: 524645 - DNA, 861 bp, Homo sapiens
  misc_feature (24)..(24): n is a, c, g, or t
  misc_feature (83)..(83): n is a, c, g, or t
  misc_feature (100)..(102): n is a, c, g, or t
  misc_feature (109)..(109): n is a, c, g, or t
  misc_feature (159)..(161): n is a, c, g, or t
  misc_feature (163)..(163): n is a, c, g, or t
  misc_feature (166)..(167): n is a, c, g, or t
  misc_feature (176)..(176): n is a, c, g, or t
  misc_feature (183)..(183): n is a, c, g, or t
  misc_feature (388)..(388): n is a, c, g, or t
  misc_feature (391)..(391): n is a, c, g, or t
  misc_feature (415)..(415): n is a, c, g, or t
  misc_feature (432)..(432): n is a, c, g, or t
  misc_feature (493)..(493): n is a, c, g, or t
  misc_feature (497)..(497): n is a, c, g, or t
  misc_feature (514)..(514): n is a, c, g, or t
  misc_feature (659)..(659): n is a, c, g, or t
  misc_feature (744)..(744): n is a, c, g, or t
  misc_feature (749)..(749): n is a, c, g, or t
  misc_feature (751)..(751): n is a, c, g, or t
  misc_feature (753)..(753): n is a, c, g, or t
  misc_feature (757)..(760): n is a, c, g, or t
  misc_feature (762)..(762): n is a, c, g, or t
  misc_feature (765)..(765): n is a, c, g, or t
  misc_feature (767)..(767): n is a, c, g, or t
  misc_feature (810)..(810): n is a, c, g, or t
gaacatcagactgaatatcatcanacacatacacaaaaccactcatctctaaagtcattttctataccctctcaaaatttttncagtttttttttcctcnnncaatttnccactccaaccccaaacaccaacatggaataaatggaaacactagccttnnngnttnncccacagtnccaaagngctattacagggggaatatctgcggcaggggggcattcttgctgctgggggtgtgagtaaaatgcttagttccttctaaaatcataattgcaatatggacttctgcttcacgctgcatcctaaggcacaaatcaggtaacctacatctcccaaatgatcaacagagcactccatcctattttacccccaatgctgagaaattacnccngggcccagaagttgtcacataggnggcttgggttacttggngcccaggcaacaactgccacaggccccagcttgatgaacaccatcaatttctttaaatatnttgntactaagatggaggccnctgctcagaggaagcaaggacgtaaacgctgggacagactgcactgagggtcactacactaacagacccagatgacacgatggaacatgaatactgaagctgacaatcttctgaaaaatctctttttcaaaacccatacgcctantcgagaaatcagggacagggaaacattcgcataattacccaccaacatgttcttcttaacagaagtgaagattattttaagaatnttttnantntttnnnnanatntnttttcagggatagaccagagcagcagaagtacttttcagagcnggttcattttaaagtctatctcaagaacaagggcagcctgctttcacaagg

SEQ ID NO: 524646 - DNA, 134 bp, Homo sapiens
tctacaggatcttactggtatcccaccagctataacaagattctccttgctcaaaggggcttctatggaaggagtgggaatacttagaaacaaggaacatggtgtccctgtttattgttgtccaggaacttggg

SEQ ID NO: 524647 - DNA, 195 bp, Homo sapiens
ttacgactcgagctcggtaccatgctcatccctccttacgagccacagttctcgaactcaaaggacctgggggtgcttcatatccctctagaggagcctgttctgtaatcgagtaaaccccgatcaagcctcaccacctcttgctctgccttatataccgccttatgctcatccctccttatgctcatccctccg

SEQ ID NO: 524648 - DNA, 988 bp, Homo sapiens
tggccgggggtacaatttatccaggggcaacattattatacagaaataaatggtatggggggtgggacacgggaacccccggcagccccaccccttagctgggctctcggggtcctggcagggggcaagaagctggccggagacccgcatctgggtggccagtgcacaaagaaaccactcgacagagggccagacaagaatctctatcgccctctcaaggtggctctggggagatcccggggtgggcaaagatctcacactgcggccacaggggccatgggggagaatgtaagacgcccagtgggtgacaggtaacccaatttccccaaaaggaatgcacaaggggcgcttctgggcgtaggcgtctgggggagaagtgcgacacacacagacgcgacaggcgaggggcactctggtgcctcacagggggtctgagagcgccaccagggagcggggacaagcctcctataaggcgcgcaccataggggggccctctcatctgccgggcggggtcacaccacggcccagagaaattgcgcgacgggatatggagcctataattcccacaccacagggggtccatcataccattccacagggagaccccttggggggggggcacccagggggacgcttgggacggggtgagagaaactcccttaaatgggcccaagtggcccgggacactgtggggcggcaccacattaccacgggccaactccaaatggcgccaagggcctataagggaaccccaacacagggcccaccttcatccccggggggggcctcaggggaacactgggggagcgttagaaagcccaagggaggactcgtgggagctcaaaaacccctgttggaggcgcacagtggggggtcagaagattcgagaaaacgggacagggacacgggacaggccccgtgggggaacgcgaccacagaaggggggttccaaacgcctccagggggagaggacatactctggccccaa

SEQ ID NO: 524649 - DNA, 383 bp, Homo sapiens
ctgccccatttgctgcctgcgctggggttcaaaaacaagactgtccctaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttggattttaaggaaggaattatcccatcaaggagtcaggggaaagtggctggaaaccaacgccctaaaagttacccctcccggttcaggggaaatgaggaactaaagaagaccatggggtattttatttcccaaacggtcccactaaaaaaccttttcctttttaaataggccttccgaaaa

SEQ ID NO: 524650 - DNA, 950 bp, Homo sapiens
ggaactcgggcgggtaggcgtctgcgctcggttgagggctcggcgtcgggtgttcccggtaccttcttgctgcgcggatgcacgctacgggaattcggcctgacccaaaccccatggcttcagaagagctacagaaggatcgtagaagagtgtaacaggtgttgcttggtaaaaatggctatgtaggaaacgagtacggtgatgcctcttacatgctgaggaatgcaaagattgagagagatcgtctaggaccaaggatgcatggagaagaattatggaagagatgcagaatcttctgattggtgagaaagatcagctggatgtggattggtcgccagtgaaaggggtgttatacggtgaaccatcagggggagtttatggagtgggactcaagacgagataagttgtgagaaatcctacattaccttgactggagtacatcaacgttcccacgtgtgaactgtgcaggtgcatgccacagagaaggtcatgggagcgtttagagtgccacgaatctataactggctacagaggtgtcgatgattgtgaacgatcgctgggaaaccgatctctgtgcgcaggcagttcaacgcaagtccaggactgctacaaggctcaatattgtgtgaccgcggcgggaaactgcccggtgggatcactgacccaggttgcaccggagtggggagacaagagcaggcctctagacatgaacatcgtcctctgacgttgggacatgcaagagagctggacgacggcgtgctcgtacgacctcaacgccggtggcacggggggacgccaggacggaacggataaggaggaacgtaagaggccacgtgtccagcgacagggcgatcacaggacagacacacaccagaggcgacacacagggagaagacgaacagaggaacgaagggagctcgaaacaacaacgaagcgtcagacggaacaat

SEQ ID NO: 524651 - DNA, 613 bp, Homo sapiens
ccatcctgaacaaccaagatactacatgcttaagtccaaatgtgctagcttacttcagtgtaataacaaatttgagaattattggtattctggcctggattggccatggatagtagaccaggaccagtatgtttcacatctacacaatattcatcttcaagatttgtctccataaatggactggccgtcggttcaaacatgtatggtgatatctcctccttggcaaacaaaatctggaattactctgtgaaaaatggaattctagaatccaaagcctttctctccagtgcatagtgctctgaagttctcagcagtccgaggaacaatgtttgaaaataattccatagttatccgccctagaggttcaccgtccgcacaaacaccaaaaaacaccacaggattggtctcctttgatagttctgctgccagtgatacatgtcctttctggagtttcattaaattctgctgacattcttcaaatgttttcttgaaacaatcagctacttctttagttttaaatctcactgcaagctgttctacttttgcttctccatcagcataatctgaggcagtccaaactaaagcattatttgaaacatttacgggctttaat

SEQ ID NO: 524652 - DNA, 167 bp, Homo sapiens
gcaggaggaggaagggaagagctggtaccctgggcgatcaccacataccaagccctggacggctagtgactaaggaggcgggtagactgtctagctagcatgctgcttatagtcatgcgagacgcactgaacagttgagggacatataggattactggagggagccc

SEQ ID NO: 524653 - DNA, 111 bp, Homo sapiens
aacatattaaagtcgtgacagaatttcaccaggtaggcccacggctggtctcaaactcgctggcttcaagcagatctgcctgccttgcgcctacccaagagtgtttaggat

SEQ ID NO: 524654 - DNA, 272 bp, Homo sapiens
gaattctggatcctcgttgggggaaatattagacatctgagactcaaaataggaggatttgggtagattttcatatatctgttataaaatggaagcattattattatttatgtgtggtaaagccaacagatcagaagacaactgccattgaaaagagagtttgttactcacagtttcctggaggaggagcatgcagaaccacatggggaagcacctaagcagaagtgcagcaagacatgccagcagagtccttactgttgggccttccagga

SEQ ID NO: 524655 - DNA, 868 bp, Homo sapiens
  misc_feature (1)..(2): n is a, c, g, or t
nngctccctcgctggcggtgggtatataacagagcggctttgtgtgagccgcccgcgtcgtcctggggcagcagcccccccaccgcttgtttcgcgcccccagtagcaaacagcccccgggcggtagtcactccctctagggtggtttgtcttatgagctgcgccggcgggggtaacaaacttttttcctcaccagcagaagcgcacgcagtctagctcccgcttcgtgcgcgcctcttttttgggaggagaccacttagtgaacacacaggttcgtgttgtagacagacaacacacacggcggtgggtgtttctcgttgcctcgcgtttttctcccgcggtgtattgtttggtccacgcaccgcgcgtcctccgagcgacgcacgcggggtggcctcggctggggtgtgtcatcacaccacccacgccgtgtgaatacataaaagcctgtcttctgggaggcgcggcgcgcgtggtctccctcatcgttgtgctcccccagtgtcttccaggggggcgtgatggtggtggttttatcctctccttcgccgcccccgccccccctctctttaacacctgaggggggtgaaaggctgctctcttctcgcaaaagcattttgttttttcctgctgggccgcctctctatgatgttttgttaggtagtggaagtgatggtggttgtagaatgaacagcacgaccttgttgctacctctctgcccgaagagaggaagaattatatttttgtggccccgccggctgtttttttttttggccggggccccttttatttttttttttttttaaacacctcttttttttggggaaacccccgccccccaatttttccccagttttgggccccccta

SEQ ID NO: 524656 - DNA, 269 bp, Homo sapiens
aacagtggatacgctacatataaaattcaggtagatatgtttttcatctagcatattaatgttatcagaatcattagcttgcaatgattctaataaaaagtttgctgtaattcttaccttatgtaatagtttgctagggctgtcatatgaaaatagcacagactcggtgtctttttttttttttttttacaaatggattatcaccccgccccccaggttgaagtgctgtgttgcgacctcagtcaattgcaccccccacctcccgggct

SEQ ID NO: 524657 - DNA, 225 bp, Homo sapiens
tgaatggtgatctaacgacgcctatggtcctgtggctgtcagatccaaagttcctgtattctgagcttccccgctgatgcagtgcttgacagattgcacacgaggacgaggcactggagattcttcaccgtgtccacgacggagccatagctttcctctgatttctatgcttgagaggatgtaaccattgttgaccctgttatgacttctgaccccaaactgaac

SEQ ID NO: 524658 - DNA, 496 bp, Homo sapiens
tcgaggaatctgatgcgagaatagtagcagactctgatcagctgacttcagtgatgattttagtgatgattttgttacatgctcgtcgaaggcggtcaaggagaaatcagaaaagactaattaactactaagaagactcagaaagtgacggttcccagaacattttgcgacgtggtcactaattaaagcgagttcacgagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagcc

SEQ ID NO: 524659 - DNA, 281 bp, Homo sapiens
  misc_feature (32)..(32): n is a, c, g, or t
  misc_feature (50)..(50): n is a, c, g, or t
  misc_feature (58)..(60): n is a, c, g, or t
  misc_feature (239)..(239): n is a, c, g, or t
  misc_feature (259)..(259): n is a, c, g, or t
atagattttagcatttcattagggcgaggtgntgtcggagaatgagctanggataacnnnaaagtctgcctaaagaacgagagattagagccccgcagaccttcttgaaaacttaacacccctcagacccccaaaactctaccccctcacacagcctcacactcacttggaacccttctgccccctcaaattaagcccctcacaacaactggcttcgacctttctaggctgtacctccnataaatattttaattaatgnattcctacagatgctgggagcc

SEQ ID NO: 524660 - DNA, 772 bp, Homo sapiens
tataatgtaatatatataggggagtttttaaaaatttaattattattattattttttttttgagacagtctccaccatgcccggcagggagtttattaagtaataacttacatggtcacaaggtcccaagtagctgggactacaggtgcccatcaccacacccagctaatttttgtatttttagtagaaatgggttttcaccatgttgtccaggctgttcctgagctcctgacctcgggtgatctgcccgcctctgtctcccaaagtactgggattacaggcgtgagccaccatgcccggcaaggagagccagtccgagtctcaaaactgaacgaacttggggtctgactgtatgagggcaggacagcattcacgcagggcgcacaaagcatgtagactggcgcaggcccggcccatctctctctcacacaattcctcatgccctgcttcactcctccgctgccacacctgcattcagatatgtgccctaccacgatcacagcacggactctgcacttcccacagcccactgatctccacatatcacctctctactcccggcaaccacaccaacacacaccacaccctaaccattaaactacttccgatattacccctccaactccccaacatccaaactccagacaaccctccacgcactatacacccaatccaccattgacaccccacactcgattcgaacgtctaccacactcaccagataattttcccctcggccattacaacttccatctcaattctcccaaactac

SEQ ID NO: 524661 - DNA, 297 bp, Homo sapiens
tgtgtggaggaatacgatttgcacagattacatcacttttcagagttagagtagcataatagcttggaaagtatagtaaacagcttgacaaagcaggagtacattcaattccgtacatatatactctatagtttgtgacgtgaccatcatttctgctggtttgcaggtgtaagaattaaaagaatatatttgtacactttagcatacttgcggctaccaagatcccgatctaagattcttgaggcactacgtctctacctcgataaagtatacagtattctaacagacatttttgaa

SEQ ID NO: 524662 - DNA, 368 bp, Homo sapiens
gcacgaggtagcatttatcaacactttattcctttttgtgggtaaataatattccattgtatggatataccatacgttgtttattctttcatcagttgatacacgcttgggttgttgccacatttagctattatgaataatgctgctaaaacactcacatacaagtttttatgtggatgtatgttttccactcccttgggcatatacctcggagtgggattcctgggtcaacatagtgagaaccccatctctacaaaaaatgtaaaactggctgttagtggggcacacaactgtaggtccatctattcaggaggctccggtgggaggttaggctgtagtaagcccaattgtccactactccaaccagg

SEQ ID NO: 524663 - DNA, 1432 bp, Homo sapiens
  misc_feature (1432)..(1432): n is a, c, g, or t
aagattgtaaactgaagatgaacatgattatactctgttggaagagcctaagaggaaactgatgacatgagtttcagagagtaatgcttaagccactcagtgtacgacaggatgcgcagtcttgtcgtttgcctcttctgttaagttgacccactacgagtgatttatgtagatctgctaatgggttgccaaccacaaccgatagcgttagacacttgggacttcagatctacatgagaggattgcatatacaagtatctcctggtgtctccgatagcacgtgccttcccagggaacgaggatcttgcgcgatcagcaataattcaggtggttgtcctttctccacttgtgttgctaatatcagtcggtccagagaagataacgccaggtggtctgcacttcagccagaggggcgagatgcagctataccgtgttctatcaccttttctagtccgtcactctagtcttgataagcatttaatgatcgtcagcgtgtgagttgtaactctattaattatacatattgaacttataagtcttcaatttatacatttaattattgctgacgatgggaaggttccaactcgtgtttcgccaggcctggacgtgagatgtgtgtacaaatcatgtgggctcatcatgggaaggcatagcgactctcccgaggatttcaaagcaaaattctttccctgtggtcaagccatcactgaagttggctggggactaactggggggcggtaacctgttctttaagatagaagcaactgggggttttcacccaatgttcgtgccaaccgaatgggtcttctaagttccgcttggagccctattgttgtgaatctgtggcataggcctcaaaaggtttgcgcgcaaagagttgcgttggagatttcaactggtgtgttttgacgcgatttacaggatcccacggttttgctctatgtttgtcaagctgtgaaaagcctaaaaaagtttgtatggcaataagtgataacggaagagagggtgatctataaaggagactggacacaagaggtatagtaaagaacagaagctagatctaatgaacaaaaacgcggacctttcgtggcaccacagggtgggaacagcgagggggacaagctacttgagaacaattaaacccgcaagcaggagacaaaaaaaacttggagcacaaacactacacaaaaaaaagagagaaagaaagggagggcaaacaacaccagaggagcgaaatgttagaagaacaaacaacggagcggacaacacagaggaaggatacagaacaaaaagacgagcaaagacacactacgagcgatcacaaagatatgagcaccgacccaaccaaccataatatagcaggcaagcatcggacgaacagaccacaaacaacactactcctccctcccgatgacaacaacctccactgtgn

SEQ ID NO: 524664 - DNA, 274 bp, Homo sapiens
  misc_feature (2)..(2): n is a, c, g, or t
  misc_feature (65)..(65): n is a, c, g, or t
  misc_feature (67)..(67): n is a, c, g, or t
  misc_feature (94)..(94): n is a, c, g, or t
  misc_feature (131)..(131): n is a, c, g, or t
  misc_feature (154)..(154): n is a, c, g, or t
  misc_feature (198)..(198): n is a, c, g, or t
  misc_feature (216)..(216): n is a, c, g, or t
  misc_feature (226)..(226): n is a, c, g, or t
  misc_feature (228)..(228): n is a, c, g, or t
  misc_feature (235)..(235): n is a, c, g, or t
  misc_feature (255)..(255): n is a, c, g, or t
  misc_feature (263)..(263): n is a, c, g, or t
  misc_feature (267)..(267): n is a, c, g, or t
gnctttcctcttgaagaacttccactggactttgatggcgagtattcagtcgttgatggagggcntntggcaagcggaggtgcagacatgcgcntggggggggtggggggggccggagcggggcgcggggngggggcggggcgggggccgggcnggggttgggagggcggggccggcggggagggtcgcgccgcgggngcccgcgctttacttgancgccttttgngntttttgngacgatttggtgaatttgcnggcgccgngctnttttttt

SEQ ID NO: 524665 - DNA, 111 bp, Homo sapiens
tcccagacctgcgcttatcagctatttgactcttatctctgagtttgaagattttaatctataaaacaagaatagggccaggcacagtggctcatgcctataatcccagca

SEQ ID NO: 524666 - DNA, 165 bp, Homo sapiens
ttttttaaaaaaaaaaattttttttaccccttttgggttttaaatttctttcccccaaaacccaaaggcccggttttgtttttacccttgggaaaaaattaaaaaaatttggggccttttttttttttttccccccggaaaaaaaaaattaaccccttggtttta

SEQ ID NO: 524667 - DNA, 164 bp, Homo sapiens
tagaggaccgccagaggacaggaggatatacaaggggagggacgggtctccatttaaactttggaccacaaagtgcaaggggacactcagcacctctaagaaattctatattttcctaaaacttaatccctactccccaaaaggactctatcatgccttctcct

SEQ ID NO: 524668 - DNA, 166 bp, Homo sapiens
tgtgtgtgtgtgtgtatgtgtatatggacatggcctggtgtgtgtgtgtgtgtgtatatatatatggcatgtgtgtgtacatatatatatatatggtctctgtgtgtgtgtgtgtgtgtatgtatatatatatgtgtgtgtgtgtgtgtgtgtgagacccggtgtg

SEQ ID NO: 524669 - DNA, 368 bp, Homo sapiens
tataaagaggtcccgtggaactacacgtgccgggagctggcacctactgagtggggctggagaacggaatcccacggggacctgatccggtgcacggggctcacctaccagtgcgagcctggcttccagctgctaggctcctacattcttacttgccagtgggacctgtcttgtagcgcctggccaaccggctgccaaaagatcatgacttgtgctgaccctgtcgagattgacaacggtcaccgaaccgcctcggacgccggcttcccatgtcggctaccacgtccagatccgctgcctgacatggtacatgctaaatggggcaaacatgctcacctgctacagccgggacacatgcacacgcaagt

SEQ ID NO: 524670 - DNA, 100 bp, Homo sapiens
tttgagtagcagagattgaagagtacaaatctgaccaagatgttgatgttggataagagaatactctgctccccacctctaaagtagcccgccaatcgaa

SEQ ID NO: 524671 - DNA, 373 bp, Homo sapiens
  misc_feature (57)..(57): n is a, c, g, or t
  misc_feature (59)..(59): n is a, c, g, or t
  misc_feature (314)..(316): n is a, c, g, or t
cttactttttttctacggagcgcgcattgtgttgtacagggattcggcattttgccngnggagctttattttttaatcgaacagggcttaaaaacccaccgggtccttaaattccaaaccttgttttaaaaatttggtggggggaccctggggaaaaacccaccctctctgggggtttttttttatatttttcccccggaaaagggggcctttttttttttttttgggcaccaatttttccccccgggagaaaaatcttttcttttgataaaaaccccccctttttttttttgtggacgcacacaaaaaaaaannngggggggtggtgcccccgccccccccccttctgtggtgggggaggagaaaaaacaac

SEQ ID NO: 524672 - DNA, 271 bp, Homo sapiens
  misc_feature (6)..(6): n is a, c, g, or t
gtttgntagtagtatttagggttggaaagtggtcttcccagattcagacaaggtttcacgtgcctcgccctactcaggatactgttaagtaaaaaagagttttcatatacgggagtatcaccctctatgcttaaactttccagattattctattaactctttttagtctatgttacagtcctacaaccccactagtaaactagtggtttgccctcttacgatttcgctcgccgctactttcgtaatctcatttggcactgtttggactctg

SEQ ID NO: 524673 - DNA, 1418 bp, Homo sapiens
  misc_feature (1093)..(1093): n is a, c, g, or t
  misc_feature (1160)..(1160): n is a, c, g, or t
  misc_feature (1174)..(1174): n is a, c, g, or t
  misc_feature (1176)..(1176): n is a, c, g, or t
gatcatttttaaatgtggtgttgggagacttcgctgatataagaggtgtgggcagacaaccaaatgacgtgttgggggtgtgtgtcccaccgaaagaaccgtggtctaccaccgaaggagacacatggtttttcgtaccgacgaccagcccccctgtggggaccacccagaaagaacccctctgcacacagagaattggggcgccgcacctttttttggggagtttcgccaacaacaacgcggggggaatttttttctcttaagatgtttcttttttgtggccgaacacccaccacataaagaaataatattgtcgggggagacaattggggcgcccaaaaaacaccacggggtaatgtgttttgacaccccacatttgtgaaccttccaaaaaagggggaaattaaatgtcctctcccccacccgcttaagcttgccccaactgccgtgtggaggttgtataagatgtgggtggcggaaaattatctgtcctatatattaaggcgagaacattttatatggcaggtgatatatctcctcgttatgggttaccccttgtgggagaccccccacgagaaaaaaatagtgtggggatatatttgtataaaaagcacccggagatgcccctaaacgccccggtaataatatatgctttttggagacataatggagatcgccccagaaagatgttctcacaccccgcacatcggctctttgagaacacacgctgtgtttgcccctctatagagaaaaaaaggctctttttgcatattatctctattctccctcgtgttgacacacactatttttttctcctgttatatgtttaagaattttctcggctcttgcgtgtgttttcctctgcgcacatctggcacatctttaaatggagtgccccctcttgtgtctccgcccacacccctctccacacaccacacatacacactctttttgtgataagaatgttatacaatgagagtgtgtgtatacatcacttgttatacaatgtgagtgttccccgctgaccacactttaggtgaagagcactctcgagagagacacacacaatgtttctagaaataatatgtgtttnctctctcacacaaggggctcttgtgtataacccacactctcactctgtgtaacaaagggagacagtnttctctctggtgtntnttggtgtttgtgtgtgtgtgggtgtacgccacttatgtctaatatatttgacttttaagaggggtaacacttaaactccacgttattttttaagcctttttatgaacctttgagtcttgctaagggagttctccacaataatctctcccttgagggcctcttttatattttttaaatgagattataagatatgtgatttgccttgttatgtggctaattagtcggccaagctggaagtccca

SEQ ID NO: 524674 - DNA, 653 bp, Homo sapiens
  misc_feature (560)..(560): n is a, c, g, or t
tggtgcggcgacttgaaatctgtttacccacaatctgctgagctcgcatgtgcggggggtggggtcccgtggtttccccctgcgcctccaggccaccgaggtccgtatctgccctggtggaatttcaaccccaatttcgtgtggcgcgttatgaatacctaaaggtggaggtggctcggcgtcccgtggaggcggccgataacttgcgttctgactccaggtgccgaaagggccggttgagggatatgaggagaagtgaggagtttctctgaggaccagtgcaccaccgtgcgtgctggaggttggaagtgatagagggcacccttgcagttgcccggaatcgggacgttatgttccccatcagccgggggatccccaacatgctgctgagtggagaggaactgacagtcgattgtgccagggcgcaagttttccctggtaaatggacctgggtatctcggtggatctataccctgtttccgaattcggccggtgtgtttccccaacctttgacccattgacaccaaacacagtgttttagagctcggtatatatatcgntctcattaagggtttaaaaccctagaaaaaaacatcaatcacaacacaaacaaaactttttggcgccctgggcccctgaaaactttttaaaac

SEQ ID NO: 524675 - DNA, 365 bp, Homo sapiens
ccccactcgaatatgtaacggagatgctgagaatcagctgtttcttttgctctcccagcacgaagtctttgttgagagaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattcttt

SEQ ID NO: 524676 - DNA, 849 bp, Homo sapiens
cacgcgcgagccaccatgacgtggcatgaacaggttataaatctttataagttaaagcaaataggccaggtacaccagggttggaaaaaccacactaggcaaagaacgttgcgtcgaaaatcaggactgaaatacattaatgtgggtgatttagctcgagaagtctgatcatcggatatcatggcagtcatggctagagatcggcgttcttcccaagagcgatgccgagatagatgcacagatgatggcgacaaatcctgaaggtatatggggattacagaatatgagccaagagttataagtcagatgttggagttgccttccgatatgtgagcacaattgctagatgatgcaaatagattcattcaagccatgctaagaaagctactgttgatgcagatgatgtgcgatatggcaaatccagtgccgcgcgtgatcagtcttttatgcgtctcctcccctgaagagatttgttacttagatatagcaatggcatagaaagtcaaacccgctttgcctattgatcaggccatattcaggtactaggttgccatctgatagatactgcttaacagctccaaagtataggctgaaatctttacggaaaaaggcgctccatctgtctgcgtggaagaataacagtcccgggtgcaaggtgttggtctcagtttactagcagaaccaagttactcccacatctaggcagcacgcaatccactatagacatgatttgttcgaacctaaaagtaggggactcccatgtccctccacagggtcacaggtgtacgggtaccagattgcctactttctacagtcctccagctgtgaacagcttcgaattcctggcac

SEQ ID NO: 524677 - DNA, 328 bp, Homo sapiens
  misc_feature (108)..(109): n is a, c, g, or t
aaagaaaaattgggccaaggggccagtggcacaccaccctgtaatctgggcctccccacagtgctgggattaacaggccctgagccccccggggccggcccccccctnnattggagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctcta

SEQ ID NO: 524678 - DNA, 420 bp, Homo sapiens
gcggatccctggatagcgctcgggttacgtaggtttgttgtgggtgtgtgtgagatggagtcgcccaggctggagtgcagtggccgtgatcttggctcactgcttgctctgcctcacgggttccagtgattctcctgcctcagcctcccgagtagctgggacagtgattctcctgcctcagcctcctgagtagctgggactacaggcgcatgccaccatgcccagctgatttttaaatatttttagtagagattgggttttgccgtgttggtcaggctggtctcgaattcctgacttcagcctctcatagtgctggcattacaggtgtgagccaacatgcccggcccactttccacattttcgaagagtgaaacgaaaaaggtattatcatggtatctcttcccctaaaaccacacatgc

SEQ ID NO: 524679 - DNA, 422 bp, Homo sapiens
ggtagtggtttttgctttcatatctagtgctcctttcaagatctctgtagggtaggtatagtggtaacaaactccctcaacatttgcttatatgaaaaggatcttatttcttcttcacttaggaagtttaggtttggctgggtatgaaattcttggctgaagattttttatttaagaatattgaatataggcccccaatctcttctgacttgtagggtttcagctgagaggtcttctgttagcctgatggggtccctttgtaggtaatctgccccttatctctagctgcctttaacattctttctttcattgtgaccttggaaaatctgatgattatgtgtcttgtgggtgatcttcttttttttttttccttttttttttttagttggccaaggggaacccccggggtctcctcttgattc

SEQ ID NO: 524680 - DNA, 150 bp, Homo sapiens
gcgtttcatacaggtttgggaatctgtcatcagtcgtttgattgataacatgttctggtatgctgtaatctgctgagtattgtgtgcacgtcgtgaacagtcattatctcatgctgatttactttggctgcacctaggcgctatcaagta

SEQ ID NO: 524681 - DNA, 156 bp, Homo sapiens
cagaagtcatcaagtagaacctcagtttgctaactgaagtgttttattagtattttactctagcggtgtaattgtaatgtagaacagttgtgtggtagtgtgatccgtctgaatctaactagtatgggagaaaaagtcgagttaccgtatactagc

SEQ ID NO: 524682 - DNA, 507 bp, Homo sapiens
ggtgacagaggaaaaaactaaaaatgcctgttttttttgcatgaacacacgcaatggttttatcaacggatgaagaagtttgccgaatggtggtgaacgcctgaagacctttcccaatcttcccaagaacccggccctttccctggggaaaattttgattccaacccaaaatttcccctagcttttttttgataaaaacctttcccaatttggcttttcttgaaaaaattttgccgctactatttaacaaaaaaacttgctctctgggaaaaaaaacaaacaaccaacttccaaccacctctgaaccacatcccccccccccattccaacccactttcttcgaaaagagcaccattttcttttcccccccccttccccaaatttttttttttcttcacacatttttttcacccccccctaatttttccctttttttccacaaaccccctatatagaggggctttaaaaaaatcttacccccccctgtaataaaaaatggtggagtgg

SEQ ID NO: 524683 - DNA, 502 bp, Homo sapiens
tagacaaagtttcgctcttgttgcccaggctgtagtgcaatggcgtgatctcagctcactgcaacctctgcctcctgggttcaagtgattctcttgcctcagcctcctgagtagctgggactacaggtgcccgccatcacgcccggctaattttttttttttttttgagatggagtctggctctgtcgcccaggctggagtgcagtggcgccatctcagctcactgcaagctctgcctcccgggttcacgccattgccattctcccacctcagcctcccaagttagcttggggctaccaggcgcccgccaccaacgccgcggcttaagttttcctggtattttgttttttaagttagagacaagggggttttcaccaatgtttgggccaggccttcttaagcaaccacagttcccttcatttgaacccaaaccggtttctattgctccaggtagaagttcattccaggtcccgttatgggttatttagggccggagaaggag

SEQ ID NO: 524684 - DNA, 100 bp, Homo sapiens
ttgactccttcatttctaacagaggaagaactgtattatcaccccttatggtctacccatgaataaatacaatatttgttcaagcacccaaaaacaaaac

SEQ ID NO: 524685 - DNA, 101 bp, Homo sapiens
tcactagacacggagcctgctggagctcttggagctctgtgtggggcactgggggaaggagtgcaggcactccaccctgtacctgcccctaacctctggat

SEQ ID NO: 524686 - DNA, 758 bp, Homo sapiens
tcgcgtggatcacctgcagtgctcagcgagttctaaaccagtctggccgatcatggctataagctccatctctatctgaaagatatacgaaagaaaattagcttggtgagtggtggacacgatgcctgtaagcccagctaatcgggagagctgagagcaggagaatcaccatgtaatgctgagaagagtcatgggcgattgaccacggtgatgctgtagcaagtctcgagccatttgtcagctcacaggctcttatgggccacaatcggacgcagctaacatagcgcctttaccgctcacacatacaatagtgcggaaccttgaacacccttagtaccctgaaagcactctcgggtagatgccatacttggtggatatcacctgttgggaactacccccaacgcgagagctgacgtactcgcttcatctggcacgtaaccggcaacagcagatgcttagaacaccgtaggccattgccaccgactttacatcgcgcctccaggacaatccccaacggtacactccagggcgtcgatcaaccctttagcaaacacaaaccgctagcacacattgctcacccacacgcatacaccaacaatcggacgctcgctcctccccctcgggcgtccaattcccaacattacatgtccccagctaccaccttcttccaactcgcccacgcttccatcacttcaccgctccctctacacacctgcgaccctagccccaacacgactcgtcgccccctaaggcccctc

SEQ ID NO: 524687 - DNA, 658 bp, Homo sapiens
gaccgaacgcggtgtgtcggcagcgttcgcgcgggggcctgcgaagctgctgctcggggccggcactgcccgttgggatggacgcgccgccgactgacacaccagacgccgcacgactgccgccgaccatccagcctgggcacatgccgccgacgtacctggcggagccgagacacaccgcagagctgcaggagtaaacaccgacaggagtcttgtgagccgctgaagaagggaataaagagagatgcacgggattatgtgaggttacggcagccccagctgcaagatgcacatagaccgagctgaacccgggatcggctgacttgttggaaccggacgtgctctgcacggacgagtggctgcgattgacgcttgaacgatcagaccattcaccgagggcaataaatataaaacaaagacatgaccgacaaaggacaaacacgcagacagaccagagaaacatccaaatttcaggatctaaagcacaaactgactaagacgctaatcaaagacacaacatcaaaaaaaaaaatacaaccatcaacaacattatcaaaattacctaccaaaaataatgaaaacaaatacaatataaaaaaaaaaaatcaacgaataataaacacaataacacttgaactacaaaaaaatacaaacacca

SEQ ID NO: 524688 - DNA, 343 bp, Homo sapiens
  misc_feature (61)..(61): n is a, c, g, or t
  misc_feature (163)..(163): n is a, c, g, or t
  misc_feature (165)..(165): n is a, c, g, or t
  misc_feature (176)..(176): n is a, c, g, or t
  misc_feature (251)..(251): n is a, c, g, or t
  misc_feature (299)..(299): n is a, c, g, or t
  misc_feature (303)..(303): n is a, c, g, or t
cttccaaaattgatgatatctggaaccttgaagtaaaagaaaattttgctggagaagccanactccaacgcatataatcctctgggagcacagtacgaaaaaccacttacagctagaggcctctttttcaccaacggagaacatacaaggaaagccaccctgnantctctccatgnaaatgtcagctcttgttcaggccatgaagtcagcccagtcctccatgatttccctgccttgccagaagtgccctnatctaacactaagaaccagaagatcagatggaaaaatgaagtccggantcantctgggctttccagaccacgccgagccctatgctatttca

SEQ ID NO: 524689 - DNA, 183 bp, Homo sapiens
aatgggtaaaaagaaaaaaaagggttgtaattccccccccatgtaaacctgctcatggagttgaaagtaattaaggtttgatacactgatatcaatttttttatgtaactaaatccctgttttataaacttgttaatgaccaacaatttttgttttgattaaaattagttttttgaaagttga

SEQ ID NO: 524690 - DNA, 94 bp, Homo sapiens
  misc_feature (52)..(52): n is a, c, g, or t
  misc_feature (78)..(78): n is a, c, g, or t
ctaactctgtttttttttaaatagaatacttaaaaagataaatagaatactnaaaaagttttaaaacatgaacccttnaaagagttcaagaaag

SEQ ID NO: 524691 - DNA, 855 bp, Homo sapiens
ggaggaatattcatttttaatacacacacacacacacacacacacacacacacacacacacgtgtatcagagtaacggggagtttctctcaagggatgtcatactcctagtgagccgtggacccgagtgtgttctattagtgtcggaaacaatattatcatcatatagtgtaactcgtgggtaacgtgcaatattcttctttcgtgtgctgctcgtgtcaacgaagaggtgtatcgatggtggcttgcagagagagtcgctcttatatatacatcagacgctatttctactctcccctcatatcgtggtattaagaaagggaagggcctatcaattagattactcttgatgagaatgttatctagaatctctcataatagaagagactataccctccgtgaccgtgatcaaacgaggggatcaccctatcgtctcttatatcaacgagctttcatctcttttcatgacgagtgttgtgtggtattgaagatgaagggttaaggggcaaaatttcgcaagtatatcgcttaagggaggagttctttttacacaacaaattcacgagagaaaatgtggggttgtgtgagaagatgtgcagaaagagctagtgggtttagtgtagagagagtttggggtctttaaattgtttgctgcttagaatactctgagtagtatactacaagagtgaagggacactattcatcgtgagagcatcctctctgaataagggatgtctgtcgtggagtctccaatattcagtaacaaacacttccttagtgcttaacacttcatttagtgaaacttacatttattcaaaatttttccgtgtgtatacttttcatacaaattatattg

SEQ ID NO: 524692 - DNA, 1688 bp, Homo sapiens
ggcgcccttttttggttttttttcccaagaaaaggttctcactttggtgcccaggctgggatgtggcacggggcacaatccacgagcccatctggcaggcctgggatactcgcttagagctccagggccattcctcccgatcttcgacgctctcccaatgtatgctggggcctacagggcttggcgtataaccaaacccgggctaaacatttctggtatatttattgtgtagaggacaggagaggttttcactatatatatttctccacagggcgtggctccccagaagctctcctgtggcgcctcacaggataatctccgcgcgcacaccctctctaggcgctctccacagagggtctcataggcgggtctaccacagtgtgtgtgaaccgcccattttttgcagacccacgtctcgtaaaaggcttggtgtcactggagaggtgttgagaaaaccccatcttatagggggctggtttcattatcacagggcaaaaggagattcgggatgcacggggcgttacagaaacttgagaaggaggagggggcgagaatctctccagcggtgtctctctctttttagctacagagcgctctccaggggcgctcctccaacgggttgggggctactacaggagagggggcgagcgcctccagaggctcatcatatgagcgctgttgtcccccaacaccaccgggggttgaagcgggtttggtgcgcccaccgatttttttgtactccccaggaggttcgtgggagagtgtcgctcggtgggccagttggagagggctgcggaacaccaaaaagaggccccggggactatatacgaggaactccccttaaacagcgcccaacgggtgggtgccacttaccgggggggggatacattcgcccagaaaaccgggttccgaattggacaaaggtgcacagggtctccaataggcaggggggccatgggcccttgggccacgtccactctctggggggttgcgccccccggcggaagtgtggcttccccccaggtgtcgggatgtttttcttaaaccgtgggaaagagaggcggcctcccacatgtaagggcgggcgcccctgagatttctttccaacccccgggggtagttcggcgtttcaccatcccgcgagaggctcaccttcctcgggggcggcaaccgacacctttctctgggggcggagaagctgtcagcagaccggcggtcttcctcccgtaggggagacaaaagcttatactgttccctgatggaggcaacccccgtgtacgaggagggagacaacccccctttgttctgggcggacaaagtactcccaccaaccgcggcggagtgtggcgttatacagaggggccgacccccgtgctgagtgcgcgcgccccacatggtgagccgagcttggtgggtgcgggctggaaaagaaagattcccgccggggcaacatagggtaggacgacgaccacctctggtatatcatgtcggcatgcgtgcgtgcagtcgcaccacaccagctggtcggtgtggtgtgttgattacccgccgcccgtgttggttgttcgtcaatcgcctccgagtcggtcctaccatataggttcatgcccgcatgtgctgggtggctcgtgctatgatagtgtttgatgtttgttgttcgttattgtatcttagtgttcatgtgtcgt

SEQ ID NO: 524693 - DNA, 394 bp, Homo sapiens
  misc_feature (28)..(28): n is a, c, g, or t
  misc_feature (82)..(82): n is a, c, g, or t
  misc_feature (96)..(96): n is a, c, g, or t
  misc_feature (368)..(368): n is a, c, g, or t
ttgaaaaacttgtagtagaaatgacaanagttaacaataaaggcccagaccatcacccatacccagtacagcctcacagtantcctctgcctttantcctgttttctctttttcctatttttgattcatatttgggcatatgggattcaggaagtttctttcagaaagtctaaaatcaatgggaagcttagctctggtataatgtagagaatacttgctggaatccaacgactttgatttgtgtctggactcagtaactgaccagaagatggccttgggtcatttattttacttctctaatccttagtttgctgatctttaaaacagaagaaagtaataacactagatcttgcttaccatctaagatncactgagaaagtcaaatgaaaaaaaa

SEQ ID NO: 524694 - DNA, 276 bp, Homo sapiens
ccttatcaaaggagggctggggggcaggctgtatcagcagggtagccagacatgctatgaaggacacagtgaccatactaatgtaagactcgggattagtacacacattggtggattaatggaaatgtttacagagtcccctaagcctggcaagggaatttgcttcaagctccgcctggccccgacaggcctccttatcaaaggacaccatttggcaagctctatcaacaaggagccaaacatcctacaagacacagtgaccatactaattatacc

SEQ ID NO: 524695 - DNA, 174 bp, Homo sapiens
gcgctgggctgcaggtctctgtcgagcagcggacgcgggtctctgttccgcagatgggggtttgttaaagtggttaagataaggcctacttgaggagataccaggtgaaatttagaggacgacgagaggttaaaactgataataatctcggaaacgcttggtgatacagttaaa

SEQ ID NO: 524696 - DNA, 1525 bp, Homo sapiens
  misc_feature (1525)..(1525): n is a, c, g, or t
ctcaaacgtgtttggtggctagcgatctccggtcttggtgtaggttgagggtatgtcgatcctcctttccagctgtcttgctgtgagtaaggtgtacgtgcacgtacttctttgccctggcagttgctcgcgttctggaaagagtagcgcagccttcatcggtccgggctgaacattttgcgatcacggtaaggtgtaggtggtagtgtcagttatggcaacaacgttcctcgcgtctagatgcagttgtcttacgcaggtagtaggtgcaacgcaggtcggcgccactgatactgtgcaccaaggccacctactagtgtggataatgtgcagaacgagaccttccagcaaccgagaagggaaccctcataaggtagagttaagtacggaggatcctaaccatgtgcgcagtgctcgatctcacctatgcgggatcttgcgcgaatgtgtcgaaggttcaagacacacctaaatcggggatagtcgagagaagagcggctcaagtgcatgaccaatattgcgacgaaaaatccgcgaagggcaaagattggcaacggaaggggccgccagcggcgtagcgctcgtagcatctcccttgcgccagagatagttcgggcgcaaagcggttgcaagcccatggatcgatagatagctcaacaatccaggtatatctcccacaagttactcggagggggccacatctccctaaagaaagcggaatcccatggttggactaagtaaggtataaataaaccctataggggtagaccagttaatttcgtggaactcccttttggttttggtctaaccagggaagtggcactttaatgggccacggcattgcacacttggggtgcaatccctcagatggccatgtggggcatacgctgtccctagttcggttgctttacatccaaagagaaaacataacggttccacttgtagttcttttcacacttgtaagccagtttttgctaacttacggaatagcttagccatattggtgttgtaaaacggacgaacccatggggggagagcgatataggcgcgtagagtggtattgggcgcctcgatgtggcgttggagagagggttaactaacacgttggagccatactgggagtcccttgtggggcggatccaatcattggcgcaaggggtccaaatattcgcattgggtggccgccagaaaggacttaagtatccgtttcgcgagagccatatcaaggggcccgttcccccgagaaggtgtgggcgcataagggcagacctaattactggggaaaaaggattaagcgtaaattggtgccgccaaagggctgttttaacattccttaacctctctcatcactctattggtagcgcacctgggggacgagaaacgattagttccatatgagcctcacgaggactagggggcctgataagaacatccccagaggggaagtttgacaagtcgcaaaatctattatcgcggacacactatcaaagaagctgtctcccccacaacaacttgtgatggtagn

SEQ ID NO: 524697 - DNA, 161 bp, Homo sapiens
cccatcattatttagagaagataggatgaaggtaggttggctggaccccagccttactctgtagtcacaacccagaggtacttttcccgggttgcagggtcaagttgatgtgtgttgggactctagtatagctggtttttatggctacatggttaccattc

SEQ ID NO: 524698 - DNA, 334 bp, Homo sapiens
acggatggtcacgctgtacgcgggtatcgcccggggagggctcgtgctccgtgggtcggctcggtcacgggcgcgtcgagctggaggcccaccaggatcgggttgtggtccgaggaccgccactggtccgcggagtacaggtcctcggccacgtagttgtggcgcgagtactccagtgccacggattcgttcgcgttgatcatccagatgtcctggccggtgatcgccgtcgccgccgacggcaaggcgtagatcccgtccaggctgccgacggcgccgccgaacgcgtacaagtactcgcccgtgagcgcgccctgcgagaggtacccggccg

SEQ ID NO: 524699 - DNA, 110 bp, Homo sapiens
agcattgtgtactcagtgtcagattccgaagatgcctctttttgcaagtcttcttgggtgtggcattgatcgatttccatgtcgatccattttgcatatcaacttctata

SEQ ID NO: 524700 - DNA, 344 bp, Homo sapiens
actttagacggtgtgtttaaactctaaaaatagtcatgactctgccacaaaatatgtcagtgtactcctggtggccaccctgagagatgtacatggaactcagaagctgcatggcctcaggacagtgttacatgggacagacctggtcccagtgcagagtgaggagaagcgtgtgagatgtccctgaagtgcacctgggagaaatgacacgctggcatggattcaacagcatatcatcaagcatacacactcacaccacgctgcaagactggggccacagcacgacctcgccaacaaccaatcccttgttacaactcccgcctgtaaaggagaaaatcaaagac

SEQ ID NO: 524701 - DNA, 782 bp, Homo sapiens
agcggcgtggtggctcatgcctgtagtcccagcactttgggagactgaggtgggaggcttgtttgagctcaggagttcgaaactagcctgggcaatgtagtcagacccccttctctactaaaaatttttaaaaatcagctaggcatggtggcacatgcctatagtcctactcaggaggctgatgtgggaggattgcttgatcctgggaggtagaggctgcagtgagcttgatcgggccactgtactccagcctgggtgacagagtgagacctgtctcaaaaaaaaaaaaaaaaaaaaaaaaattatggggcaagaaaaaatgggctttgcacgctctctcagggaaaccaggagcacaggccctttacccttgttgcagagcagcttgcaagggccttaaaagcagccccttgaccttgagaattcttcctttcccctttcgggaaaactgggcagggctgggactcaatctcacttaggtgacctttccagcttccaccattcgatgtgaaagtgtgttttacatctcagaacccctgtgttccaagagacagcatggactcgtgggtgttcttcagccacaccatccttgtgtcacgcctcagggtgggcctagaacccttatagggggcgcctctgggagttcgccaaatttgcccagacttaaagcgaagggccttttctggtgggacaccggggaaccccttggaaagccaccgcgtcgttttccacaaccacacaatgtttgggcccccaggctgtgggtccaaaaattttcccca

SEQ ID NO: 524702 - DNA, 141 bp, Homo sapiens
cgccgcaccttgcgtagtggctatagcggtgccagtggtagtcagcagtggcttagagcctagggtaggaggaagcagctactcctatggcagtggtcttggcgttaggaggtaggctatacagttccagacagtgagcag

SEQ ID NO: 524703 - DNA, 588 bp, Homo sapiens
gcaaacatccacgttaacttcggtcctccttggcaatacaagaatctcgggaataggaaatggggtcttagcattagactgtcagcgttctaagtgtaagccgaacaaattctctcagagctttcaatacgtacgatttggaagagctcttgcggccatgggtgcccttggcgttctcgcatatagccaccacgaatgctgccaaggcgcaagtttcccgtccatcccgctgttcacctggatctgtatcagtattgcccctattgaagtatcacacggtagtgcacatagagcatgacctggtgcctcagaagtggtcaaggtgtgtcgttagcacggttaatctgcactacatgtcccctacagtcttctggcagatcgtcaacagctctgtctggtgatattgcctcatcatatagtgagtgaagtcagcgttcaccggccttttctatatgtaggtggaagccattgtctggcaaggtcatgtgcagctacattcatcattctggactccagactttcagccaatcctgcagcctgaggtccaactctcgctcgtcaagctaggtctaacaatctcgaccgtct

SEQ ID NO: 524704 - DNA, 339 bp, Homo sapiens
  misc_feature (6)..(6): n is a, c, g, or t
  misc_feature (25)..(25): n is a, c, g, or t
  misc_feature (216)..(216): n is a, c, g, or t
  misc_feature (263)..(263): n is a, c, g, or t
  misc_feature (307)..(307): n is a, c, g, or t
tccggngagcagttgtctgagcaanctctacaggtcatcatcctcatccgggagagcagttgtctgagcaacctctacaggtcatcatcctcatccgggagagcagttgtctgagcaacctctacaggtcatcatcctcatccgggagagcagttgtctgagcaacctctacaggtcatcatcctcatccgggagagcagttgtctgagcaacctntacaggtcatcatcctcatccgggagagcagttgtctgagcaacctntacaggtcatcatcctcatccgggagagcagttgtctgagcaanctctacaggtcatcatcctccccgggataaag

SEQ ID NO: 524705 - DNA, 544 bp, Homo sapiens
ctcacaaacatgagggagcatcagaactactcgaggggcttgttaaaacccagtgcgttagaagtcggatgcgggggctcacaccggtaatcccagcacttggggaggcccaggcaggcggatcacttgaggttaggagttcaagaccagccgggccaacagtggtgaaaccccgttctctactaaaaatacaaaagttagccgggggtgggggtgcagtgcctgtaatcccagcttctggggaggccaaggcacaagaatcgcttgaaccaggagacggaggtttcagtgaatgaagatcgtgccatggtattccagcctcggcaacacagcaggacggtgatttgctttggagactcctagatttgcgggggttgggaacggaattggtgggatgtgggcaagtgcctcttatgagcggttactttatcctgcattggccccaaaaagacttatctggaggtgagcaaagtatgtcgggtagtgaggtcacaaaggcaatcagccccttcctcccaagtcccatggccatcttctcagtcct

SEQ ID NO: 524706 - DNA, 967 bp, Homo sapiens
gtgcagccccgagccgagcgccgcgtttcgggagttgatggcagcaccactgtgcggccgcccggcgagcgcggagcgcaccactcgccgtgcccaggagcgcccaagatgtggggggcgcccggggcggcaagcggcgtagcagcgccaagggacgggggcacggcaagaagccctccggctcgcccgccttgtccttgaacctggcttcgttggccccccaaaagatttgttcacgccaaggtccaaggggaaccccccctccttcgttcctggtccagccagaggcacccgcccgggacaagtccttccaaaaaccaagggtgaaacgcgaaacgtgactcaaacggatccatcgtggacgcacattgggaaattaacgtccgggggcaggacccttggaaggggaccggtgcgccaacggaacttcaaaggggagaaaagctctctattaacgttaactcccaatctttccccaatcgtggattgcacacaccggggaaaccacatgttgcctggccaggccttaccagcggaccacacaggggaacatcagcgaatttgccccaaaagttttgtacaggctggcttgtgtcactgacttccacgtcctccccatttaaagtgtggtcccaacttcggttcgtcacacacagcgagggccactggttatcggagcattacggctatattaatcttctcgcatcaaacttctactttcagagggtgggttgccagatttgacccccttgtgctttgaacctaccgcggagggatgacatgcttgccgtccacacggaccgctgaatatacctcagtggcaagcaggctcagctagagaagtccacggtcgagctatgacggttataacccccggcacctcggttcccacggcgggaagcaacttcccctcctcaaggtgcctgttgtgtacccaggttgcctctcttgaccaggcctaaaggtc

SEQ ID NO: 524707 - DNA, 650 bp, Homo sapiens
  misc_feature (401)..(401): n is a, c, g, or t
tccaaagggagaatcccaatcttttatattacggaaagccatcaacgggggtgtggggagtatgtcaaagggttagtgaaagtccaggggattctctcctccaagtcctaccacacaaaggaaagctttcaaccctcctttttcacccctttcttaaattccccacaaaatagggggttggtcccaatattgtggtctccaatgtgattaaaacacttgtggtggtttaaagggttctcctccttataggacttagcagacaaagtttagcgctatattaccttttataatgtgaagaaccattataagcaaagtccagaagagggccttatagaggaaagccaagaagtctccttgggggagaaaacatctctatagcgcgttctcatatataccccagncatttttataccttatagggtgtataaatttcataggtctcatacaccaaagtcttggtgccgtgggttcaaacactttaacaaagggcacttgtagtgaaacaccccacaagaaagttcctcgagtggggaaaaaaacccgtggggagaaaattgttctttgataattcaggcgtgaattaaacgccagttttaaacaaccactgtgtacccccaaagcttgtggaaggggaaaaaccaattttcccc

SEQ ID NO: 524708 - DNA, 162 bp, Homo sapiens
atagaatcgagctcggtaccgacgatcacggcacgacagtgcgaggtgcgtttcacgcccgctactgggtgggcggcggcagtgcggtgaagatgaccgagcacagccgcttcctgcgcatcgacggccgttggtactacctcgacgcggtctgagcctcaa

SEQ ID NO: 524709 - DNA, 220 bp, Homo sapiens
tccccgtgacgctatccccaacactaaaataaatgagctatcaagtcttgaaaagatatgaaggaaacttaagtgcatataactaagtcaaagaagcccatctgaaaagagtacatgctgtatgattccaactatatgacagtctggaaaaagcaaaattatggacacagtaaaaagatcagtggttgccaggaagttgaaggtgttgggcgataacata

SEQ ID NO: 524710 - DNA, 188 bp, Homo sapiens
acttggtgcagctctttccactattggctttgcggattcttggaggaacactattgtgcagcgatctcgcggacagttacgatttgttgcacatcagcagcacttccagctccttgacgttgtggaccatgaacttctcggaagccactgtcgcagtatgtgctctgtgtttttgttgcttccattac

SEQ ID NO: 524711 - DNA, 489 bp, Homo sapiens
  misc_feature (408)..(408): n is a, c, g, or t
  misc_feature (435)..(435): n is a, c, g, or t
  misc_feature (478)..(478): n is a, c, g, or t
  misc_feature (485)..(485): n is a, c, g, or t
acactcctttcctgttgtttccattcatgccttaatgaatgaggcctgtgtttatttcattttgagagccttctatgtttcaggcataatgctaggcgtggagaccatgatagacaaaacaccctgctcttgaggagctcccatcagtccccaaagccagcgtaagtgtggatctgtcagattggttggttggattgcttcggtcccagcttcaggcctcctcccttggtttcaggttaaaactattcctttctcagccacctgtctcccaagaactgtggccactgaaaatccttggacttgccttggttctcacaagcacttttctcagtctgagtctgcacagagtatggctttttacccttttgtaaagccagagaaccagagaagagagcacggtattgtagnacttttaaaagcagggaaggtgtgggnttctaagcactgctatttattagttagggcaagggtactcagnatctttngatt

SEQ ID NO: 524712 - DNA, 892 bp, Homo sapiens
ccattcgtaacgtttgacctggtttacttgaggttgcgaactttacctcgcacttaagtccttttaattcttctgagctagaaatccggatcaacggaccttaccagtccctggaatggtccccagtcaatggatttcagtcccatgatcttgatttctttgacaacctcttgaagataagacagtgatgatgaccttgccatggaacattgcccatcagggacttcagggagattttgctccagattacgtatgattggggactacatgacttacagcttcctggcacaagttaggaactttgcaagactcaaacgtttggatccatgacaaaccagagccttgggtagcaatcagttaacagcttttatggacgattcctcagatgagaagcttcagagaaagcatagtgacaggctgaatttactagggcaattttcctgtaagaaatagagacttgacttcatctagtttgcttacacggtttccaatggccccataggaatatgcaataatgtagactgataaacccgttattttagtactaaagagggagccttggctatttcagtgggctataagtgttaaacatttttttaaatgaaaagtctgctacttgttactaagagatgtattttggagaatcttagataatagatgataaagtatatctagggtttatatttttctcgagaagtgttatctgcaatcatgtctgtagtttgcacagacttgttatgcactaagttcatctttgaaaaatatagaatatatggtctaatagtttttttacagcttgttggactaaagtattccacaaatcttacctctcttatggtcactgatggtcactcacgattcatgagtgccacattggtagactctacacccc

SEQ ID NO: 524713 - DNA, 420 bp, Homo sapiens
atgaacgctttgtggcacgatgacctctatgaaaaagagagatatacaggttttgcttttgttcactcaactaattaccaacctttcattatacctctactcggacatctaaacttcagttaagctctatgtttaagtgggatggatcttcaatttgcctacctaaggatttgaagtcaggtttacagaggcatcattttacaattatcaactttgataaatgcagattgtcatggaactaccaccagaatccagatagagaacatgctatcatccctgttatatccctttgtggctaatccaccacactgttccatccaccaaagtccctagaagccactgatctgttttatgtccctctggttttgtctttttcaaagtctgaaataaatggaattgtggagtgtgtaaaaaaaaaaa

SEQ ID NO: 524714 - DNA, 482 bp, Homo sapiens
ggggtgggttttcatacaaatatggttgagagtatatacggagcaccgtgtctcagtgaacgaaggacttatatgtgttgtacagaattgcaggccagtagtctctgtttatgaaatcatgactgttccctatgccacagagaacgatattgtgcgtttatactagttgacacaactttccgttaagagcgacctctcattaaaacatgtcacgacacactggcgtgggatactctccctggtgagaatagactctagttgggggatgatcttaggtacctatgcgatacttacggcacaatgaagtaagactgtgcggcgagaactattttaccgcattgaacagacgaggagctaatatgcactgtagggaggcttggtatactatctaaattccttcataggcagattttcactgttgtgaagaatagcatgaacctgatgaagagcagacacattttgcagttcctgagtagagatca

SEQ ID NO: 524715 - DNA, 352 bp, Homo sapiens
aacgtcaagaagtacttcttgccgaacgcctgatcgcgctcattcgcttgaaccctgccgcccctcgcgcggcgccccgtctcttctagatctcaaggatttccgtcatgtctcgcgtcaaacgcggtgtgaccgctcacgccaagcacaagaaagtctacaaggccgccaagggctattacggccgccgcaagaacaccatccgcgtcgccaagcaggccgtcgaaaaggccggccagtacgccttccgcgaccgcaagcgcaagaagcgcaccctccgcgcactctggatccagcgcatcaacgccgcggtccgcccgttcggcatgacctacagcgtgttcatcaacgg

SEQ ID NO: 524716 - DNA, 443 bp, Homo sapiens
  misc_feature (120)..(120): n is a, c, g, or t
  misc_feature (129)..(129): n is a, c, g, or t
tcagtagagacagggttcaccgtgttagccagaatggtctcgatcttctgaccccgcccgcctcggccttccaaagtgctaggattacaggcgtgagccaccgcgcccggcccagtccanccattttantcagatttccccagctttacatgcattcaccttgcacgttttttgtttgtttgttttgttttgtttttgagacagggtcttgctctgtcgcccagactggagtgcggtggtgcgatcaatggctcacaatagccttgagctcctgggcttaagcaattctcccaactgcttgggaggctgaggcgggagaatcgcttgaacccgggaggcggaggttgcggtgagccaagattacgccactgcactccagcctgggcaacagagcaaaaccctgtctcaaaacaaaaacaaaaaaacaaacaatcattacatcg

SEQ ID NO: 524717 - DNA, 159 bp, Homo sapiens
ggatattgtactactacactgtcttgcagaatgttaaagccattcatcagaagagggaaatggtgtagtgcaaacttgggttgatgggaggaggaagaagagcctggaaagccgcgcctctggggcgtgcttcctatgggtttcagctggcccaagccc

SEQ ID NO: 524718 - DNA, 131 bp, Homo sapiens
  misc_feature (60)..(60): n is a, c, g, or t
  misc_feature (79)..(79): n is a, c, g, or t
ggggtattctcctcctcctcctcagccagctagctgtcttctgattcacatcttcctganctgcagaaaggaggttggngaaagaggaaggagaaagaggaatttgctgagacaggggacacggggttgct

SEQ ID NO: 524719 - DNA, 419 bp, Homo sapiens
  misc_feature (13)..(13): n is a, c, g, or t
acctagaaaatcntcctgttgtgtattctaggtgcttgagtcactgtcttggagattttttaatcctccagagatttgagttatttaggccacttcatatatgcgtgggattgagataaccttctaaatgcgaatttcctaagcatctaacctcagaaatgttaaggaaagagtactatatgagaatataactaagagtccagctgttagccagaagtgtcccttctgggacagttgtcctctggggtcattctcaaagcagaggcctctcaccacctctcggaggtgacagcaccagccaacctgctcttacaactcacatgtctgctttgttccccttggaaaatgtcctctggagtatcccttacagtcttaagtcatcaggagaggcttggggcccagatccagctgggtcctca

SEQ ID NO: 524720 - DNA, 394 bp, Homo sapiens
ggtttagccatgtttccctccccaaccatgacatcaggtttacgtgataaacgatctatttatctcatgtttctgccatgttttccccagacatgcgcaaggagtaggagcgcctggtccagctggagcgggcggagcatgagaggaaggagcgtgagcgccaggagcaatagcgcaacattacaactggaagctggagaagccactggaatagcagtgtgtgatgtctacaacggtcgacagaggaggagaggaggaaacgtacccttgagaggcgacaggctgttctacgggaaccttgtaaatggcacgaccacttgagtgggaccggaatccaaggttagaactatgtatatcaaagatccaaataacgagaggacctagttgtcctgac

SEQ ID NO: 524721 - DNA, 1577 bp, Homo sapiens
  misc_feature (694)..(694): n is a, c, g, or t
tgggtggtgtgggattcctcctatttgctgtggtgaacctctgtgtggggctgggacacatagaagggcgtgtggtgtgcttgttgtttggggtgctctttttgggtgcggtcctacgcgagctctggtggggggagtgtgttttttgcgtcgttctgatgcctcctgtggttattgcatggggccgccagggtggctgttctaccgactggggttggtcttgatctgcggtatgtcgcctggcttcgagtgtgggattgcggcgggttgtgtattctctgtcggcgctgtggtgttgtgcgcccgccttgttttagaaaccgcgcggttttatgtgtatttgttgtcctccgcctggtgtgttaatgtctcctctgctagatgatatcatatctgcgtgggggggggcgttactgattttattcctctgacgctccgtcagtactcgtcttggtggggcgacactccacttctggtgggcggcgggtggttgctatctcaggtggagcgttttgttgtgtccgctccctctcgcgggttgccacgtcttgggctggcagcacgcgtcgtctctcgtgctgtccgcccccctactgtgtagagccggttttatgttgtgatcgcgccccaaagtaggtgcgcaactctgtcgggggggcctggtgtcctgatttgtggtgccccagtagagggncgcgcgctctcttcaatgtctttctgctggttgtgtcccctagtgctcatcttacagcctcgcaccgaagttggggtgggcttcgtttgcttctttgttctgtatttcctgtcggggtggagatagtatagtaggggcggcccccccatcttgtgtggtgtgtgtacttccccgtagctgctcctcttctcctcatggagggcgcccctcacgtgtctctgcgttgcgtcgaggtgtgatctgctctccacatcttggtgcggcgctgtgattttgtagctcgcgtcactatcgctcctcgccttgttcgtctccgtgatggccctcactccgccgtgtgtagaggaccctcccctctccccggggataaacactggcccacataggggacacgagacatctctttaagacatctggagtagaggcgcgccccacaatgagacactctctcagagaagatgcgcccattgagagacaccacatgcgctctctttgcacagagtgcccaacgtgcgcaccacacgacgcgcgcgccctctcttgggcgctcgcctcttaggcgtctctcttgtggcgcctctcctctctctctgtggccgcgcacaggagcctctttgtgtggggcgtttctttgcgcctctgctgttttggggcgccacaccccggggcttgggccaccacgttccccaggcgccccacccccctgtccaaagatcgggtaaacggaggcttgccctcccctgggccccccccctcttggttaactccgcccccccacccccccagcccttttccctcgccaccccctctctcttttggggactttctggtatgaccttgtacccgtgacccccatccccattaatgtgatccccccccccca

SEQ ID NO: 524722 - DNA, 305 bp, Homo sapiens
ctatatttaccattccttaccttcctatctattctttctttcttttactttctttctttctctttctttacttttcttttctttactttctctttctttcttttctttctttttttttctttctttctttctcccttcccttcccctccttctttctgtctctctcttctttctttctcttctctctttcaattccttaaagatgttgcccttatgttctggcctccatagtatctgctgagagatcatcatcattgattcttattgttgcttccctgtagtgatgtacacttttcgtttggtgc

SEQ ID NO: 524723 - DNA, 251 bp, Homo sapiens
gggcctcttttagatcgccaagaaatagacaggtctttgccagacacagtggctcacgcctgtaatcccagcactttgggaggccgaggtgggctgatcacctgaggttgggagtttgagaccagcctgaccaacatggagaaaccctgtctctactaaaaatgcaaaattagccggttgtggtggtgcatgcctgtaaccccagctacttgggaggctgaggcaggagaattgcttgaacctgggagacg

SEQ ID NO: 524724 - DNA, 887 bp, Homo sapiens
ggactctcttttcggactcagcccgctgcacccaggtgaaataaacagccttgttgtcacacaaagcctgtttggtggtctcttcacacaaacgcgcatgaaatttggtgccatgactcggatcggggtacctcccttgggagatcaatccccagtcctcctgctctttgctccgtgagaaagatctactaggaccctcaggtcctcagactggaccagcccaaggaacatctcaccaatttcaaatctggaccccatgaaaatcggactgttcaactcatctggcagccatcccagagcccctggaactctggcccaagcctcctctgactgatccttcccagatcttctcggcttagcagctgaacgactgacactgcccaatcgccttggaagccccctagaccatcacggatgccgaagtttcgagtacactctcacagtggagggaccgcgcatgaaaaaaccaaacaaaccaaaacaatttctttgctagcagactaaaaaaccacaaacaaaaggcctttcttctggactggacctatatataaatctcaaaaggatggcatcttcacaaaccttcctaccagcaagttctgtgagaagctgatcttgtcccctggagtggtcttcgagacacctattcctcatggggcctgcattctcctatgataacatgcattcttctgatcctctgacgactgctgggctcttaccactgagcgttgaacacgaccacggtaccccacgtatacaggtgttacgaatgttaaccgacaaagggataatcatccagtacatagcgcgttgtgccattttgcggacagggtgctccgctcaagtattacactttgcacacaccgatgacacccgggtgttcgaaagtg

SEQ ID NO: 524725 - DNA, 509 bp, Homo sapiens
tccataatgggtgcccacgactggttagagtcaggactttagagtcgtggatataggttggggtgtgtccccacccaagatctcatctggaagtgtaagtcccacaattctcacatgtggtgggtggatccaggtgggaggtgattgaattatggggtgagtctatactgtgctgttcttggtgatagtgaatgagtctcaggagatcagatggtagaaaaatgggagttaccagaccaagagtactctctcttcgcctactgccatccatgtaagagagtgacgtagctcctcatagttttctgccatgatggtgaggcctccccagacaagtggagcggtaagtcaagtaaacctcttattatacccagtcgtggagtgcgtctttatcaggagcgtgaatacggactagtacagagtcagatggtcattgctcgatagcctgggtctgccattacgggccgtggaaccaaaaacttgtacttaagtcctccaggcctgtaagatga

SEQ ID NO: 524726 - DNA, 777 bp, Homo sapiens
agcgagtgggaaggggacgcagcgccctgtggcccggtctctagtcatcgccctcgcagcggcggccaacatcaccgacactgcatccctcccagactgtggacgggacggatggagctcgaatggccgtcgctaccgacggcggggagaggccgggggatcccagcgggcattcaggtcatgtcggagtatcccagacgatcaggcggcagcatgcgtcggaagaaagctgctcatgaacatcggaacaagcgcatcaaccggatcatgggcttatcacagagcccgggaatcggcgcggacagcaagacacagtcacaccaaagatcagaagcaggcaggacaggtgatagactgaactccctcagcgttccttccgattcaaagcgagtagtagcagggtgatacagtcaggaccacgggaacaactgaccagcagtggtggtgatggccgagggtaaaggggacccaacagggagaccaatggcactcgatcattaaaccacgctgagtgcagaagtgatgtacaacctagaagctccggcaagcggacacagaggggacctgacagcaggaccgtcgggacccaagaaggggggtaccccaggaccacatgggggcctacgaaagccagataaccatttcccagaaattccgaaagacaggcaggtggacagacgttaagggaacaccagctgaataacgtgaaaccaaacccaggtcaaagaaggaatggaacagacacacagaacgaaatctgaacccgtagcgaaataa

SEQ ID NO: 524727 - DNA, 469 bp, Homo sapiens
cgactacctacccagctgcgcagtttagggtcgcaatcggatctctgctgagaatgccaggaaacatccattctttctcagcttgggggagcggatccacaaacttcctgacactacttccatatttgcactaaagggggtacagctacaaaaggaggccaacattcggtccacttctatgcctgactcaggcaggccagctttccgtgtggtggataccgagttctaagccaagttttaagccacagacagaccaaggccccagcaggcagcggctggagggatgccacaacccttacagggcagcccccatctgcaatcctccctgcttgttgcctgcttacctgcctgagccacactcccctgccaacttgtcccctgccacctgcccaaacaccaaaccactggcctggcctgtcaacccaaccattggcctgtctgctgggtgctaacaaagctctcaccacta

SEQ ID NO: 524728 - DNA, 221 bp, Homo sapiens
  misc_feature (72)..(72): n is a, c, g, or t
  misc_feature (204)..(204): n is a, c, g, or t
gtacccggcagcccccgcaagacgggcagcccccgcaagacgggcagcccccgcaagacgggcacccccaanaagacgcagcaattcacgtaaaactggaaagggacgaactggcgtcttgcgggggctgccggcagcccccgcaagacggaggtgtctgctgctttttgcctgtgcctgctgggaagttgcagtgctctgtgnggctgcgtcttgcgggg

SEQ ID NO: 524729 - DNA, 113 bp, Homo sapiens
aatcgctaaacaattaaacaaagcatcgcgtcaacacccgccgcgtgcttcgcgatgctttgttttaattgtgtagaattgaccagtcggatcccctggtccgcaccagttct

SEQ ID NO: 524730 - DNA, 278 bp, Homo sapiens
agtcggttggagcgagcatcccccaaagttcccaatgtggccgaggactttgattgcccattgttgtttttttaatagtcattccaaatatgagatgggttgttacaggaagtcccttgccatcctaaaagcccccccccttctttttaaggagaatggcccagtcctttcccaagtccccccagggggggtgaaagcattgctttcgggtaaattatgtaacgcaaaatttttttaatcttcgcccaaaaacttttttattttgttttattttgaat

SEQ ID NO: 524731 - DNA, 130 bp, Homo sapiens
gtacccggcagcccccgcaagacgggcagcccccgcaagacgggcagcccccgcaagacgccagttcgtccctttccagttttacagtgaattgctgcgtcttggggggctgcccgtcttgcgggggctg

SEQ ID NO: 524732 - DNA, 345 bp, Homo sapiens
  misc_feature (119)..(119): n is a, c, g, or t
  misc_feature (186)..(186): n is a, c, g, or t
  misc_feature (238)..(238): n is a, c, g, or t
  misc_feature (243)..(243): n is a, c, g, or t
  misc_feature (246)..(247): n is a, c, g, or t
  misc_feature (250)..(250): n is a, c, g, or t
  misc_feature (255)..(255): n is a, c, g, or t
  misc_feature (276)..(277): n is a, c, g, or t
  misc_feature (303)..(303): n is a, c, g, or t
  misc_feature (320)..(320): n is a, c, g, or t
ggttatgtaaacactacatacaaaagtaaaagtatctgaatgtcatgactatttctataacctatggtggagaaacccccttttttttttttggagatatagtctcactctatcacccnggcgggagtacaggggcaagatctcggctcacggcaagctcggcctccggggttcaggccattctcnggcctcagcctcccgagtagccggggttagggctcatgtgctaccacaccgngctanttnngtnttttnagtagagatagggttcctacnntgtgggccaggcgggtctcaaactcngtgacctcaggtgatcngccggcctcagcctcccaagggtgc

SEQ ID NO: 524733 - DNA, 580 bp, Homo sapiens
gggtaaaggtgggggtgtcttttttcactttaagcatcttgttttctaatcatgtgtgataattgggctgaaaaattcttagctcaaagtgttttacaaaacaggtaaagcaaagaaactagcaggaccactctcagttcaagattaaaactaaagtccagtgttaagctaaacggacgacatagcaaattaactggcttctacattctgtttgcggctgctaaggaacaaccagaacattctttcatcggtttctagaaggctgcgaaagtcctgggtcacggccccagcagatcctgttagcgtgagagcccgcttcctggctcatagcatggtgccttctcactgtgtgcgtgcgaagggcgccaagtgagccctctgaggtatatcgtctatcgacactggagtctcgctcttgttgcccaggctgcagtacagcagccacgatcctcggctcactgcaatctctgcacccctgggttcaagtgattctcctgcctcagctcccaagtagctgggacctataggcatgtgccatcacacctagctaattagtcagtcctgtagaaacagggttcac

SEQ ID NO: 524734 - DNA, 103 bp, Homo sapiens
aaccttcctaggcacaggaggctttcccccgggccaaggctcttcttttaggattttgtttgctcagatcagtccttggaaggggcagcgtttgctcttcgtg

SEQ ID NO: 524735 - DNA, 166 bp, Homo sapiens
ctttgaaaggaggtgatgatgctgaaaaggtagagaacgacaagctggaaggtgccagtaagcaacgtgagaagaagatcaaggtccagtgcatatcaagtaccaggctgaggaccagaagtgtcagcacatgtgaccactttatgggtgtgggggcgcagccgaa

SEQ ID NO: 524736 - DNA, 183 bp, Homo sapiens
gtcgacacaaataacttgttgtgcagtgcatactgtaggaacatgctggaggctgaagatggcccagagatgaacttcctggttgggatccacagtgggtgctcagtggtgtcagtgtgtcaaactgctcccgggatgatcactattgagctctattgaagttctcgcactttcttgcattga

SEQ ID NO: 524737 - DNA, 395 bp, Homo sapiens
acgctctctctgtggggtagccatttcttttattcctttactttctctcttttttttgagatggagtctccctctgtcacccaggctggagtgcagtggcgcgatctcggctcactgcaatgcttcgccacccgggttcaggcaattctcttgcatcagcctcgcgagtagttcgaattataggcatgtgccaccacacccagctgatttttgcatttttagtatagacaggttttcaccatgttggcgaggctggtatcccactcttgacctctggtgatccactcgccccttggctcccaaagtgctggaattacaggctctgtttattttccttctttctttctttcttttttttgtgagatgaagtctcactccccccacagagagagcgt

SEQ ID NO: 524738 - DNA, 408 bp, Homo sapiens
tgggtggatcacttaaggtcaggagttcgagaacagcctggccaacatggccaaagtctgtctctactaataatacaaaatacaaaataatacaaaaaaattagccgggcatggtggcgcatgcctgtaatcccagctatttgggaggctgaggcaggagaattgcttgaacctgggaggtggaggttgcagtgagccaagatcctgccagtgcactccagcctaggccacagattgaaactgttctcaataagcataataataataataggcctggtgcggtgtggtggctcatgcctgtaatcgtgccactgcattccagcctgggcaacagagggagacttagtctcaaaacaagaattccaagttgtgttaacaataccttaatagtgggcaggccaggcctta

SEQ ID NO: 524739 - DNA, 231 bp, Homo sapiens
gctacgaccaacaacttagccttgcaacaaagcaagatcccgtccttacaaaacaaacaaacaaacaaacaaaaaaactaattggccaggtgtgttggtgcatgcctacagtcccagctacttgggaggctgaggcaagaggatcacttgaacctagggagttcgaggctacagtgccctatgatggcaccactgcattgaagtatgggtgacaagagcaagaccctgtcc

SEQ ID NO: 524740 - DNA, 154 bp, Homo sapiens
ctattgtgccaggctgctgaactcctggcttcagtgatctctcacctggctcccaagtgctgattacaggtgtacacgtgcccgtagaaaactcttacatttatataaatgtaagtgatgattgacatttaggaattctgtgttaaatagtttt

SEQ ID NO: 524741 - DNA, 210 bp, Homo sapiens
aggatccccgaaagccgagtttcatacagaaagtagaaagaattagccaggcatggtggcacacacctgtagtcccagctactcgggaggctgaggtgggaggatggctggagcctagggtggtcaaggctgcagcgaatcaagaatcgtgtcactggtacttcaacctgggctgacagaatgcagaccctgatctcaaacaaaaacaaa

SEQ ID NO: 524742 - DNA, 237 bp, Homo sapiens
agtaagtcaagtgcactttccagtacacttaccatgttacgacttgtttcctctatataaatgcgtaggggtttagttaaatgtcctttgaagtatacttgaggagggtgacggggctggtgtggtacgccgcttcagtggcccttgtttcaactaatgcactactactcttcagttatacttgcttaaatccacccttcggaaccctataagttttcataaaggggctaattcgta

SEQ ID NO: 524743 - DNA, 942 bp, Homo sapiens
taattcagtgcacgggcggggttttaattccatacattacatggtccctcggtcgtacaatttcacaccgtcgcgccgccgcccgctcagcgtccgcgccgacatgggagtgcaggtggaaacatctccccaggagacgggcgcaccttaccccaagcgcggacagacctgcgtggtgcactacaccgagatgctagaagatagtgaaagaaatttagatatgccatcccagagacagaaacaagccctatttaagttatatagctagagcaagcaggaaggtgataccagaggctagagaacgaaggggttagcccagatagagatagtgggtcaagagagccaaactagactatatctccagattatagccttatggtgaccacatggagacacccaggcatcatcaccacacacatagaccacatctacgtactatacggataagtagggagcttactaaaaaataggaaatgacagagaatgagactccataccctataagactaccctgtatctatggatactgccatggaagaggatctgagtgcactaccagacatgattgcaaccaataaaataccaaaatagggaggactataaaccttggaatgatatcccacaacacaacattatgataataagaacaatcttgccccatggatcttgagatttgtagtttcatagatacaccttcaagcgtatataggttatcccgaagacagccatctggtataaccattcatatacccggcaatatacatacccattcgataattggtggtagttagtaacctatacagctaattaatggcccattaaaacccatccaagtaattcactattactataagataccactacagagaggatgacagaaatccaggttatcaaggcctagtggggcatataagggtatccacaataacgtaacaatgggta

SEQ ID NO: 524744 - DNA, 1132 bp, Homo sapiens
gctggacgagtgcactggggggaaggtacccaggccctcccccgccccccgccagcacctagtgcaatagtgaggagcgctggcttgtcctggtggacttgggtggcgagggagctttggtttggtgcgctgcatgtgacttctgacttacatggtcctaagacatctacgatggccttctcctttattaggcactgaggtgcaaagagtgtgcagctttcagtctgagaaatattccgactggaggacgggtccaacggtgaacaaggccctggtggctggtatcacccacagtagaccacgtgcgctccttgcaagtttagggagaccccacattacaattgggcgccacaaacgtatgggaggacatcagaagcccgcaagatgcgtactccgacgaactcccatggaacccaacctaaacaagattcacagcaaggtacagtccagttgattccgtcccttccagttcaagtccgttgcacttcaacttaacccatgggacgtttaaagtatacagttttatagcattagtcccttacctttggcattacgcggagcgccagtaatattcagccctatactgtcggtacccccttccaagttagccaaaggtgtggggttatgggggatccgggagaacgacgtaagggccacgggcgcacagaaccgagagattttaccagagggttatacgcccagaggtaaaaggcttttccaaagatttggcccttacttatgcataggacaaaaagcaaaacaagggtagaaagctaacatagagggtttggaagcctattatcaccgatttgtttagaacccaacaagttcccatatgagaggtaaggggaacacccccagtggggaatgtactgtgggcacaacaatttggtttaaaagacggttggcgttcagaagaaacaacactagtaacggaaaggccaagggcagttgagcagaacattgcgaactcgatatagatcccactgcaggcaccattcggactcaattgcctttttctacggcccaaaggccagtcccgaccacttatggagtagtaaggcatccccaatcggtaggcaaccaatacatcgttcgaacggcccccaattggttgcccattaaccacaag

SEQ ID NO: 524745 - DNA, 179 bp, Homo sapiens
acatagccacagcgagttgcggttgaatcagtcatggccattctccacgcccagggcaatcagtgctgcagcgagcggtacctgttcggcaatacgacggctcacaccctgacctcggcttttttcattcagtaaggtgatttcgcattccgacgaagaaaactcggcagtgcggggta

SEQ ID NO: 524746 - DNA, 267 bp, Homo sapiens
gcggcttcgtccatcagcaggagatcaagacatcctggttcacgcggtgaaaccatgtctctactaaaaatacaaaaaattagccaggcagtggtggcaggtgcctgtggtcccagctactcgggaggctgaggcaggagaatagtgtgaaccctggaggcagagctttcagtgagctgagattgcgccactgcactccagcctgggtgacagagcaagactctgtgtcaaaaaaaaaaaaggattaatatgaaagggcaggtcaac

SEQ ID NO: 524747 - DNA, 257 bp, Homo sapiens
attttcctcttaaaaattaaatcctaactaatctaaagctgtctagttaacaaatgcccaaacaaaatttaaaaattagatgggcatgatggtccgtcctgtgatcccagctatttgggaggtctaaggcaggaaagattgctcgacgcccagcgcaggtcaaggctgcggtgtgagccaatattatatgccccatacactcgcacgcctggggcacacagaagagacccctcatttcttaaaaattaatataaata

SEQ ID NO: 524748 - DNA, 196 bp, Homo sapiens
gtgatcctcccacctcagcctcctgagtagttggtggcgtgcgcaatggccccaactgatagtttgtattatttgtaaagatgaggtttcaatgtgttgctcaggctggtcttgaactcctgggcccacttaaggcatccacccaccttgggctttgaaagttctggattacggggtttagcccctgtcccagcct

SEQ ID NO: 524749 - DNA, 269 bp, Homo sapiens
cccggcttcgggttcatcgattctccttgcttcagctcccgaaaagcttaacaggtgcccgccaccatgccgagctaagttttgtaattttagtagagacggggtttcacaatgttggccaggctggtctcgaactcctgacctcatgatctgcccacctcggccttccaaagtgctaggattataggggtgagccactgtgcccagtgctgctccttttttcttgcaacatgcggattaccatacctttcctctctcacgttccctat

SEQ ID NO: 524750 - DNA, 506 bp, Homo sapiens
ggctggttattgaaaaaagtcataaagttcgaataaaattatggttttaaaggtcaaaaggttagagtaagttaggattaattactgaagaaaaatgttttgaataaatgtagtgtaatgtagcctaagtgtgcagtgtttataagagggtacagtagtgtacagtaatgttgaaggcctccacagtcactcgccactgactcgctcagtgcaacttcctggaagtcctgcaagctccattcatgttaagggccctaaacagtactttttctatgtttagatatgttgatacacaaatacttaccatcgtgttacaactgcctacagtattcagtacaatcacatgctgtactgatttgtaacctaggaggaataggcgccaccatatcgcctaggttttaggtataggcctaataggctataacatctaggtttgtgtaagtacactctatgacagcagtatccaatcttttggtttccctgggccacactgggttaagtaagca

SEQ ID NO: 524751 - DNA, 819 bp, Homo sapiens
cgcgtgtgccgtgctgagagcgcctgcctgtgcgccccgagcggtgtgcatgggactcttccaagatgcccacgttcgcacagagaccccggatcgcggaagctcgtgtctcgatagtgcctgtgggtcacggggggccatctcggtgggatcgtggggcgggatgacctccacgtgtgaaccttgtgctgctgggtgcttggatcaggaggctccgctcggctccccctggatgagacggcgcgatgccctggtgtcccccgtggctgcgtcgcggtcagtgtcattcagtccttatcggactccagacttgggggatgcgtattaaacgcacagactccttgcaaaggtctgtgcctatacaagcactcagcccctggggagagaacgggttggccgcggatgactggaacggtggcctcgaggtccctacaagagcccctaccagcgtggggaggcctaagtacctcagggttcagggcccacggagggagatcggggggagcgaggccggtgatctacgtgtgaagggagctggagcaggacctcaaaaaagggccaaggagacggcgagggggttccgcgcgtctgtaccgttcttgacatcggctgagtcctccccgcagggcgggtctccacggccctgcccgtcccgtgggttcaccgggttttcatcacccgtgcgggtagttcctggggattccgacccacagtatgtgtggcgatgggccaggagcggttggacgacaaggggtgtctcggcctgggagagttccaggtgaccgctctccacgggagagaaaggcggttcacctccgt

SEQ ID NO: 524752 - DNA, 148 bp, Homo sapiens
  misc_feature (14)..(14): n is a, c, g, or t
ttgattatatgcancgcacctacgaaggcattctggagaccgccgaggccgaggcctgcgagctgatcgtcatgggctcgcacggccgcaagggcgtgcaggcgctcatcctgggcagcgtcgcgcagaaggtgctcacccacgccaa

SEQ ID NO: 524753 - DNA, 879 bp, Homo sapiens
tgcccctcatttacataaatattatactagcagtttgccatctcacttcttaggaatactagtatatcgctcacaccgtcatatcctccctactagtgcctagaaggaataatgactatcgctgttcattatagcgtactctcataaccctcgaacgacccactccctctgagccaaatattgtgcctattgccatgactagtctttgccgcctgcgaaggcaggcggtgggcctagccctactagtctcaaatctccaggcacatatggcctagactacgtacataagcctaaacctactccaatgctagagactaatcgtcccaacaattcctacttactaccactgacagtgacttgtccaagaaaacacagtaactttgaatcaacacaaccagccacaggcctaatgagtagccatcatccctctactatcgtgacaagcgcagaagtcaatcaagcaagcctagtttaggctggttaccccaagccttagaacatccgaggcccctaacaagcgccccctcgctaatactagcatacctggactcctaggcgctgccgaatcagggcaaagacgaaacagcccactctatcccaagtggaaccacctatccagggaacagacaactcgtacccgtctcctcatacctagatctcccttcgcgacactctcctgcaactcattacctgccacaggcccaccaggcacctaacatgccatcacctccacaactcctcgctgccggagaaccacacacctcaattccccaccccttgcgcctaatcagcgccgaccccgaataaaagcgccaggccaagcccaaagagaccggcaggcaccccgcacggcgcacagttacctcccgaagtgcgaaa

SEQ ID NO: 524754 - DNA, 611 bp, Homo sapiens
gcatttttggctgggagcccccccccccaaatgcacgaatttttccgctgaaaaaccccctaacggggggagagaccctcaccccctccgaaggtttgtaaaccctccggatatcgagttgagaaaatgttaaaggccccagatccccggataaggaaagggattcctccctcgagttccgcccgaggagtgagttctttgctggccagcacacctggaaagatggagacgtaactcttgttctgaggctacccaaaatgtccacaaaggagagtttactcttcatcttgtgttgggaactttcgctggtggtgctaagaaaaagggagaagaaagttttacccccctccccaggaaggaattaagccccaggaggaaagaaaggtttaaactggctgtcctgaaatattataaggtggatgagaatggccaaatttagtcgcctttcgttcgcagagtgccctcttctgatgaatagtggtgctggggtgttttatggccagtcactttgacagacattattgtggccaatgttgtttgacttactgtttctcaccaacccgaagaccagttactgtatgaggttatatataaagaccatggacttacca

SEQ ID NO: 524755 - DNA, 236 bp, Homo sapiens
  misc_feature (5)..(6): n is a, c, g, or t
  misc_feature (16)..(16): n is a, c, g, or t
  misc_feature (27)..(27): n is a, c, g, or t
  misc_feature (37)..(37): n is a, c, g, or t
  misc_feature (48)..(48): n is a, c, g, or t
  misc_feature (60)..(60): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (92)..(92): n is a, c, g, or t
  misc_feature (103)..(103): n is a, c, g, or t
  misc_feature (110)..(111): n is a, c, g, or t
  misc_feature (115)..(115): n is a, c, g, or t
  misc_feature (159)..(159): n is a, c, g, or t
  misc_feature (183)..(183): n is a, c, g, or t
  misc_feature (189)..(189): n is a, c, g, or t
  misc_feature (203)..(203): n is a, c, g, or t
  misc_feature (213)..(213): n is a, c, g, or t
ccatnngcgctgtccnggctgcagcgngtcgagcttncgctctttgcngccgcctttccngtgcntngncgtggcggccccggcgatgactnggacccagggnctccttnnagtngtagatgtcccctgtatgggtgtggccaccctgaatggctcctncctggccttatcccgtccctcagnaccatncctgtgctactttntagctggggnctctggcttcttggcctctactg

SEQ ID NO: 524756 - DNA, 329 bp, Homo sapiens
aaaacccccaaattatagactgaatgtacgcttaatagtctggccagggatctgactcctgagtaaggtaagcctctcccctgccacgggcccaccgcagcccctgagggaacagtgccgtcttagagccagaccctgtgccgagatggtgggggccctgcaggagtctctgctgggctctcaggctggaggagcctctgccaggtcctccctgcacacaccagaacccacacgctggtcctgcctatgctagcgtctccccagccccacgtggcttcagataggtcccagcttctccctcagggacaggcccctgtccctcagttcca

SEQ ID NO: 524757 - DNA, 302 bp, Homo sapiens
gcaaagtagcctgtccatctgcagacattcacagagcactcagcgaggttcatggaccatgatgatcatggtctcacacatccccagcctccaaatagaccctcatgtccacagtgtggtgagtgcagtgggaggggggcacctgtgcctgagccaggcagaggagggagctggccaaggagggctgctcaggggaagtggcccttgagctagatctgcaaggatgagctagacaggaagaaggggtggaagaacatcttgggtcaggggaatagcagttgtgaaggcgcagaggcaaggag

SEQ ID NO: 524758 - DNA, 106 bp, Homo sapiens
ccattccggtgataattggtcgtacagtcattatccatccatccgcccaccgggaacctcccatcggatgcagaaacggtcatctggttaaactggtgggtccgta

SEQ ID NO: 524759 - DNA, 250 bp, Homo sapiens
cctgccagtgccacgagttagtaactgggccagcaaagttttgggtcaaagaccaacggggccaagtgcaggggctcgtgcctgtaatcccagagcttggggaggctgaggcaggtgtaccacttgaggccgggagtatgagaccagcctggccaacaaagcgaaattccatctctactaaaaatacaaaaatccgctgcgggtaggtggcgcatgcctagtaatcccagccacgggcgaggctaggatt

SEQ ID NO: 524760 - DNA, 305 bp, Homo sapiens
agaggccgcccttttttatactggctggcattttggctttaaggtcttctacagaactaggtcctttgggtgtttaggagttttttccggtttctggaaggattctggtcctttggatctgggtgtggatgatggtttggagtcttttccattctgattggactttggtgcattttgggctggagtatctcgtatagatttcttcacgggcgctttttcttcagcttcctcatcatcaaaatcatcatcatcatcatcttcatcatcatcctcttcatcatcatcgtcatcaggggtaccgagct

SEQ ID NO: 524761 - DNA, 752 bp, Homo sapiens
cacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaaggctgggggtactgtcttgatgacatacctaaaaagaaggttgaagtccaggtcattgccccggagtatctatggtgtcacaccggtgccgttaatttggccatgtactttgccggagtgaacgtgcaaccgggggcgcggaggggtgcgctaacgggtgttctgatgacccgggga

SEQ ID NO: 524762 - DNA, 1790 bp, Homo sapiens
agcgggttcgtaaggaagggggcctaggcccgggcctgcggctggtgggggcttgctgcgcgccgagcgggtcgctcctgcatgctgtcttccgactccagcattcgcccaacttccaccttgcccacgcggcggctggcgcagcaggcagcaagcaccatgcacaggcagcccactgcgcagcgaaccgacacgctgcgctccagcctctttgcacagacgaaacgaactgcgcaccacaagaactggaatgccacgcaacagcaaagcaaacccgctgcgccctgcgcacgccaactcagggcacctctctgccctacacaccgcgcaaggcctctacacggacacctactgtcgcataatgcaagccccccatggggcaaacttctaaccttggcaaccgcttcccagcaacacgcaacactccaggggacacctggattccacggctctaacacacttggccttaacttttcccggccaacagagccaaggcaacggccttaacccaaggcaaccttcgcaagggggacaaagcggtctgcaacccaatttacatatactcagtggagcccaaaaaacggcgtccaattcctctccaacttccgaaaccatggttcccctgtggggaaaacaagaaacacacctcataacttgcgaacgcgaacttgggaggagacccccaaagtgccgaacaacaccgtgggcaacgcaaaacaccacgggaaaccccagttattggcaaaccctacaaacaacgagcagagagcagagaagcgcgaaacacgcagcggaaaaaagacccccagttgggccccacgacagttgttgcaaccagaaggtttccgaggcgctaggcgcgaaagaacgccaaaagtagcccccagcgattggcacaacaggaggtgccgcacaacggcagaacggcacaaacacggtacacacagaacgcccttaaccccagtttgttcccccgaaaaggccccgggtgggacccacaagaaaggcttgggtcgataaaagacgggcccataagaagtcccacaagggcaaaacaacaccggtggcgaaactttggaaaaagagaaaacgcgaataacaaacgttgggcccattcccgggcaaagagacaaaagtttaaccgcctttcttaaaacttgaggacttttctcgtcccacaatatatcagcgcatatattgtaccagcacaaattccccggcaggtgtgccctaaaccgccaatagaaatgggaccagacaccgtttattcccattgggaaaattttacccactttgggaattggaccccggcagacagttctcggaacacaaaggaattgggagtaaacacgagggcgggaaacggcaaaacgttggagccaataatttggggcccatctgacgtcgataacagctccccatccccctatcacttccgcgagagaaaaaaacccaatagtatgggagcatcgcaaacattttggaaagccatcttaacgccgactactttctgggggacgcaaagaaacttttcgggagggagaaagggatgcgcagctgtgtgaatcattgttgcacaaagcagggtgaaaacaagagtgaaaaaacgattgttaaaagcaggggtgaaaagattttacgtttcgccagaaagagaaaacacgtctgtggtggacaacaacaggggtaaataagatggtgccgccgttgataagttttgagcgttatagcttttcacgaagacaatggggaagaaaaagagaaaggtttaaaaaagagtgagggtatac

SEQ ID NO: 524763 - DNA, 477 bp, Homo sapiens
  misc_feature (46)..(46): n is a, c, g, or t
  misc_feature (51)..(51): n is a, c, g, or t
  misc_feature (53)..(54): n is a, c, g, or t
  misc_feature (57)..(57): n is a, c, g, or t
  misc_feature (59)..(59): n is a, c, g, or t
  misc_feature (63)..(65): n is a, c, g, or t
  misc_feature (426)..(426): n is a, c, g, or t
  misc_feature (440)..(440): n is a, c, g, or t
cgtttgaagatctaatattccctcacctagctcccggcccaacatngtctnanngtnanttcnnngttcaaaggtgaatctggaagaggggtggaaaaggctctggaaagggggtggaaagcatcgcaggggggaaccaagattcctaaagcttcaaaagcccggagaaagcaaaataagatacctatagatttggtatgtggtggccatgggttaacaatatgccacgaggaaataactgttacgccaactgcaaatttctaaaaacctgcgagcatttctagttcccacgactgtaaccagcacccgaagcaatggggggttttgctattgtcctgaaatcacgaaagcttaacccgaaatttatccccctagggatatcggtacttttaaatccttctaactgttctataaattaatttaatnaatctaaatttctntctcgattttcgttaatgtgacttgcactgtctctga

SEQ ID NO: 524764 - DNA, 201 bp, Homo sapiens
tgaacattcgtgtcccattcgtgtccgtgtgtggtgcgtggatatggatgtgtgtggatatggatgtgtgtggatatggatgtgtgtgctgtgtggatatggatatgtgtggtgtgtggatatggatgtgtgtggtgtgtggatatggatgtgtgtggtgtgtggatatggatgtgtgtggtgcagtggacacgaatgtca

SEQ ID NO: 524765 - DNA, 440 bp, Homo sapiens
  misc_feature (300)..(300): n is a, c, g, or t
acacccacccacctcatgacaagcttttccccgtgtcagtcggcttccggatgtctgattatgtcctggaagagtcttggcttagtgctagcatatttttaccatctctgcaatgtttgctaatttccctttcaagagaaagaaggagtcagagctcagaatcagaatcaactacattgttgagtactttcgttactgttgtttctacagataccttctatttctagactccatttccactagtttttttttttgtaaattgaagtaaccaaagcaaagtatttaaaggctgggcacagntgctcatgcctgtaatcctggggctttgggaggccgaggcgggaggattgcttgaggccaagagttcaagatcagcttgggcaagaccctgtctctacaagcaaccaatcagtcaatcaataaaataaaataaaatgatt

SEQ ID NO: 524766 - DNA, 336 bp, Homo sapiens
  misc_feature (159)..(159): n is a, c, g, or t
  misc_feature (163)..(163): n is a, c, g, or t
  misc_feature (165)..(165): n is a, c, g, or t
  misc_feature (267)..(267): n is a, c, g, or t
  misc_feature (291)..(291): n is a, c, g, or t
ccaatccggttgttcagcaaaaaacgttgaccagcgacgttgccaggtgttgggctgtggagttgtggagagcgcgttatcgaaatcaaggccaaattgtggttggtcgctccattgatgtaaacgcgcaatttgctgaccaagaataaatgcgctatnatcncnagcggacggaggtggggagataatccattcaccaggaaaactgttagttcacggtcagcgccaacttgcccaaacctttagggcacggttgacggtttttanttacgcggacagttaacttcccantttgggttcggctttcggcggttaaaaaccgggggaagcatttcc

SEQ ID NO: 524767 - DNA, 985 bp, Homo sapiens
  misc_feature (351)..(351): n is a, c, g, or t
  misc_feature (487)..(487): n is a, c, g, or t
  misc_feature (961)..(961): n is a, c, g, or t
  misc_feature (985)..(985): n is a, c, g, or t
gaatttgggcgggaaccccccaaatcccaccattacggccccgggtagacgcccaacacgccatgagagaggcaagtaagaatatcatgtcacgcgtctgggagagaatggtacattctgttttaagcctgaaagtatcacccacaagaaccaaaaccccgcgcgatggagtgagttgtgtcaggggtgttgttttgtgtgaagtttggcggctggggcgatagcgctacgagggcacgatagggagagccgcatgcggggaggagagggcggaagtgagcgtcaagacgatcaaacattgcgatcgacaacacacgaatatcagccatagaatcttcctcctcgcaaagncaaccagtgctggcttgtgaggacgagatagagaggaggttcttgggtggtgtagccgaacgtgcgggccacggggcaggtaacaaacgagcaagaggacagcgacacacacgactgcctgaacatagcggaacgnggaaatgaaagacgacaacgaaacgtaacacacacactctccacaaacgtgcaacagaggacgacagagtgtgtgagcgccgtgtataggtagcccggcgcggttgaggggtccggtgggtgcgtatcgcctccgacactactcttccctgcctcgccggccgcgactccgctccagacctgcgactaccgacgcccctccacatttctgtgcaaactaattgaagcgacaagatggtcaacgcatcacccccacaaagcattagtcacgatcatgcacgtagctcgacgcgcggacgcaaataatgcccgagcacctctcctgcccaatcttggtcaacgtaacccattcatccaaatataaatcaacaataaaacagtggacgcatcgattgtaagaatcgctgaactagacgacatctatgtcgtgcgagacgctgcaatcttaactcctattgcagcgtaggcgaccctngtcgcggttcagtgaatgggcgcn

SEQ ID NO: 524768 - DNA, 1273 bp, Homo sapiens
  misc_feature (583)..(583): n is a, c, g, or t
  misc_feature (1273)..(1273): n is a, c, g, or t
gcgcaggcagacaactgtgctcccaatttgattcttgaagcggaccagaacttgcagtccagcaaatcacttgtcgaatgcaccccccttctggctgattgctactcatggttgtgctgtctgccttctgtcctcttctgcctgccggtgccggaggtcgcctttgctgtcggtggctgcatggcatgttgggccaaggaggtgtgcatggactcgagtttgatccttaagtcggactgactgtcggacgaagagagccatgggtgggttagctcatgctgtttgcttggtcttggtcatgaggggacctcgtctgtcaaggggcgagagtgagagtgtgcatgaccaatgcagagagtgtttttgcaactcctcgtatgtttgattccacacctatgaacatggatggctcgacccattctgagcgctaagaggactgactgatggtgggcctctatagctgagatggcctcgcatgcttcggtgcctcagtgccccgtggccttgtcctggttgtccgtgcgagcggctgctcctgttgtgtgcctggaaagtgacagtataaatccataaaagcgaaggnaagatagataccacacgcaataggtcacgtggcatcattgttcactgtcgcactacaacgggtactgttgtcagaccctgtcaaggtcaggaagcgcaattgcgagttaacgggaaagtcccttatgtggctggccccttcttatacccgagcgggccgcattctcccgcgttcccttagatttgcttgggcgcgtggatgttacgccgaccatgacccaccttgggacgcattccgtgggccacccatttggtctctgagtataaatacggcatacttggggagaacgtacatagttacgctaggttaagccaaacttaccggggggatcttgtatgcgtaccctacccttggtagaggagcgttctattacgttgtttcttacccgtttggctcgcagtggtatggttcgggaccccttggtaccggcacgtgtgcttttcccttatggccggagtatatagccggctgtcatgggctgcccccgtttgtgcgcgatttcggccattgagggcggagcatagggctggccctgggtgtcggtcgtcctgtggccatgtgggtcgttggttgcagtagttccgcggatttggtgggtccccaggctcctgcgttggtgcactccgcgtctttatgcaactttacactgggccctacttggcgttagtccatcgcgttactttgccacgn

SEQ ID NO: 524769 - DNA, 218 bp, Homo sapiens
cgtcgacctgagccggtgcacacctgagccagtgcacggtacacacctgagccagtgcacacctgagccagtacacacctgagccagtgaacacctgagccggtgaacatctgagccggtgcacacctgagccagtgaacatctgagccggtacacagtgcttacccagagtgcctgagcatttggcaaggccggcatggtgcccactgaccgtcgac

SEQ ID NO: 524770 - DNA, 484 bp, Homo sapiens
  misc_feature (232)..(232): n is a, c, g, or t
agtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatccctgcntgacactttaccaagggagatggtcccttttatcagttggaatgtagcaggcgttatttcagaagtgggggggccgggtaaaagaactccaggtccccacccacccccagttccaaccaaaatttttagggccaaaggccaccacccttttggtaggttaacccaccggcccgcttggaccattggtgataacgcctgtttaatatccaaatgaccaaataaaagctttttttttgggaagctcgaaaaaaa

SEQ ID NO: 524771 - DNA, 331 bp, Homo sapiens
aaccagacaaatataatatatatacagtagagatgaggtttacaccatgttggccaggatggactcgatctcctgacctcgtgatccgaccaccacggcctcccaaagtactgggcttacaagcgtgagccaccatgcccggacgtaatttcatgtatataaagcctcaattttcatcatctgtaaaatggggatcgtcataagatccaccccatgggattgacgagggactgtagttcaacaaggtgatctcatgtcaagagctcagcccactgcctgtcccaagtacggtgctccatggatgtactgtctggtgatgcggatgggaaaa

SEQ ID NO: 524772 - DNA, 706 bp, Homo sapiens
agcggggcttcctcttctcttgctgcacccttccgagctactgcgtgcaagtgcgcccacctatgacgtgctccccgaatatgcgcggctgctaatcgtgggtcgtcagatctgggtgtctggacccggacttagggcaggattagtgtagttccaagtgtgtaatcggggactctgcgtagcagatctcctcgctggcagtgcgcacccttgccctgtgtggcgtacacaaggacctggactcggcattggagcaggttggtgaagcccgactcatcgctgcgcggcgcaggacggatgcgtagccaatgtcctaatagttccatgagtaagataatttttgtacaacaagtataccgacagcgatactataagaacgtagtgtttgtcttgacataccatccaatgtagtgatgaacgcagattagctagaagagattagtagatcgagaaacgtttgctggctttgcaggtggtgggcctgtcctgggcatcggccgcgttggaggagacgccctgggtggccttagctgccctgaaccggtacacaggtggcaacgtgggggctcaggagttgacaaacacaaagaaagtagcgccgaattgccggtttatccgcagcttttatttggaagacagtgccacgaaagctgcaaatcctggtgtcccaaatagtcaataccaagttgaaaagcatctgggagag

SEQ ID NO: 524773 - DNA, 139 bp, Homo sapiens
tgctgggattacaggcatgagcattgcgcccagctgagagcctgtctcttaacacaaaagtatgcagtgtgccgaaaagggtgatggacttagcattcacagacgacaccatacaccactgtcacgagatcagggtttg

SEQ ID NO: 524774 - DNA, 653 bp, Homo sapiens
acggaaacggctgtattcactgctcgatattcatagaaccagacatgagttatcagaccgtgtaagcaaggcaccgaatggaactgaaaccccaaggagtcttcttatctttctgctttctagataccaggaaaaaaaaagaagcagttgagattattcactcttccagtaaacaggcctctagaaagtcagaggaatggctgggtgcagtggcttatgcctgtaatcccaacactttgggaggttgaggcaggcagatcacaaggtcaagagatcaagtccagcctgggcaacaagagtgaaaccccatctcagaaaaaaaaaagcataaaccaaaacttagtagtgtctgtggattcaggcaatccctaatggcaagaggttctctgaattgagtaatgccttaagtagtttggattttttaagtcataataggatctgcagatgtttggccagtaaccctatttgtatgcatgatacgttattcgtaccagaccaggggtcacaggctcaaatattctccaggtctcaggctgtgtcacagaaacaagggtgtcagaaaagcagtataaacccctctggtccagggctgctgactctgtttggcttctgagctttggagaaggggagcttgaaactaaatgcttcattgg

SEQ ID NO: 524775 - DNA, 311 bp, Homo sapiens
ccccccccccggggggcccccgttttttgggaaagtggggtttttttcccggggggggtttggggaaaaattttttcccccccccccggggttttttgggggcccttaaaacgggtttttggggggggggggttccccccccccccctttggccccttttttttttggacccccgggggggggggggggggggtgtttttttttggggggggggggggggcccccccccccccccaggtggttttttttttttgggggcccccccccttttttttttttttccaaaaaaccccttagagggggggggggca

SEQ ID NO: 524776 - DNA, 128 bp, Homo sapiens
actacttcctgtgtaaccttaagtttcttacaagtatcttttgttaactgttaaaaacgaaaggtatgttcatttcatgtccttggggcttttaaaaatgcgctgtgcattatccggaagtatgtagt

SEQ ID NO: 524777 - DNA, 142 bp, Homo sapiens
aaacggccagtaagccagcccctcaccctatgatagatattcctttaaggcaccagacttcatgtgtgataaatgattaatggttgaaattgtttctcttcttcggggttttcccagttaatacatggtccctgtttcccca

SEQ ID NO: 524778 - DNA, 164 bp, Homo sapiens
gatagattatcaagctacttattagagtagaatagtagaatttggatgatgtacttgataggaatttctgggcttcatcaacgggatagattccatttaacaaaatagggcgggcaggggggctcaggccggtaatcccagcacttggggaggctaagggggaa

SEQ ID NO: 524779 - DNA, 231 bp, Homo sapiens
gcagctggcgccgtcgtactacgcgacattgatgacggggctcgtgaagtactcgtcgtccatcgtcccagttacgacgacctttccctacctaagggaaaactcgaacctggcgaggatcttcccaccactgcagtgcgcgaagtggccgaggaaaccggcattaatatccggttgacgatgcctctgcaacccatcgtcgacgcggccgcgaatttagtagtagtaggc

SEQ ID NO: 524780 - DNA, 552 bp, Homo sapiens
tggtgttccagtgtgtgcaccaccctctcgctcgcgccccctcacgctcctcggtgggtgtccccgctcaccggtgtcgcgcgtgtcccacctgcgcgggcgctccccccgcgttctcgctcttggcgcgccccgctctctttctcgcactcgtctccccctcccgttttgcgcccccctccttgtccgtactagtggcacccccgtcgggggggtatgttgcggtctcctctcggatctcgtgggttcgctctcgtctccgggtctctgcattctcgcgctccgtgttgaggtccgcgcgcctctctctgtctctcaccgacagtggtgcgcgcgctcgctccacctcatgtcttttgtgaacacatctcagtgtaggtgtcgtggtcctcccctttatggtttctatcatttacacctgattctcttgctgtcgtgtacgtgtcttatgtcctccacgacattctttctaccccatataacacggaccgcggcgataaaatactactcgactcaccaaggtattccagacaatatatgtgtcgtgagcca

SEQ ID NO: 524781 - DNA, 425 bp, Homo sapiens
  misc_feature (397)..(397): n is a, c, g, or t
cctttgtctatatttataaatcaagagaccggctgcgtgtggtggctcacgcctgtaatcccagcactttgggaggccgaggtgggcagatcatgaggtcagaagatcgagaccatcctggctaacacggtgaaacccagcctctactaaaaatacaaaaaaaaaaaaaattagctaggcgtggttgcaggcacctgtagtcccagctatttgggagactgaggcaggagaatggtgtgaccccaggaggcagagcttgcagtgagccgagatcaagccactgtactccatcctgggtgacagagcaagactccatctcaaaaaattaaataattaaaaattaaaacaggagaccaaattttcatgtctgcaagggttaaattctaaccctaatatnagctgtaatactgagacaaagggaaaca

SEQ ID NO: 524782 - DNA, 291 bp, Homo sapiens
  misc_feature (62)..(62): n is a, c, g, or t
  misc_feature (109)..(109): n is a, c, g, or t
  misc_feature (117)..(117): n is a, c, g, or t
  misc_feature (132)..(132): n is a, c, g, or t
  misc_feature (223)..(223): n is a, c, g, or t
  misc_feature (239)..(239): n is a, c, g, or t
  misc_feature (269)..(269): n is a, c, g, or t
aacaacaatcagccacaatgtgcttttaaggatttaactgatagtaaagataaatgtgagtnttaagaatgggatttttagactaggctgacacaagggatcttctttnaataaggntcttgagcatttgtntttttggagctcatccttaagggctggacaggaagaatcctgtgttatgtgtgcatgttgagcaatgcaaaaaacactctgccaaatcctngataccacatggtctngagaaatgcatgagtgatttaacgcacggntgggtgtagtcattatgttcct

SEQ ID NO: 524783 - DNA, 117 bp, Homo sapiens
acagaggatcccgtgtcatcccccttcgtgataacagctttctcagaagcaaagacatgaagtgactgtctgccaatcatgtatcatacaacataaggagtcctctcttatcttagg

SEQ ID NO: 524784 - DNA, 174 bp, Homo sapiens
atcatctagccagatggggcccgcaaccccagccaaagcggacagcagcagggtctggctgctgaggtccaccacagaccagctcccggaagaccaaagattgaatcccgcattgtccagctatcgtaacacacggtcccccagcgctggtcatgcctcaaccaccagtcagga

SEQ ID NO: 524785 - DNA, 178 bp, Homo sapiens
acgacagttttcagcttctcccaacacagagctagattttggaggagctgctggatctgatgtagatcaagaggaaattgtggatgagagagcagtgcaggatgtggaatccactgtcacaatctgatccacggaaatcttggaactttgatccaaggctccagcacgatacaaatgc

SEQ ID NO: 524786 - DNA, 377 bp, Homo sapiens
tccacggtcgggcgtgtggtacgacccagaaacttctggggacgtcagtcatagttactacctatttggacggcacgtgggagactgctggccccacggttgacggtctcacgttacgacgcacgacccacattggacctacacgctggtttttcctttgggtttaggtgtaagtgaactattatcattggagtggagaactggagagaaagggttgtcactgtccagcactacacagctgccggcacccagatggtacacattcccagaaagacacataggtagacacgtgggtgtacacccatggcacacagacacaatcacgcatacctgtaagcatgtgtgtagacatctacttgcattcacacccagatgcc

SEQ ID NO: 524787 - DNA, 432 bp, Homo sapiens
tggaaacagagtctcgctcggtaacccaggaggggtgtgcaatgacaaaacctgggttcatggcaaaatctgcctccggggctcaagcgattctcccgcttcagcctcccaagtatagtgtgggactacaggttacccgccaccacaccaagctatttttggtatttttagtagagagggggtttggccagtgtgggccaggcgggtctcaaattcttgacctcaggcgatcggcccgcttgggccacccaatggtgcggggatcacaggcttgagccacaatgcccagttagggcataacctttggatggtcctcttggaccaaagtcctgaggggaagcacttccggggaggggggtatttaaagcaaagtgccagcgcttgggaaagggcagaccaggtctaacgaaatggggctaggggatagggtgt

SEQ ID NO: 524788 - DNA, 1056 bp, Homo sapiens
  misc_feature (739)..(739): n is a, c, g, or t
ccacgcgtcggggtgacaagaccaagcctctgcctcaaaaaaaaaaaaaaaaaaaaaaaaggaaaaaaaaaaaatttttttgggggaagggggtgagggaaattctcctttcgaccgaggtggagtggaagaagattttctctctcgtcgcagcctcttttttgctcccacaacagaagaagacacacactccacggcggggaaaagcagacactctctgtggatacgtgggtaagaaagtggaacctctctctttgaggttaaacttctgctgtgtaagtcggggcagagaaaaccaccgggagacgatgggaaatggcccaccccgagatattatactctccctctttctctatattggcccgacaacgagaatactcttataacttcttctctaaggcgctctgtgggggaaaaattgtgggggagtgtggcctatagagaacatctttatggggcgccctctcctctctcgccgggaggggtgggtgttcttttctaaaaacgggggcgcgcgagatgtaagagcggccccctgctggggagggagtgtgggttaacaacgttttctcacctctatagatttctcgccctcaagagggtctccccacaaaaacggggggggaaaatctctccgagagagcgaaacacaagagacgcaaaaatatgtggtggataaaccacagagggggggaatatctacacactcactcacaaatatatacaagtagagggacancctctctctgggggtgtgccccccctcatacacacacccaaaagaaagacgcccctgtgcagaacaccccccacacagtggggggctcacaatcgtgggggcaaacaaaggaccgcctgctcggagggccaccctcactctcaataaaagcgtgaaaaaccatcgaacgagtggtagtgaagggggacgcccccacacagcggggaaatgaagaacaataattgagagataactagttgtggaggcccataacaacaaacacatacaataccaacaacatataagggaacagaaatcaagaaaaaggacaacaaaaa

SEQ ID NO: 524789 - DNA, 230 bp, Homo sapiens
tactggcggaccggacaggtaagcgttactgaaggcactttctttataatatagcccgagtggaatgaggcgttcatccttgtccatattcttactctttacaggagttcaacatgcaaataagctccacctcccaggcacttgttagtctcaaaaagtcacaaaggggcgatccaggtcccatctctcaaaggtccacacgtcaatagccttcccgtgtggctagatcc

SEQ ID NO: 524790 - DNA, 408 bp, Homo sapiens
cgggaaaacacacacaggggcatctacttgctggaaacatgttccggagagagtgcacggagcaggcatgctttgttctcttcccaaacctgcctgatgtcaaagtacgtcaaaaggagcctcacagtcccaggagagcatcgtcccaggtattgctgtgacaggtggtgacccttgagccagatctggaacgccttcctgggggctgcccaggcaactcacccatgaatccagaagcacttttcactgctggtggtgatctgtcacatatggcagcaagcagccctccaggctgtacgacgagagatgtgaaaccgcagatgcgtttgctctgtggcatgtgggctcgctgactgttgctctgcaggctgcagcaggtccggccagtaacccaacagggcatccggc

SEQ ID NO: 524791 - DNA, 160 bp, Homo sapiens
tgcgtgatgatcagactctagagttcccccccaaatcaagtatgtacgggcagtcttattgatctctgggttccccactgcaccccatgcaggttagaagttgacccgatctattaagtgagtcgagggatccagtcttggctgggtgtgagggcttatg

SEQ ID NO: 524792 - DNA, 483 bp, Homo sapiens
aaataaagattgaggagatgtcaagctctccagagagaatcataagggtagggggtcgcgagtgtatagcttatatgcttagcacgtttctgaactgagaggtttatggcttagtagttttctaactaggtatatacctcttttaaaagcaggcggaaaagccagagaaagttgaatgcttttctaagttctaactaataacatagatgttctgaagagtggcagcgtctccatgtgatccctgagcattaccactctgtgattggtgttagggggcaaaagaacagaagactatttagtagatagatggaaagacaggacccagcttgcccaagtaagggctttggaagaaaaaggagagcagatgcattgacttctgtgagtagatgctagccatggtgccgaggcttcaggccactgattaagaaccatggcttctgccagtgagcagcatgtgtggcattccaggataaatgaggacaa

SEQ ID NO: 524793 - DNA, 110 bp, Homo sapiens
ggttcaaaatggcgacggcggcgcacgcgccgttaaattggctcctcccggcttgcccggtttccgttcccccaactttcggccgtaagttttgtctccttttttggggg

SEQ ID NO: 524794 - DNA, 102 bp, Homo sapiens
agacatgagaggtgtaggcagaagcaggaagcagcagaagcaggaagcggcagaaggcttcctgcttctgctgcttcctgcttctgcccataccaccctgaa

SEQ ID NO: 524795 - DNA, 555 bp, Homo sapiens
  misc_feature (511)..(511): n is a, c, g, or t
aagcagaagcgtcttagggtttttaggctcagtgaggatcttaggaggttctcccagtttggatacccatggctgcctgagaggccactgcagctccctgctcttagagtgaacacactggcaatatcctttctgcaatttcaacaggggcaccttgggtggcctgggactcatgggtccccaggaatggcccataacccttacaggaatccaagccagagcagaaagactttatagtttattgtctgggttaggcgcagaacaaagttgcactctagacaccccagaggcttgggtctggacgtggttgccatttgaagtttcctgctcctgtgacattcctgctctgtggccatccagtctctcctggtatgccaccatctaaaggaacctcagtctccatctccctccttcctgaagcaacagatagtagcatgtttctgacttcttgagaagtcttctttcctcttgtgcactggcgcctgcacctcagtcacttctgccaccccanccccatcctaactgagccccacattgaggaacctggccacccac

SEQ ID NO: 524796 - DNA, 104 bp, Homo sapiens
  misc_feature (63)..(63): n is a, c, g, or t
cgcgggtagtagggccttttcatgggtactgcatctacttcgaccgcaaaagagaagtgaccncaacttcaagaacaggcttcgagaacgaaccgctgtccctg

SEQ ID NO: 524797 - DNA, 334 bp, Homo sapiens
acctagctgtgctctgcacgtgcgatgggtcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcaa

SEQ ID NO: 524798 - DNA, 235 bp, Homo sapiens
aaccggtcgttaaccagactcacgatgaggctgaacgggataagtccaggctgagcattgtcagggaagctgctgagttattgaaccacttggtcacctttctctgtgagtcccaccaacttggcccccaggtagagctgaatggtggccccttgatggcaggatacagaaggtcaaattccagacggtcaatgctgagggaaatgggcactactcaaggacaagaaggaagttc

SEQ ID NO: 524799 - DNA, 567 bp, Homo sapiens
tctgtgcgtggagtccccaataaacctgtggtcctgcctggcaaaaaaaaaaaaaaaaaaaaaaaaaaaaaaaaaaaaaaaaaaaaaaacaggtgtgggcggccgccccgggcccccagaaaaagatttttcaaaccaccattctgggtgggggcggcgggggcccacaagagggagaaagaaagaaagcggggacaaaaggtgtgtttcccagaggaaaaaccgggggacaagaaacagaggaggggggagatttcccaccccaatataaaaaacgagccgcggggggcaaaaccgagagggtgtgttgggaaacaacaacacagagagagggaggattcagagaggggctaaaagggggggatcaccaaaagagaggggaccacaaaagggggaacgaggcgaaaaatacaaagattataacgcccccgggggggggggggctcaacagaaacaaaagaaaagagaggagagagacacaacaaaaaagcaggaacacgagaagagaaaaagaagaaaaacaatgacaacagagaaaaagacgacagaagagagagaggaggaaga

SEQ ID NO: 524800 - DNA, 577 bp, Homo sapiens
ggcacgatggcgcgtccatgtgaagagaccaccaaacaggctttgtgtgacacatggctgtttatttcacctgggtgcaggcgggctgagtccgaaaagagagtcagcgaaggggagataagggtggggccgttttattaggatttgggttaggtacaaggaaaattacagtcaagagggggtttgttctctgcgcgggcaggatgtgggggtcgcaaggtgctcagtagggggtgctttttgagccaggatgagccaggaaaaggactttcacaaggtaatgtcatcacttaaggcaaggaccttaagttagtcaaaacttaagacaaacttaagacaaaagaagtatctacacttcttttgtggtggaatgtcatcagttaaggtggggcagggcatattcacttctttggtgattcttcagttacttcaggccatctgggcgtatacgtgcaagtcacaggggatgcgatggcttggcttggactcagaggcccgacattcctgccttcttatattaataagaaaaattaaaccaaaatagtgttgaattgttgggacgcgccatcgtgcgctt

SEQ ID NO: 524801 - DNA, 141 bp, Homo sapiens
aatcgagctggtaccctgccgacgcgggtgtgcatgactcgccacccgggaggacactgcgccccgtgcgacggtcgggcgcgtctgttcgatcgcctgctgcgccgtttccgcttccaccacgcctcgccttgcacgtgg

SEQ ID NO: 524802 - DNA, 805 bp, Homo sapiens
acccttgtaataaattagggatcagccgccggtggcccaccggaccaccattggaccaggtggttgatactgaagtaaaatttgaaccaccgccaacatggtgaacccgtctcttctggaataccaattaccgggtgtgtggcgtgctcataatcccacctactcaggagctgtagcaggagaatcccttgaacccgccgaggtggaggttcactgaactgagattgggccactaccactcccgcctggatgacagacaggactccgtctccaaaaagaaaagaaatgtgaaggggtccaattttggggccaaaatatgtcattgcccgtgctccattttcccagccctctcttcctctgcccatgacccttggggaagtacatgttgagatggaggtgctaaatagttgagtcataatctcacctggatacgctgtaaccaatgcctggattatccaatcagttatgtaaactaaaatccttaacccccccgactgacagatgcccacctcgtggccgagggaatctcagaaaaaactttaaaccattcctggccctgatgggttgggaggtcagatgccacttgttataccccatccccttatggtttagacaccagctgccgagcctgaatggaccaaatagggatcatgagatggacagaacagacactgtggccataagatacccaattgtaaaccggacctaaggccatgcccagcacagggttaagtcatgtagagcccgccttcatgccccgcctcccctgccccccacttatgaataaactatgttctaactgcca

SEQ ID NO: 524803 - DNA, 242 bp, Homo sapiens
  misc_feature (99)..(99): n is a, c, g, or t
  misc_feature (158)..(158): n is a, c, g, or t
  misc_feature (172)..(173): n is a, c, g, or t
  misc_feature (199)..(200): n is a, c, g, or t
gaaagagaccagccttggtccctaagcctccaaaaaccgtcttctttaatccccaccttttctttactgcccaaaaaagaattgaacacccctgactcntggagtggtgtatactgccacaatcaagtgtttgagtcaagtccccagaggagaggggnaccctcctcccatnnttttttgcaacatctcatttcttccnnttgctgttgcttcccccctcacacaacttggttttgttctat

SEQ ID NO: 524804 - DNA, 374 bp, Homo sapiens
  misc_feature (8)..(8): n is a, c, g, or t
  misc_feature (13)..(13): n is a, c, g, or t
  misc_feature (115)..(115): n is a, c, g, or t
  misc_feature (118)..(118): n is a, c, g, or t
accaaccncggcncactgcaaccctctgcatccccaggttcaagcgattctccctgcctcagcttcccaagtggctggtattaccaggcatgtgccaccaagcccagctaatttncgncttgtttgttttggtagagacagtgtttcaccatattggctaggctggtctcgaactcctaacctcaggtgatccacttgcctaggcttcccaaagtgctggaagtacaaggtatgagccactatacctggcctgctttgtaatttgatcaataagaaatcttcatagagaactggcaagggcttctggaaaaatcattttgattaaagacatttaaaacaaaaaaggagtagaactatgtgtttaagtgtctaaa

SEQ ID NO: 524805 - DNA, 1557 bp, Homo sapiens
  misc_feature (1557)..(1557): n is a, c, g, or t
ttccggagagtggtggactgtatagatgaaggggtcaatattgtgcttacaggtgaaggagcgatgactgctcaaggcttccagggatttcgaaagtccttctctgctataaggactcagataagcaagttctagacgtactgggcaagctcaggtcaacgggatgtgagcagttagccaggttacttcctccatgccatgggtttgttgatgagtcattgaatggcaaccctgggtggaaaagtcgagagcctcacgaggactgctagaagatgtgactctcacttttctcccactgaaacttggtgccagtttgtaaaagtaggacatagcccttcttcgtattttttctctggatggcgtgcgtacgtgggcacagtaaccatactttcaacgtaaaggggacgataggacgtcgcaagggttattaggttctactctcgtcatcccgcgagacactgtatggtgagacttgaagggaaatggacttctatattttcctcctgttcttcgcatttttcttacacatgcggtaaaaacacacggacatttacgaaacgggtatggggccctccagggtccaatcttattacattgatttaagaaaccgccacgcttggtttccatgtaatccaacaatgtggttccaccgaagttagccgcctgtttcatacattttccttttgcggggcaccctgtttgacggcgaagtatggacctcgttgtgccaggtaggtcggctaaggttcagaccaggcggccatggagggggatgcgcgttgggtggcaagcccccattcgccattatcccatgaagttttattataagtcgttagattacgaagattgtcgtatatgcctgtggcccccatgaagggttgttcccatattaacattgttgcggtgttgtgggaggtgaccccccctgggggggtgacccaaaaaaccgaggtgggaattcttgattcgttccgccttcgaaattgtttggttagcaagccctgtgtttccagtagtatccaccaagcacaaggcggacgttactcagcgaaaggggtacacccccctgtgggtgcgcattgtacaagtccctatcctcatacttattacatggtgctgtcgtgtagttcaggaaggcgcgggacacgtccaggaccggtggactttacgcacgggcgcggcatcagcgcaactactgtgcacaagttgtgtgtttagagcgttgcaacacctgggctaagttgctggtggccccaagagggagagaaggacgcagcaggacaaacacagacaaacaaccgctggctagcttgtggcgctggcgtcacagtcggcacccgaggaagaacggagctacacaaccagcaaagtcgagtgtggagggcacggggggccacgcaggaggaacagcagagcagaaggtggacacacaggagacgtgacttactgcagggcagaactgctggagcaaggacccaggcagggagagagacagagcaccagacaagaaaacgacccggggcgggacaccagagacatgtcgtaacgacagacacn

SEQ ID NO: 524806 - DNA, 562 bp, Homo sapiens
gcggaggtgacggacttccttccccaggagccgactgagcaatcacaggcaggaagatgaaggttcgtgtgggctgcgctgcatggtcacattcctggaaggatgccaggccaatggctgagagcatggcggtggcagacagagccggagcccgagctgcgccaggagactcgagtggcagagtcggccgagcgctggcgaaacgtgtgcacatgggtcgtcttctgtggattacctgcgcggggtgcatgacactgtctgaccaggtgcaggaggatctgctcagctcccaggtcacccaggacactgagggcgctgactggacgaagaccatgaaagggacgtttgaccgggctctagcaatagtcgagagactggcaggaaccaacctgaacccacggctggcgggaggagactgtcggtggcaacgggtggtccaccgagtacgctgcacggcggaagacagggtccacgccattgcgtgcgacgtgcacaatggcaccgaccgttgtcgcgggccggcctggtggcagtagccgttgggcgtaccgttgcacggcca

SEQ ID NO: 524807 - DNA, 354 bp, Homo sapiens
tagttgttgattccattctaaagagtaattacagtcaggcatgactgctcatgcctgcaattccagcactttcagaggctgaggtgggaggattgcttgaggccaggaatttgagaccagcctgggcaacacagtgagatcccatctctacaaaaaatataaaaaaattagccaggcatggtggtatgtgcctgaagttccagctactcaggaggctgagaagggaggacagcttgagcccaggagttttagactgcagtgagctgtgatggtgccactgcactccagcctgggcaacacaccaagatgccatcccggtcctcaacagctgtagcaccaagcagagtaagatct

SEQ ID NO: 524808 - DNA, 146 bp, Homo sapiens
cacagatgtactcagatcgtatatcttcttcgtaagccacacttatccccaccttggctatcatcacccgatgaggcaaccagccagaacgcctgaacgcaggcacatacttcctattctacaccctccctgaagattgttggtgg

SEQ ID NO: 524809 - DNA, 118 bp, Homo sapiens
ctgacatggcgactcccggctctgtgattccggaggtcccctttgaaccttcgaagcctccagtcattgatggctgagccccactgtttacatgaatccagagagtttcatggataag

SEQ ID NO: 524810 - DNA, 306 bp, Homo sapiens
aggcaggacacgaacgcaagtcatggctcacatgtgtggcagcaggcaaagagagtgcttctgcagggaaactaccctttttaaaaccatcagatcttgcgagacttattcactatcatgagaacagcatgggaaagacatgcccccatgactcaattacttcccactaggtccctccaataacatgtgggaattcaagatgagatttgggtggggacacagccaaagcatatcattctgcccctggcccctcccaaatctcatgtcctcacattttaaaaccaatcatgccttcccaacagtccc

SEQ ID NO: 524811 - DNA, 312 bp, Homo sapiens
gggggagttcctttgagatgacatgatgactgacagtgccattagtggctctgacccagtttccacttcccaagaaccttctggccaagtgtgatacatgattgcaactgtcatccatccacatgctaagtgtgagtttgggtctccatagaagtttgttgtgggggccgtttactatggtcatgtctagatgttccactaaaggcaggtttagcagacgggctgacgggggctgtgtaacctaccacgcccaaaaacctagcgccagcgtggacgggaaactccttggcttgtggagcgaaaaagacagca

SEQ ID NO: 524812 - DNA, 745 bp, Homo sapiens
tttaaagaccctcatcaatagatggagacatacagaaaatagtcaaaccacatctacaaaatgccagtatcaggcgggcggcttcaaacccaaagtgatgttgggatgtaaagtgaaatattattgggcggataaagcagaatagtgaggaaagttgagccaataatgacgtgaagctccgtggaaagcctggtggctacaaaaaatgttgagccgtaaatgccgtcggaaatggtgaaagggagactcgaagtactctgaggcttgtaggagggctaaaatagaggcccagtaacaattgtaatgagcaggtgcttgaattattgggttccggtggttttctattaaactagtggtgagcctcagggtgattgatacctccgtgatgcgagtaaatacggatgtgttaaggagtgggactctctaggggatatagcggggtgatgccatgttgggggccagtgcccccctaatgggggggtaggggctaggctggagtggtcaacaggctcagaaaaatcctgcgaagaaacactttctgaggtactaaataggataatcccgtaattagaaggccttttgggaccgcgtgggtgtgtgttggccttggaatggtcctccccgtagtaaatagagccatcatggatattggtctggtgtaggaacaggcaaatagaaacgtaaaggaggaaataacacatggtatgccgaggcatagaggacagagcacttagccaggcggaaa

SEQ ID NO: 524813 - DNA, 518 bp, Homo sapiens
tgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaaagatgcctgttgcaaagtggaccatggtctagcagtagcatcagtgtcaaggaaaaacacccactacttagcagactgggaaaaggagcctccctttccccgggggagtttagagaagactactcctccacctcttgttgagggcgtgacatcatgcatggcggcccgcagctatgcataagcctggattcctgttaagctgtgcttccctggtcacacttcctattggctttcatgtttcatcctgactacctggatatggctataaaatacaagagcacatgagtg

SEQ ID NO: 524814 - DNA, 709 bp, Homo sapiens
ggctcacgcccgtaattccagcactttgggaggccgaggcggtcggatcacctaaggtcaggagttcaagaccagcctggccaacatcgtgaaaccccgtctacactaaaataaaaatattagctaggtgtggaggtgcacgcttataagtctcagctactcgggaggctgagacaggagaatcacttgtaccttggaggcggaggatgcagatcgcaccactacactctagcctgggcaacaagagtgagactccgtctgaaaacaaacaaacacaaaaaaacctacccaggcacggtgtggtggctcatgcctcgaatcctaacactgtgggagactgtggtgactgaatcactcgaggtcaggtattcaagaccagccatggcaacatggcgaaacgcccgttgtactaaaaataccaaaattagtcgtgcagtgtgacgtctgacctgaatcccaagtactcatggagctgagtccgcagaattgcttaggaccctgaggcaagaggttgagtgagccacgatcgatgcgttagactgatcttggattgtaccactgcacttcagcctggagaatacattgaggctccattccagaactaaagcttactggccccagacttctggacgggccctttttccggattttaatcggagagatttaacacatcggccgaaatcgaccaaattttcctaggccattaggc

SEQ ID NO: 524815 - DNA, 290 bp, Homo sapiens
gtactccagcctgaggacccagtgaaactgtgtctcaaaaaaaatagaaaaatctgccggtcatgatggtgcacgcctgtaatcccagctcctagggaggctgaggtacaagaatcgcttgaacccgagaggcggaggttgcagtgaaccaagattatgccactgccctccagcctggcaagggggagattctgtctccaaaaaaaggaggtatatatacatgtgcttgtgcctccaggtatgtgtttgtgtgttctaggtttgacacgaaaaagactgatttacttgtg

SEQ ID NO: 524816 - DNA, 123 bp, Homo sapiens
ccagagacccactcgaggagcatcacagcgcatcataacctctctcatgacttcaactctactccactactactggactgtcagacttcagaatatggaatgtctcattgtgatttgatttac

SEQ ID NO: 524817 - DNA, 163 bp, Homo sapiens
tacttgtgatgagctactcctgggtcatgagaaggaacctgccttcagagactatgtggctgtggcacgaggaaacaaagatcacagcattcgtgcccaagaaccagagagtgggctttcagaagagacgcaggtgaagtgcctgagggaccaggcaacagat

SEQ ID NO: 524818 - DNA, 766 bp, Homo sapiens
  misc_feature (8)..(8): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (190)..(190): n is a, c, g, or t
  misc_feature (242)..(242): n is a, c, g, or t
  misc_feature (255)..(255): n is a, c, g, or t
  misc_feature (257)..(260): n is a, c, g, or t
  misc_feature (264)..(264): n is a, c, g, or t
  misc_feature (274)..(274): n is a, c, g, or t
  misc_feature (284)..(284): n is a, c, g, or t
  misc_feature (292)..(292): n is a, c, g, or t
  misc_feature (295)..(295): n is a, c, g, or t
  misc_feature (304)..(304): n is a, c, g, or t
  misc_feature (325)..(326): n is a, c, g, or t
  misc_feature (332)..(332): n is a, c, g, or t
  misc_feature (341)..(341): n is a, c, g, or t
  misc_feature (348)..(348): n is a, c, g, or t
  misc_feature (466)..(466): n is a, c, g, or t
  misc_feature (486)..(486): n is a, c, g, or t
  misc_feature (506)..(506): n is a, c, g, or t
  misc_feature (509)..(509): n is a, c, g, or t
  misc_feature (522)..(522): n is a, c, g, or t
  misc_feature (525)..(525): n is a, c, g, or t
  misc_feature (583)..(584): n is a, c, g, or t
  misc_feature (603)..(603): n is a, c, g, or t
  misc_feature (623)..(623): n is a, c, g, or t
  misc_feature (636)..(636): n is a, c, g, or t
  misc_feature (639)..(639): n is a, c, g, or t
  misc_feature (642)..(642): n is a, c, g, or t
  misc_feature (651)..(653): n is a, c, g, or t
  misc_feature (687)..(687): n is a, c, g, or t
  misc_feature (690)..(690): n is a, c, g, or t
  misc_feature (695)..(695): n is a, c, g, or t
  misc_feature (753)..(753): n is a, c, g, or t
cctgaggnccaaaccctgcctctcagctgcctcctgccctacaaactggtgactgctctcatccagcttctgatctgtttcatttaagatgattaaaatactcccctccccaattcgcttaaaaataattttcaaagattaaaaatttcatttgggngggngngtttttttaaataagaactttaaatgngggatatctccttcttcccctaggtccagttgaggactctggggggcctgcntcttcaccccaanannnnagcngccacttgangccccttggnaattttcnggnagtaatttntttcaaattttccctgcagtnncaaatnccacaaacngcttgcntaaacacgctgtcttcattataggcaccactcctcagctctggcaacctgatctctttctgtcaactagaccacatgcttcagattccctttggtgtggttgggggtttgttgggttngggggggctcgtgggggtcngggggggggcgtggggtggnttngagcacataatcnggnccatatgctgtgaaaaactcatgatctgggatctcagaggatagtgttttccctaggnngaccccggtcaagtatgtncagcatcgagccgtgttggnaaggttatagccnccnccncccaaaatnnntgttgccaactgccattgaagggtgtacttaagntanttgcnaattcccactggagttatgttaaaggagcacatggtatccccagctattgtgtcagcncccagctgtaaga

SEQ ID NO: 524819 - DNA, 312 bp, Homo sapiens
agttaagtttacaagtaaataagcttgctgaatacagtggctcacacctgaaatccccagcaccttgggaggccaaggtgggaggactgtttaagccccaggagtttgagaccagcctgggcaacatggcaaaaccccgtctctacaaaaaacacaaaaattagtcaggtgtagtgatgcatgcttatagtcccagctacttgagaggctgaggtgggaggatcacctgagcccggagaggtcgaggctacagtgagctgtgatcctgccactgcattccagctggttgacagagttaagactctgtcttta

SEQ ID NO: 524820 - DNA, 419 bp, Homo sapiens
cttttccacagggataggggagtgagttttgacaacagctagactgtgagacttgttctttcacctaaatcctaaggatgatgtacataacatttagtttgtgcctaagtaaattgcattttttctcattttgtcttcaacgtttggctattttccagcttactacatcttccaatatagaatgatcagatacagtatgggaaaaaaaactatacctactggtttcttttcttccacttattagaagtgtagataaagtatttgataagaaaaataatttaaactaaactagcatggggattttttattactaggaggctcactttccaatttccagctacaattcaaaattgttataattattggtagttagcaaaagagttcacacttgttagaaataaatcctattatcttattac

SEQ ID NO: 524821 - DNA, 595 bp, Homo sapiens
  misc_feature (53)..(53): n is a, c, g, or t
  misc_feature (390)..(390): n is a, c, g, or t
  misc_feature (454)..(454): n is a, c, g, or t
  misc_feature (497)..(497): n is a, c, g, or t
  misc_feature (522)..(522): n is a, c, g, or t
  misc_feature (531)..(531): n is a, c, g, or t
gggagaccacatgtctgctggtggtctcgtaagattatgatggagctgaacanttcctattgcctaggaaaggtgtactcattgacatgtcgtatcaccacgcattactcatgtgtttgtggtgatgccagtgtaaacaaacctaatgtgctgccagtccaaacctactgtgctgccagtcctataaaagtctagcacattgtgtatactacacaattaggtacagaacgtaatatttgataatcctaagtgcatcactggtttatgtatttactatactttttattgatgttttagagtatactcctatttatttaaaaaaaaaattaactgtggaacagcctgaggcagggccttcaggaaatattccagaaggcattgttattgtangacatgacagctccgtgcatgttattgcccctgaagacctttcagcgatacaggctgtggaggnggaagacagtgatgttaatgatcctgaccctgtgtgggcctangctagtgtgtgtgcttgagtcttantttttaatngttttttaaattaaaaaaattttaatagaaaaaagccgatagaataaggatataaaggaagaat

SEQ ID NO: 524822 - DNA, 146 bp, Homo sapiens
ctgctcggatggggcgggctgtcctcacaggtagtagagtaccagcaggtctggtccaaggtctggtgaatctctgcgtctcctccttggcactggccaaggtctcttctaggtcatcgatggttatctccaactttgcccacagg

SEQ ID NO: 524823 - DNA, 472 bp, Homo sapiens
  misc_feature (118)..(118): n is a, c, g, or t
  misc_feature (174)..(174): n is a, c, g, or t
  misc_feature (205)..(205): n is a, c, g, or t
  misc_feature (398)..(398): n is a, c, g, or t
acccacactcttctggttttccttctacatcagttcttctcagtctcttttgctggttcctcctcttcttgtgtggctctgaatgttgaacatcctaaagccagtcctcgatctcttncctatctacgttcaccacaaaactgccctcaagataatctcatcctgtctcatgtnttaaatacactaaggacagccgggcacactngctcacccctgtgatcccagcactttgggaggccgaggcaggcagatcacgaggttaggagatcaagaccatcttggccaatatggtgaaacccggtctctactaaaaatacaacaattaactgggtgtggtggtacgcacctgtagtcccagctacttgggaggctgatacaggagaatcgcttgaacccangaggtggagattgcagtgagccaagattgcgccactgcactccagcctggacaacaagagaaaaactctgtctc

SEQ ID NO: 524824 - DNA, 361 bp, Homo sapiens
tgttgagtaggctcacgaggaggaagaagaggaggggttggtcttgctgtctcagggttggcagaagcagaagaaaatttgtgtttaagtggacccatgcagttcaagctcatgttattcaaggatcaactgtacttataaaacttcctttcttgttcccctgctaagatggatgagctgacgaagcagaggttcagagaggaagttatattcctgccacttgctaggtaggctgtcagggcaagtcacttcacctctcagccaccttttccaatcccatgaggttgggatgataatgcctaacatgatttttggattgaggattcagagaattaaagatacatcatgcttggcacatgca

SEQ ID NO: 524825 - DNA, 451 bp, Homo sapiens
  misc_feature (46)..(46): n is a, c, g, or t
tgggattagtatatgaggtttctcactacctagtgacttctgtatngacctcgactctttgagataaaataaccgatgtgccgttccgtgtgcataaaagtagaagatgcagagagttttgcaaagtcaaagggaggtgatggacaaggggaatatttaggatgatgaaggcagagccaacagccggacagaagaatagaaccgggaggtagatggctacacggagcagatacagatgagcaggtacgaggatactgatctgatgatcacacattaaggtaaagagattgagctgtagacatagctgagcatgaaagctgacttggaagacacactggcagaaacggaggaacgcattggagcctatctggcgcatatatcaggcgctgatcagcggaatagaagcaaatttgggagatgtgcgagatgatagagaagcggatatgctttg

SEQ ID NO: 524826 - DNA, 217 bp, Homo sapiens
  misc_feature (199)..(199): n is a, c, g, or t
  misc_feature (205)..(205): n is a, c, g, or t
tgtagtcccgtgctttgggggccaaggtggtggattgcatttggctcagagttggccggcctggcgaatgcggaatgcctttctacaaaatacaaaaagtggtctggtgtggtggatgcacctgtgtcccagctacttgggggctggtgggggttcgcttggcctgggggtcggctgtgcagttggttgcacttctacnttccancctgggcgacag

SEQ ID NO: 524827 - DNA, 123 bp, Homo sapiens
tgaagaaatactggagttaaggggtcagagagagagcactaaaaattatgagcaggagattataaaagatttgctggaaactgcgattaaagaagcagttttaggtattgtaatcttaagaca

SEQ ID NO: 524828 - DNA, 519 bp, Homo sapiens
  misc_feature (25)..(25): n is a, c, g, or t
  misc_feature (78)..(78): n is a, c, g, or t
  misc_feature (80)..(80): n is a, c, g, or t
  misc_feature (82)..(82): n is a, c, g, or t
  misc_feature (89)..(89): n is a, c, g, or t
  misc_feature (100)..(100): n is a, c, g, or t
  misc_feature (105)..(106): n is a, c, g, or t
  misc_feature (115)..(115): n is a, c, g, or t
  misc_feature (118)..(118): n is a, c, g, or t
  misc_feature (134)..(135): n is a, c, g, or t
  misc_feature (143)..(143): n is a, c, g, or t
  misc_feature (147)..(149): n is a, c, g, or t
  misc_feature (153)..(153): n is a, c, g, or t
  misc_feature (155)..(155): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (198)..(198): n is a, c, g, or t
  misc_feature (203)..(203): n is a, c, g, or t
  misc_feature (217)..(217): n is a, c, g, or t
  misc_feature (221)..(221): n is a, c, g, or t
  misc_feature (223)..(224): n is a, c, g, or t
  misc_feature (235)..(235): n is a, c, g, or t
  misc_feature (239)..(239): n is a, c, g, or t
  misc_feature (244)..(244): n is a, c, g, or t
  misc_feature (246)..(246): n is a, c, g, or t
  misc_feature (250)..(250): n is a, c, g, or t
  misc_feature (252)..(252): n is a, c, g, or t
  misc_feature (266)..(266): n is a, c, g, or t
  misc_feature (274)..(274): n is a, c, g, or t
  misc_feature (279)..(279): n is a, c, g, or t
  misc_feature (283)..(283): n is a, c, g, or t
  misc_feature (292)..(292): n is a, c, g, or t
  misc_feature (301)..(302): n is a, c, g, or t
  misc_feature (305)..(305): n is a, c, g, or t
  misc_feature (308)..(308): n is a, c, g, or t
  misc_feature (314)..(314): n is a, c, g, or t
  misc_feature (316)..(316): n is a, c, g, or t
  misc_feature (321)..(321): n is a, c, g, or t
  misc_feature (323)..(323): n is a, c, g, or t
  misc_feature (333)..(333): n is a, c, g, or t
  misc_feature (337)..(337): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (352)..(352): n is a, c, g, or t
  misc_feature (364)..(364): n is a, c, g, or t
  misc_feature (368)..(368): n is a, c, g, or t
  misc_feature (378)..(378): n is a, c, g, or t
  misc_feature (396)..(396): n is a, c, g, or t
  misc_feature (398)..(398): n is a, c, g, or t
  misc_feature (415)..(415): n is a, c, g, or t
  misc_feature (512)..(512): n is a, c, g, or t
tggagtaaaaaccaggtgtaacatnttccggtgggggccctgggctctgcatccgcccctccgaagttagcaggagcntntnggaagtnaggtagcagcnaaganncccagcgtnttngaggggaagcgaaatnnttagtttnatannngttntntttntngnaatagcgccgcgcacagaaaaggaaactttttttngtttnttaagggcagggcngggntnnttgtaggaganggtnagctncnggcncnggcaggagcggatncaggagcngcgtngggncgcagagcnggacttttnnagnttntttttntntgcgntntttggtggangctncggttnatncngggnttttcaggtttntttnatgttttgtntgttttgttttttttttntnctcggttgttctcagcnctcttagatgttttcttcttgttgtatttgttggttgttgttggctgccgcggcgctgagtacttcacggggaagctgaggtcgggacggccggtgnagaccca

SEQ ID NO: 524829 - DNA, 802 bp, Homo sapiens
gagaaaagtctgaggccgctaaataccctccgttcaacgttgcactcccggcacgtgatcctgcctgccctgtcggtccggtaaggatgaactcaagttgaggcagcagaagcttcctcgcttctttgtgcattccctgaaccgctgcgtttagagatgccaaatgaggatcaaaatgagaacaatgaagccaagtgtctgggagcacagtgaagaccactgggagcacccgtggcacctgggagcacatgtgaagagcctgagagcatcctggcagcctggcggatgcgcaggttggcccctgaactgttctttgttgtacaggactctgctaacttctcacttggaacagacctgcgtaagagccaggtgggataagcgtaaagcaactcagctgctacagggctttgaatggagacacaaacggtctatttactgatacgtttggctgcactgttggaaacagctgctggaagtctccctgccgtgagagctctcattgccactactggaacatgagcccaggacaggcagactggggcagtgactgcaccaggaaaactagaggtcagaactccgggatcaggaactgtagcacatatcccatgcaggtgaaacgctctttgaggcctcctttaggaacagcgtctccccggtgcgtttgcgaaaagaaccattaattggtacacaccacattatcaccagcactccagggcattcggcccaagtatcagctgccgggtggcctaactgcaaactctgatctaccgaacccttataagggtattgagccggcaaaggc

SEQ ID NO: 524830 - DNA, 170 bp, Homo sapiens
gtgggggcccggggggggggggggggcccctttttttcccccccccttttttttgtccgcccggggcccccatataatagtgagatatatgggcttgttcttatttcaatattcatttagtggataaaatacaagtgaaacagatgtattagaacaatgtaaacatataa

SEQ ID NO: 524831 - DNA, 435 bp, Homo sapiens
gaaagaagaagaaaagctcctgactaaatcagggctgggcttagacagagttgatctatagaatatctttaaaggagagatgtcaactttctgcactattccagcctctgctcctccctgtctaccctctccctcctctttcctccacttaacccacaatcttgaaaacttccttcctctcctgtgaaccatcaattggccagatccattttcagtggtctggattccttttaatttcctttcaacctcgaaagaacctggccataggcccactatgtgttgtaactcccactagtgtcaggtccctcttgtttccaagagattcctgggtctccagagcccagacaggctcactaagctctaactgaagagcacaggcactcaggacagggtcaaatggtacacagctctcctgtgcccaggagaaggggtgta

SEQ ID NO: 524832 - DNA, 696 bp, Homo sapiens
acaacttattttctctatcataatcagtccttacaatctcaaaccacacacctcttccacagaatagtccctgggccttgaggagttgattagctttaatttctggcctgtgttttaggaatccagtttattttgatgacttcttctaccagacctgaagatgaggatttaatgctgtcagtgtttaagatttagcaagactggtgtcctttttagacccaggagtcaaagccctgtaactcaagtgtcacaagtactttaaaagcacatacagaaagatacacggatgtaatacctttaatttttttaaaaattttcttttaacctcagtttttttctaaacaaaccaaaacttaataataatggcataggaattatttcaataaaatgtaaaatctgttagtcagttaccaaaaagcaaaaaaaagaccttctgcagtgcacaaaatattatgtcggaagaaaacatttcctttagacctgtatgttagcatcaggccacaagaaacagaactcgagggaaaaaaaacttacatgagctgaaaatgagatgaaagtgaagcattactattttacacatttttaaacagggagagaaaaccaaaaatggtgagatgcataaaagtgacttgcgttgaaaaacgcaggaaaaattttggggtggccggaaatttataaaatttgggggggccacag

SEQ ID NO: 524833 - DNA, 112 bp, Homo sapiens
tcggtacctgattacgactccggtcacacactgtaagatcaaaaaaccattcacatttgaaagagatgtaggtgtattcatagggatggtggctcaacaaatcaagcaaact

SEQ ID NO: 524834 - DNA, 437 bp, Homo sapiens
attcaacttcttcgtatagtgccatgtggcatctaaaataactatggctaggaaataaaacatatttgcagaatgtaaggggttgacatcaaagacatggctcaaagtggcccttcatttggctccacgtcatctcacaatagtgaaatacagcagcaatgtcactaaactcacatcaacaactaaggggcagcagcattttgcaaccaacagggagtgcaagcacacgttttttgctcctgttttcaacagtcacttgtcactaatgcacacacaatagtgcatctcttctaggcccaagttggatccagtgcatccaatttcatcagcatttctgtttcaacatcatcaaaagcaaaaagtaatctgccaattagaaaaccaaaaaactcaaacttaagtgatgtactgatggagccactgtatttgcatagaga

SEQ ID NO: 524835 - DNA, 348 bp, Homo sapiens
agcggacccggctctgaacttaggctctctgaacttaggcaaataatattttacagcggattttatacattctaagtgtacttcatcccaacacagttgctttttgatagtgtttttaaaaaattcttttatcttaaatttcagtttgtaaaatgtttaaaaaatttcagattcataaatccaacacctacaaatcacgtctgtgtgcctattgaaagcactcatgttccacatgcctaaagccaaacttttaactaccattcccacatgtcctcctgactatcagtaccaaaaagcagacagacaaaagtgatgcaaaccgggtcctctcctaagttcagagccagg

SEQ ID NO: 524836 - DNA, 100 bp, Homo sapiens
aaattagaattctcagtacacgggcttaagttgatcaactttctagaaaatcagcccttgggggattccctgtgtactgggtagttcaccctttatcact

SEQ ID NO: 524837 - DNA, 344 bp, Homo sapiens
tacatcagagtacgctgatgaactcaggaggttgaggtgcagtgagctgagattatgccactatactccagcctgggcacaaagggtgaaactccgtctcaaaaaaaaaaagaaaactcagtttacccaaacggcccccactcttcatattattaccaccagtcattcatctcaattatggcactcttgcttcagagccaggtgctttactcattgtttctcaatctttcacaacagcccccagagggcaagtataagtttccctcacttttcaagcaggcttcagcacaggttcaagctcatttccccctaggtcctcacgtctggcattgcaccactcttgg

SEQ ID NO: 524838 - DNA, 190 bp, Homo sapiens
  misc_feature (100)..(100): n is a, c, g, or t
  misc_feature (111)..(111): n is a, c, g, or t
  misc_feature (158)..(158): n is a, c, g, or t
  misc_feature (179)..(179): n is a, c, g, or t
ctgcacacagtgggaccacagagatgctgtcatcatttgtgaattggctcagggaatcaggcaatgaattgcccgttggagaagacaaggaatagaacanagggaagaganagattaaaggttaaaagcactgggcgctgtggcttacatctgtaatnccagcactttgggatgccaangcgggcagatc

SEQ ID NO: 524839 - DNA, 363 bp, Homo sapiens
atgcaactgaagttaattttttactagcattaaaatatattgttggatcttgtagaggtgttagataatcccccaaggtactactaagaaaatatcggaggccaggcagcggtctcgcgcggtgtaatcccagcacttgggggggccgaggcggcggatcacaaggtgaggagatggagggcatcgtggctagcacggtgagacgcggtctctattaaaaatacaaaaaaaaaaaattagccgggtgtagaggtgggcgccgggagttggagctactcgggaggcggaggcagaagaatggggtgaacccgggaggcggagcttagagtgagccaagatcgggccaggggagtcgggccgggg

SEQ ID NO: 524840 - DNA, 459 bp, Homo sapiens
tgcggtggtatgagtggagggagcaaacaagaggttcggatggacctttgtaagaaccgtgtcactatggtgtgggcggaaatgaacgggatgggaaaatacgctacctatagaggcaggcactggaggtagtgaaacaatgaggcgagacgtgaggacctggggtagtagttggggcacggggaatattaggtggggtagcatggcgggaggggggggggtggggggcagccgttgctaaaaaccgcaggggtgaaagggggggtagtagccgtggatacaccagaggatactgactagaaattgataggactgtgcggggacgccgtagacgatacgtggcgggttacactggcgtgcgcatagttggcccctggggcaataccgcgtgcgctaagctgaccagcggttcgtgcatccaatagttgagaataagattagttgcctaatccggaggat

SEQ ID NO: 524841 - DNA, 106 bp, Homo sapiens
gaacagaagctctcaaagccctgccgtttcctctcgctgccactttggaaaataagagactagagattcactggacgcttcctcccggcatcacaagacttgactg

SEQ ID NO: 524842 - DNA, 162 bp, Homo sapiens
acagttggatcaggacatcccgcatgtgcatcccgctattaaatggttcgtttgttcaacgattaaagtctctacgctgatctgagttcagaccggattagtccaggtcgttttctatctacttcatattcctcccttgttcgaaatgtctctacctgtaca

SEQ ID NO: 524843 - DNA, 467 bp, Homo sapiens
  misc_feature (88)..(88): n is a, c, g, or t
  misc_feature (131)..(131): n is a, c, g, or t
ggctccagtcctgtcgtgcgcgcaggcccttattgagagcgggatgaagtacgaggacgccatccagttcatccgccagaagcgccgnggagccatcaacagcaagcagctcacctacctggagaaatacnggcccaaaaggctgcggttcaaagacccacacacgcacaagacccggtgctgcgttatgtagctcaggaccttggctgggcctggtcgtcatgtaggtcaggaccttggctggacctggaggccctgcccagccctgtgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 524844 - DNA, 407 bp, Homo sapiens
  misc_feature (88)..(88): n is a, c, g, or t
  misc_feature (131)..(131): n is a, c, g, or t
ggctccagtcctgtcgtgcgcgcaggcccttattgagagcgggatgaagtacgaggacgccatccagttcatccgccagaagcgccgnggagccatcaacagcaagcagctcacctacctggagaaatacnggcccaaacagaggctgcggttcaaagacccacacacgcacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatcgcccccgcccggacaaggttgtgaatgggcgtgaggggatcctcagcagtcgaccacaga

SEQ ID NO: 524845 - DNA, 115 bp, Homo sapiens
cacgagggcaatgttcaacattaacattgatgatgactatctcccgtgtctccaagggatcacacgagctaccttctgcaatgtttatctagaatggattcaacactgtgcacgg

SEQ ID NO: 524846 - DNA, 1926 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 524847 - DNA, 2296 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 524848 - DNA, 675 bp, Homo sapiens
gacccacgcgtccgggggaattccgtcttctgcactatgcgggggaggtgagctacagcgtgacctgggttactggacaaaaacaagtgaccttctcttccggaaccttaaggagaccatgtgtatctcagagagatatcccattatgagccgagtgcttcgaccggatgcgaggctcagtgacaagaacgcggtccagagatcggtcgccacccagttcaagatgagcctcctggcacgctggtggcacgatcctgcagtctaaggagcccgcctacgatccgcatgcatcgaaagcccaatgatgccaatagcaggcccgggccgctttgacgaggtgctgatccgccaccaggtgaagtacctggggctgcttggtaaaacctgcgcgtgacgcagagtccggcttgtgcctatcaggcgcaaagtacgaagctttcctgcaaaggtacaagtcactgtgcccagagacgtgggccacgtgggcaggacggccggaggatgggagtggctgtgcttggtccgaaacctgggctacacagccagaatgagtacaagatgggcaggatcaagatcttcatccggttccccaagaccctgtttgccacagaggatgcccgtggaggtccggcggcagagcctgggcacaaaagatcctaagctgactgtcagggg

SEQ ID NO: 524849 - DNA, 1964 bp, Homo sapiens
gccggctccgcggcggaggggcggcgccccgacccaggcccagcaccgtgggcaccgccaggccggcgcgtatggaggcggtgggacgcctgcggcgcgggtgagcctggcagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 524850 - DNA, 194 bp, Homo sapiens
  misc_feature (156)..(156): n is a, c, g, or t
gcggcgcttagaggatccccaaacttcccgtggcgctacgcgtggcatcgtggtgcgtggacagtacgggatgaagctgccaggcatggagtacgttgacggggactttcagtgccacaccttcgacagcagcaatgtgagtgatgcgtccccccnccacaccgtttccctcaccccgctcttccacgcccacg

SEQ ID NO: 524851 - DNA, 1851 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 524852 - DNA, 117 bp, Homo sapiens
gggagactcttttttggtcggccatggacctgtagctctcgtgttcggatacaggaggcctcaactgcattgatgagcagagagcggaagcccccactctctagaaagtgcagggcg

SEQ ID NO: 524853 - DNA, 921 bp, Homo sapiens
gaccggtgttgtggcaccccaccatgtgtggcgaacccccctcgttaactttcataccaccatttttgttacacagatctcgccgctcttaaagtatctcccgtggtgcccacaaacccacatatctcgcacatgctcaacaaattacattttccgccaccttcataccaacatcgtgcgttcactcactttagtgcacctacacgctccttcaaacaatctttcccacacgtccacgctggaaacacctttagtcacgttccccaccgtccgccatctaaatatgcattcgtcgttttcagcccctcctccccaccaatgctttatgtcacaacatgtgactccactaatactatctttcttataaccaaatcctcccccttcaaacaccgcaaagaacaacaatcctccgaagtttataaattacttagtctttttagacaccacgcaaaaaaaaagtattatcacggcacttaacatctaatacgcaacaattctgtttaagtcgtctaccttcttgagcccatatgaaattgttctatctaactgcactcttcgcatccccacatgggtttgaacaaacctacgtattataaacacgttgcgttcgttcaccttattatttgaccccaaatggctacaataccctgccacgagcgccgcctaattcccaacagaatgagctgtttgggtgccaatacacctatacagagcacaccgcagtggagttggcgcaccccccggatgctgcgccccacacttgtatggaaagagagaacagacacggtggtactaccaccgacattgaggaagatttgctgtgggatgaatctcgcgataggcgccgtccagtagggtgctcacacccggcgaaacggtcgttgctgaattcaaacaaaacgccccacttcttacataaca

SEQ ID NO: 524854 - DNA, 176 bp, Homo sapiens
tctcactttgttgcccaggctagtctcaaactctaggcccaagcaatccttccacctcagccttccaaagtgctggattataggtgtgagccaccatgcccagccattgttttttattttcctttttttttttttttttttttggaaagggaaattggctgggtggcccgggggga

SEQ ID NO: 524855 - DNA, 2019 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggcaaaggaaaacagaacaaaaaaaaagggcggcgacacaaaaaaacaccagggggggcacagaataaggacaccagtttttacaaaaggtccc

SEQ ID NO: 524856 - DNA, 127 bp, Homo sapiens
aacgtcggccggaccgacatggggacacacaagagtgtgacagtggacaagcgcgcgcatgtctctgatgcttgtatcattctgagcaatcgctcggtccgggacaataaacagtattatcaaagag

SEQ ID NO: 524857 - DNA, 2022 bp, Homo sapiens
  misc_feature (1986)..(1986): n is a, c, g, or t
  misc_feature (1997)..(1997): n is a, c, g, or t
  misc_feature (2003)..(2003): n is a, c, g, or t
  misc_feature (2013)..(2014): n is a, c, g, or t
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaaaaaaaaaaaaaaaaaacaaaaaaaacacaaaaaaaaaaaaacaaaaacaaaaaanacaaacaaaanaaaaanaaaacaagannaccacaaa

SEQ ID NO: 524858 - DNA, 2221 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 524859 - DNA, 365 bp, Homo sapiens
  misc_feature (253)..(253): n is a, c, g, or t
cgctgttgcgtgctgccagcgggaagctgtgtaggggtatgattgtcgcggcagggttccccgaggcctgcttagacgcgagcgcgccggtgagactgacagaggaaaggatagaggaacgtgctgccctaggtctggatagatgctcgaagcgaagcgtgtttccttcccgccaggcaacgtgacctttatgaaaccggggacgcctgacgccacattccgtggccgtgcattcccagtcccgttctcccgngaggcggaggtgacgtgaccatcatcgagttccttcggttctagtcaggtgagcccacttaccttgggcatgacagctcgtgaggaagtaacactcgaatgaaaggacaata

SEQ ID NO: 524860 - DNA, 2242 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 524861 - DNA, 719 bp, Homo sapiens
  misc_feature (470)..(470): n is a, c, g, or t
  misc_feature (473)..(473): n is a, c, g, or t
  misc_feature (507)..(508): n is a, c, g, or t
  misc_feature (637)..(637): n is a, c, g, or t
cccaggcggggggtgaagctcatgcccaagctcaagctcaggctgaagcccaggcccgggccaaggcctactatgcatctcagaaggcgtagctgcttcagcatcagcatgagctgcagctgctacagccaccaccacactttcagtctactggggcagcccccaacggtgggggtggtggggacggacatgcggtgacaatacaccatagtggctggctgatgaccacgaccatcgtatatggaccgatgagctcttaaggacatctgacttactgtgacccactgcaccatacatgaggagcatctgatcagatcttagagatgcgcgctgtccatcattgggaagaggaacaagtcatgctgtggggaatcgtatgcaacactgggcgggaagagagaatttcttccgagtctggatttggatacgtcttcatgagcctatgctacggattgcctatacgggcgggnccntggggtgttaacttctgttcaaaaggacatttannccctcctgattggcaagggatactgagctgatggtgttattcagcagcctcccctccaagcaaagcttctaaaactggggggtcggtgcttaagggaaggattttgctatgaccctctagaaccttggncagtgtgggcaattaccctatgcctacccttcttatcctcaagtttgggctgatgtaatggcttggcctcctacaggggttt

SEQ ID NO: 524862 - DNA, 152 bp, Homo sapiens
ctttgaccatcaccactgggtgtatagataaatgatgggtaggtaggtagacgaatggacggatagatggatgcatggataagatggatggatgggtgaatagatggtagatagatgggtaggtagatagatgactggatggacagatggat

SEQ ID NO: 524863 - DNA, 130 bp, Homo sapiens
ctggagttatctgtttccctgtgcgatctacacacaggtcgcaggtagctcagttccacacttgagctagcaatggcatatacttccataaggtgcttccttcgtgtagtaggactagcatgggggtcat

SEQ ID NO: 524864 - DNA, 419 bp, Homo sapiens
  misc_feature (96)..(96): n is a, c, g, or t
  misc_feature (102)..(102): n is a, c, g, or t
attttttaggaacgcacggtggccccgctgcttgaggccggctttcggaaggagaacaacgttacggaggttaaggggctggttcccccggcccanttccgnttataacctttccccaaattattacgccccttgtggccaaaaggttagccccccccccgggccgggcccacccattgcctcctccgtgcctttttgggcgggagttcagggggttgccccccccctggggtgattcccactgtgtgttccccaaaacttttccgggtttttttttagggggtccccccaccccagggtgattcccactttgtgttccccacaacttttcccgctttttttttaggggcccttctgccccctgcaggggcccttaggttaaattaaccccggggctggggttggcccgttggccgtta

SEQ ID NO: 524865 - DNA, 129 bp, Homo sapiens
aaactcccgtccattcctgacagtggacttagatatgttctgtttctattttcttcgatgtcagtttttcattcttgatgtttatttcttttgtccatcagatctcttgtgaaatcccatggaaggttg

SEQ ID NO: 524866 - DNA, 781 bp, Homo sapiens
tccgttatcccccgaggccgagccgtgggggacatgaagagaccctaggcccgtttctagctgtcaaaaactgcccgcaagggtagccatgattgatggaagcaaggaaatagcttgtaccagggacttcctcgtcctgacctaccgtccccgcgtcctattgcccccctccgccactggagccgcccccagagctctgccccgaggatataaaccaccatttgaaattactgtcatatgcttcctattgccattgagccatggtgatctggagctagccagccaagtttgtccatccagctgaagggggaatcccagacgagtggcaccggactggctgaaggaagccccggatgaccctagaaacgaaaccagatagtgggaatcccgaccagcaatatgcccgccgccctagggatagggacccctcaggtgcagcccgagtgaggtttaggaagattttcataaagtcatatttcatgtccaaggagaatcagccgtgatagatgaagggttcgcacgcgagagtcccggacttgtctagaaatgagccggtttaccagtactgttctaaatggtaacacctgttgcatttatattctttccctttgctatcatgtcagtgaacgccccggagtgctttctttgccacttgtgtaacctatttctgttttttcaggttttactgatgaggcttgtgaggcccatccaaataatgtttgtgatctctactactgttgattttgccctcggagccaactgaattaagccaaccagatga

SEQ ID NO: 524867 - DNA, 458 bp, Homo sapiens
gaggaaaggcaaggaagagtaaagaggacaatggaaggagaaggagagagggaaagcggaatggaaagaaggaggccgaagaggggacataggaagaaagggaaaagaagaagggggagaggtgagaaagaagagggaaaaacgagaacagggaaaggcggaaagagaagtacgaagaaggagagataaagaagggaggagcagtaaagaggaaaagaataaaggacaaaagaaaggagagaaaagggacagaggggaagaagtgagaaagaggaggagaggatacaagaaggagagaggggtgatgagacagaaaggctagctaagtggaagcaggggaggacagagtggggatgagacagaggaagcacgatagatatatatctacactactactactactactactactactatatatatatatatactatatatagtgccgaattcctgcagcc

SEQ ID NO: 524868 - DNA, 273 bp, Homo sapiens
acgtcgagctcggccctcctcttctgtgcttctgcttgggcataatggagtactttagaaacagtgcaagaatgacaagatattaaaaaaaaaaaagaaagaaaaaaaaaaaaccccctactttaaaaaaaaatacctaaaaaattttaaatatggttttctctaccatttttttttctagtatcctggaattaaagcatcagggcggcatttctaactcccttaaacaaggggtccccctataagtcgccctggcgggcttcgaaggttggg

SEQ ID NO: 524869 - DNA, 840 bp, Homo sapiens
gagcactgaaatcctgaagaggagagattggttataaattaaaaaggtgggtgatcttaagtgcctcagttaatgcacgtacagtattcattgtggtgtggtgtgtactacctctcagaagtaaaattgtgtcaccttatggaatgagagtttcgggttgggggtggtttattgttgtgctttggttggtatttcggttgtgtgtattgtataaattttctgtataattagcccaggctgatgtaactataaaaattagttgaaaaaaaaatatgtgtttccttaatggaattctcacttcattgtgaatataagatttgggatgaaaggataggtataaagttgggtttgtctcaaggattggatccatatttatccctaaatatttcttaagggatgtaactttttataaccattaagtggggggaagggggtggagggggtggtaataattataactgaagggtttaaatatactacctaggaaaaagtacttctgtgacatttacaaaaaaatctagtggactagggcttcagcatgactagagatatcaatttcgcagaactgacggacactctcttcgtgcagtacaggtattccaagagagttatttcccttctcaataatgtggcataaattcggtaaatcagaaataggtgagggagatagtttattagccagtaaaaattggtgggattgcaggaaactaatgtgagaggaaaaggggtttcaatgaattataaccggagaattgacatattgttaatttgaagcctgtgagttaaactttgggttggtgagcaataaaggaggcatttttagcaagtgtgtgtttaaat

SEQ ID NO: 524870 - DNA, 311 bp, Homo sapiens
aaaaaaaaaggacaaggaaaaatttttccactgtagttaaaatggcaaagcttaaggtaaatataatcctaaaaactattgaccatcacttatttataataattttccacattttaacctggggggggagaaaaaccactggaaataactgtgttttctaaaacagtttaatcacgatgtagtccatatacatgcaattcacctatttaaactctttactccactgatcttgggtatactcccagggatgtgtaaccatcagcagtccaatttcagcattgtccctcaccacacaaagcagcattgccccc

SEQ ID NO: 524871 - DNA, 180 bp, Homo sapiens
cagtggcttaaatgacaaaaatttattatcttatagttctggaggtcaggagtccaaaaatgggtcaatagggatgtgatccttctggaatctctaggagagaatctgttttcttccattttccagtttgtagaggcagcccacattccctggctggtggcccccttctgtcgtcttctc

SEQ ID NO: 524872 - DNA, 209 bp, Homo sapiens
aaaagaccggaggtttctttaccaacggtttgactcttggcgcgagaattctcagtgatcagagatagtctataggtcgatggtgactgcacatggacatccggacaaggagtcagggtggggggccacatacaatgtggcttcggcagacctggtggaggtgagtaggcattcttggttaaagtttcatccacattacacttattagc

SEQ ID NO: 524873 - DNA, 168 bp, Homo sapiens
tcggtaccattcatacggaaagtctttattgaggtctgggttaaaattaggacttggcagagcagccagtaaccctgatcggcccaggtgtcgaggtgcagcagttggccgtcattgcgcaggctttgcgggccgtccagcatcccgaggtggcgcaggtccttgtcg

SEQ ID NO: 524874 - DNA, 236 bp, Homo sapiens
gggctgctgctgaagtagccgctgctgccacagctgctcatgctgcttctcctcactggagacacgatcttgatctccttgctggggctcactgacataaaagctggagatttcccgatggcatggctctgcttcctcaggcagaagggactgcatgaggttccctggggggagggggtactttttatttgagcagttccatcagtctttcccctccgcgggagttcattcttgac

SEQ ID NO: 524875 - DNA, 720 bp, Homo sapiens
  misc_feature (71)..(72): n is a, c, g, or t
  misc_feature (183)..(183): n is a, c, g, or t
  misc_feature (259)..(259): n is a, c, g, or t
  misc_feature (338)..(338): n is a, c, g, or t
  misc_feature (352)..(352): n is a, c, g, or t
  misc_feature (368)..(368): n is a, c, g, or t
  misc_feature (372)..(372): n is a, c, g, or t
  misc_feature (376)..(376): n is a, c, g, or t
  misc_feature (382)..(382): n is a, c, g, or t
  misc_feature (404)..(404): n is a, c, g, or t
  misc_feature (411)..(411): n is a, c, g, or t
  misc_feature (415)..(415): n is a, c, g, or t
  misc_feature (420)..(421): n is a, c, g, or t
  misc_feature (431)..(431): n is a, c, g, or t
  misc_feature (442)..(442): n is a, c, g, or t
  misc_feature (446)..(446): n is a, c, g, or t
  misc_feature (450)..(450): n is a, c, g, or t
  misc_feature (455)..(455): n is a, c, g, or t
  misc_feature (469)..(471): n is a, c, g, or t
  misc_feature (548)..(548): n is a, c, g, or t
tcagtgtgctgtccagagtttgcagatagtgatctgccaacatgttcatgacttaacaagaaactacagcnntatttagatctaacctggataagtgctatgtgatcctctgaacacgtccattgttatgccaaccagaaacctactggagttacttattaacatcaaggctggaacctattngcctcagtcctatctgattcatgagcacatggttattactgatcgcattgaaaacattgatcacctgggtttcttnatttatcgactgtgtcatgacaaggaaacttacaaactgcaacgcagagaaactattaaaggtattcagaaacgtgaanccagccaatgtttngccaatcggcatttgnaaancaantttgcngtggaaccttaatttgttctgnacagtcnaaanaaacnntattgagganaattaatatcncagnatanccccnccctttccatttgnnncagtgattattttttaaagtcttctttcatgtaagtagcaaacagggctttactatcttttcatctcattaattcanttaaaaccattaccttaacaatttcttattctttcgcaagtgtggcgtcttttatattcgaattacgtaactgtcatgaagtcatacgataatagtacatgtcaccttcaggtagtaggaagacttacaatttcttacaatcatctatctggataccatgtaaatcaagcaa

SEQ ID NO: 524876 - DNA, 471 bp, Homo sapiens
  misc_feature (38)..(39): n is a, c, g, or t
  misc_feature (88)..(88): n is a, c, g, or t
gggtcgatctcgaggatcccctctctccacacggtacnnaaagagatatagaccaatggaacagaacagaaccctcagaaataatgcngcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcaatatggattaaagacttacatggtagacctgaaaccataaaaaccctagaagaaaacctaggcaataccattcaggacataggcatgggcacagacttcatgtctaaaacaccaaaaactatggcaaataaaaaataagacaagatgctaccaatgatgaccagcaagtgaatccaagtcaaactcttgctttcaatgaccagtgtggagagaggggtaccgagct

SEQ ID NO: 524877 - DNA, 316 bp, Homo sapiens
ttataggacctgatcatgtgcattgtgtcacctctaaataccacgatcaaagggacagcatcaagcacgcagcatgcgctcaaaacgcttagcctatgcaaaacctcaggtcaacagcagtgacttaacctttagcaataagcgaaagtttaactaagctatactaaccccagggttggtcaacttcgtgccagccaccgcggtcaacacgattaaaccaagtcaatagaaggcggtgtcaagagtgtactagatcaccccctcctcaataaaagctaaaactcaccctgagttgtaaaaaactccagttgacaca

SEQ ID NO: 524878 - DNA, 515 bp, Homo sapiens
  misc_feature (45)..(45): n is a, c, g, or t
  misc_feature (79)..(79): n is a, c, g, or t
  misc_feature (87)..(88): n is a, c, g, or t
  misc_feature (105)..(105): n is a, c, g, or t
  misc_feature (112)..(112): n is a, c, g, or t
  misc_feature (114)..(114): n is a, c, g, or t
  misc_feature (117)..(118): n is a, c, g, or t
  misc_feature (178)..(178): n is a, c, g, or t
ctagatggagctttgctcctgtttcccaggaatggagtgcaacancaccatctctgctcactgcaacctctgcctcctngggggaannggggggtgctacctcancctcctnantannctgggattacagccacagaagcaaggggacaaaggcgacatcatcggttggaaagcgtcncaataagacgcacatgtgccactgctgtggctctaagggctaccaccttcaaaagttgacctgggggggatggggctaccccggcaagcgcaagagaaagtataacggcagtgccaagggtaaaagacaaaataccaccggggactggggcgaatggaggcacctaaaaattgtagaaccgacattcaggcacagattccgggaaggaacaccacctaaacccaagagaggagctggtgcagcatccaggtcatcttaagaatttcacgatgagtaatgcaatagatgtgtcggttaaaaaaaaaaatgtatgaatactaaaggttgagctttacat

SEQ ID NO: 524879 - DNA, 431 bp, Homo sapiens
gtaggtatttggctcactttgctgaacctggctatactgccatcgtccagacactcctgcagcgccagataatcattcacagtgtatcccacggcgtgttcatacctggatggtacccagaattagcgggccctgtgtgcaggtgacacttctttggcatcaatcatcacagggttggactcgataaatctcgagatgtcccacttgtcactaacgcacaatggcaccacattctaaaagagccagaagatggggcgatcatctccctacttgggccgcgattcatcaaggaggcggtaaaactcaaagaagagccggcaagtgccctcgtagaggcccttgcgagcagggttgacgatggagaggtcattgcagggactacccccaatcaccagatcgaatgggccccactcctggatatgcttctgtgt

SEQ ID NO: 524880 - DNA, 138 bp, Homo sapiens
gatctcggtgagaggctagagagtgctatccttggtgagaggctggagagtgctatcctcggtgagaagctggagagtgctatcctcggtgaggggttggagagtgctatcctcgatgagaggctggagagtgtgatc

SEQ ID NO: 524881 - DNA, 313 bp, Homo sapiens
gtcaaaagaattccatctcttctgagcattagacgaagagtagagacataagagatcatcaaggactattttccaacggaggcaaacatctcgcttcatcgctcggtacggttccagagcaatcacatggatatggtgatgaatggaatcaccagagaaaatttctttacttcccaaaacatcctggaatatccctcagcctggtgagcgtgatgttcgcgaggaggccttgtccacagaggtactggatctcatcttcatgccaggccttgatttctgagaaacatgtctcactgtcgagggcaagagataa

SEQ ID NO: 524882 - DNA, 452 bp, Homo sapiens
  misc_feature (58)..(58): n is a, c, g, or t
atccagtccttggagaatgcccttggccccataaaaatatataaggcccgctttgaanacaacctaaggagggtggggggcccctctcccctacaaaaaaggaaaataaacaggtattttttggccctttagtaaaaattgggccaaacccgggcaaaaggacaacccccggccccaaaatataaggccccttttaaaaaaaaaggaaaagtggaggggtaaattccccccccccccccccctttggaaaaagggaagggcttttattttggtattgccttgggaaaaaaaaatatccatgaaacacattcaaaaaaccccccccccccggaaaatggatgggaaaagggggttttaagccaaaaaccccaaaatttttggggctttaacaaaaaaaaaaaagggtcccttttgggagaaggggggcaaaaaaaaatttaaagttttttgga

SEQ ID NO: 524883 - DNA, 908 bp, Homo sapiens
  misc_feature (667)..(667): n is a, c, g, or t
ctgcgctcgttaatgtggtccaagggggcctccccctaggttgttgggggcgtttttcttctgtgggtgtttgcgtctaaaacgcgggggggctctgacgcgtatcatggcgccgccacctgagctgccctccccgtgggggcgactttgatggggggtccatcatgttggaggagaggttttttggcgcgtgtgtagcccctccctgtgggtgggacgagtagtgcattaagaggggttggtgggcacccccccatcgtcgtcgatattcttcgtgcgtgctcctcccccgccgcttttgttgggggggacccccgacctcccacacgggggagacacacgccgttcttttctttgggtggtcgcacgcacggccccctcggtccctcgcgacctaggagtgggcgcccctgtgttgtgtggcacaccaagctccctcatggccgcctaatcagttcgtggtggcgggccctctcctcccaccacgatcaggcgttctgctcaccacctggcgatcaatcgcacctccctcgtggccccgcgccgcctagtgttggtgtagcacccacatatcgtgatatttttatggggggaaaactctccccgggaactatgggccctttccccgatgtcgcccccccaagtggggggtcacacaaggctgttngaggacattgcgctcacccagtcccctgcccgtggcccacgatgggtgagcacgcataagaggcgcaagtagatgtctgtccaccccgcgatgtgtgtccccacttgttgcccccaccccccccccttgggaaagcggaggattctccccaagccttctttccttgtttttgttgttgttttataaagaacaaaacaaatataaatataaactttagcgttcgcggctatcgtgaaaaata

SEQ ID NO: 524884 - DNA, 589 bp, Homo sapiens
  misc_feature (279)..(279): n is a, c, g, or t
  misc_feature (446)..(446): n is a, c, g, or t
  misc_feature (487)..(488): n is a, c, g, or t
  misc_feature (490)..(490): n is a, c, g, or t
  misc_feature (495)..(496): n is a, c, g, or t
  misc_feature (500)..(500): n is a, c, g, or t
  misc_feature (503)..(504): n is a, c, g, or t
  misc_feature (508)..(508): n is a, c, g, or t
  misc_feature (510)..(510): n is a, c, g, or t
  misc_feature (571)..(571): n is a, c, g, or t
ttttgtcaacccaacctcgacctagggtaccctcatttgaaggacttccgaccataacatgttccagctgctcctccagataaagaaccgtgccccttcttgtgccccctttcgaatgggttgcatcaggccccccctgagctcccctgtggtgccacccacggtcacgctgcagcccgttatctataaataccccggccctgggcagagcgcccacggcgggtccatcctcggacccgagaacccgataattgccaaggacccttcctggatcatccngatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgnccaggaagaggttcattgaaataatcatgcatgaagcgccnnanatgcnncatntannattntncttgtctggcaggctcgttttacctcattctagaatatttaagaatctaaaaataaagggnaactctgaaaaaaaaaaa

SEQ ID NO: 524885 - DNA, 953 bp, Homo sapiens
agcggagtgggcggtgcgcgccgagacagtgctcgaagcgggcgccatccgagatcggcggtgtgtcctgatgcgccggatggcattgagtcgaacgattatagtggtcggagcgtatgcaggtgtcattcgttattccacacaaacagaaaatacagcttctgctacaatacatggcatccagatgcctaccgcattcatctgttccaggctatgttctaacagaaatagagtgttgatagatcactccaatttaaggcaatctgagaccgatgactgggacgtgaccactgtgacgggcctcttttgggagatgatgagcgatacatgccatcacgaagagagggatgaaaagagcgggagagctttggagattttacccttgggaaaagaaagaggttgcccttcgcaggagaaaaatacttacctttaccttttggcctagcggaaagtttcaccttagggaagaggggctccatgacttgagtaggtgaatcgttggtgtgctgaagggacttgaaggaatgtgattttaccctttatggatagagatgagggagaaggaattgtttaaggtgcggaagttctagtactaccccagataaggattttaacggagggtctagttggttagtgagtgttttcgaagggaaaggatgggtaagaagtagaattttttgaaggagaggcggaagttaggtggttggaatttggcgattagagcggctcgtggggtgcatacaattatcgcaggagaacctgtgcttcttgaatctgggtgtggcattgactttatacttcatttggaataccacttttgtcgaaccatgaagaaacattgtcccgaaagtggtaaataatgtggggtaccctggattaccctagaaattttatctgcttagaccacccttagatttgatgatttccgcttcatctctgttactatcctttag

SEQ ID NO: 524886 - DNA, 165 bp, Homo sapiens
cagacaatgatcttactgtatcatgaaaacacatattaacttagggaacgttacaaatagcatgtgagactggttccatggcctcttcagatctctaacttcaacatattaccacagacatactaaccagcagaaatgccttaccctcatgttcttgattcttag

SEQ ID NO: 524887 - DNA, 118 bp, Homo sapiens
gcacagctttcgaagcctgggctcactccattgatacctctgattctgatgacaaacgccaattggggttctgcaggtacatagaagtagccagcttttctggtacctggccgaatcc

SEQ ID NO: 524888 - DNA, 327 bp, Homo sapiens
  misc_feature (21)..(21): n is a, c, g, or t
  misc_feature (24)..(24): n is a, c, g, or t
  misc_feature (26)..(26): n is a, c, g, or t
  misc_feature (31)..(31): n is a, c, g, or t
  misc_feature (33)..(33): n is a, c, g, or t
  misc_feature (70)..(70): n is a, c, g, or t
  misc_feature (73)..(73): n is a, c, g, or t
gagagctttataaggattgtnctncntgttncnatcattaaaaggccgataaccggggctgagcgcagtngcntcacagcctgtaatcccagcactttgggaggctgaggcgggtggatcatgaggtcaagagatcaaccatcctggccaacatggtgaaaccccgtctctactaaaaatacagaaattagctgggcatggtggtgtgcgcgtgtaatcccaactactcgggaagctgaggcagaagaattgcttgaacctgggaggaggaggttgcagtgaaccgagatcgcgccactgccctccagcctgctgagagagcgagac

SEQ ID NO: 524889 - DNA, 207 bp, Homo sapiens
ctcaactaaacagcagagcagaacactagttctgatatctgtccatactctgtggccgtgataatattctttcatagccttctaaagatctaacttctggggggcaggcatggtgactcaagcttgtaatcccagcagttcgggaggcccatggtgggaggatcgcttgggcccaagagttcaagaccagcctgggcaatcaagctt

SEQ ID NO: 524890 - DNA, 137 bp, Homo sapiens
tctgcggtcgctctaacgctcccctacttttccacgggctctgcgtgtgctcctgggacatgcctggactgacctggctggctggaaggactgacctggactgggtgaccggactggatggactggctaccctacct

SEQ ID NO: 524891 - DNA, 223 bp, Homo sapiens
ggtgtttcctttgtctccatgtacattttactctttaatacttttatattattttagtgttgaggaaagaaatgagctatcaagccatgaagagagatggaggaaccgtaagtgcagattactatgtgtaagtgcagattactatgtgaaacaagccaatctgaaagactatatattgtgtaatttcaactatatgacattctggaaaagacaaagggaaaca

SEQ ID NO: 524892 - DNA, 187 bp, Homo sapiens
caggacctgagcttgtggagaccagaccagctggagatagaaccttcgagaactgggcagccgtggtggtaccttctggagaagagcagaatacacatgccatgtacagcatgaggggctgccgaagccctcaccctgagatgggagccgtcttcccagtccagggttcccatcctgggcattgctg

SEQ ID NO: 524893 - DNA, 718 bp, Homo sapiens
  misc_feature (32)..(32): n is a, c, g, or t
  misc_feature (111)..(111): n is a, c, g, or t
  misc_feature (210)..(210): n is a, c, g, or t
  misc_feature (535)..(535): n is a, c, g, or t
  misc_feature (554)..(554): n is a, c, g, or t
  misc_feature (567)..(567): n is a, c, g, or t
  misc_feature (582)..(582): n is a, c, g, or t
  misc_feature (590)..(590): n is a, c, g, or t
  misc_feature (599)..(600): n is a, c, g, or t
  misc_feature (602)..(602): n is a, c, g, or t
  misc_feature (609)..(610): n is a, c, g, or t
  misc_feature (625)..(625): n is a, c, g, or t
  misc_feature (687)..(687): n is a, c, g, or t
ttttcagacctaagttgactgccaataactgncactgcagacagttaaacctcaggtccgggaggactactgttgtctttcaggaattttctcctgaggggactggttgcngggtgggggggttgggcgggggggggagggccaggccagggtgtgttttcagggtctcagagtctaactcttattcctgcagggggaccaccctgactngggcaagggttaagaatagatcccaggccgggcttggtggctcttgcctgttatcccagcactttgagagttcaaggcaggaggttggcttgagtccaggagttcaagaccagcctgggcaaaaagtaagatccctgcccatccccatctcttcaaaaattaaaaacaatttgctgggggtggtggcactcacctttagtcccaaccactcggaaggctggagcaggggggtcgcttgagcccaggagtgtgtgccactgccctccagcctggttgacagcaagatcctgtctcaaaaaaaaaaaaaatttcccgggggttagcncttctggctcttgggccancagttttggcagnctgagagcagttttntgttttanaaaaaaacnnanccctgcnnttactggttgggggnggcttcacactgggggggggtgctgtgggcaaaagggatctcatatgctgtgggtggagcanaaacagcaagttgtgagaacagctaaagcta

SEQ ID NO: 524894 - DNA, 884 bp, Homo sapiens
aacagaaactagtccccggagcagtttctacgtcacaagagaaaagggaacggaaccgcctttcagtgggatctacctgaataacaaggaatcaggaatgtatcattgcgtgtgctgcgacagtccacgtcttcagatccttgtaggatatccagaaagaagtctgtagcatcataggatcaagaagtccttccacttcgagaggcaagtggcttacgatagtgaagtgtctgagaaaaagtactgctctggcactgggctgtgcctgtcgttttccgaggctcatggtgacgtctagtgcgtctgatgaaagaccacacaggggatcctgagacgtctggatacctcgtaaggatcagctcgcgacagaggttgtctgcaagcagtgtagaagctcatctaggtcacgtgtttcctgatggacctgggcccagatgtgtcagagcgtttagcatctaacaagtgtggcttaagaagttcaaacctaagggaaatcagctgaccatgctatcaaggagtcccgttcccttgtccgacgcccttcacgtgcagccctcaatattccacaattcacttggaatgacttgtgttaatacggcaactaagaacctggggctggaaacttgtggcaaaaaccatgaactaggatcacataacacacggcgggcaccacggcccattcaaaaaaatattcccccccgaagggggcccaggagcataaagccctttaccccgagtactttgtgaacgcaaacggtggtccccttaaaacagaggaccgcaatgaaacacaaaagaacaggggccgccgtttatacaaggcgccgggaatgcacacactgctcaccgggcactctcgcgcaccgaaccataaccacgactcg

SEQ ID NO: 524895 - DNA, 105 bp, Homo sapiens
gccaatgatcctgagtgacatgctgaacgccaaatactgaggtcatggtcgagcagaaccggaaggatgctgaagcctggtcaccagccgtactgaagaattgaa

SEQ ID NO: 524896 - DNA, 261 bp, Homo sapiens
ccctcaaaattggcccttttttttgtgagtttccctgcatcaagggccctgagaaaccccgtccttgttttaggtgttttatgggaggaagtgaataaagcctttaggaactttctgggcaagcttatggggctttttttgatttgggccccttccccccttcccgtcatgagtaatcatcaaggagcaagttggggtgtttccggggttttttttgtagaaccccaaaaattggggcctttcccataaacctccgcccta

SEQ ID NO: 524897 - DNA, 645 bp, Homo sapiens
tttatatgttattttatgcctcccaagtagttgggacacgaggcatgccccaccatgcccagttaatttttaaatttttatagagacaaggtctccccgattttgcccaggttgttctcaaagttctggctttaagtgatcctcatgtacaagcctcccaacaaagtggtgggttcacaggcatgagcctttgcgcccagccagttcttgcatgcttgaattgttaggcagcacacagtgacaaggagagctgagggagttcagggagcaaagataccaggcctgctgcttttgttttgttatggtagggtctacctgcacccctatctagcttcagatagattgatatggtatgtgtccccagccaaatctcatcttggattgtagttcccataatccccacgtgtcatgggagggacccagtgggaggtaattgaatcatggggatgattgctaacctcatggtgttcttgtgatagtgagttctcacaagatgtgatggttttataaggagcttttcccccttttgttctgcacttgttgccgctgccatgtgaaggacatgtttgcttccccgtgtgccatgattgtaagtttcgtgagtcctccccagccatgcggaactgtgagtcaattcaccctctt

SEQ ID NO: 524898 - DNA, 422 bp, Homo sapiens
ttgatgcctggctggagctggccctgggcaggaggagggaggaggagagcagcagggatctctggacaggacaagactccgaagctactcccccagcacacagcccgggacccacaaacccagctggcctggtataatacgcgtcactatacgggagcactccgtacgacagaaaagctggggtacgcgtaagcattgtgagacccatcgaaggggaactgctcataaagcgggcggcccataatgttggtagatgctaagtgggccacactagaaaacacacgatgagcgcgaaatttaaatgtaataaacaagcagaggaagacatacagggcacacacagctgacgaaagactgaacacctaggacaagccacagcacaagcccatactgccatgaggaacacggagaagacaggggaa

SEQ ID NO: 524899 - DNA, 100 bp, Homo sapiens
ctctagtaacccgcgaaatgatgggatagcgtgcaaatccttaaaagagtcttaacgaaatcctggctgacattgacttctccactgcaaccatcgagtt

SEQ ID NO: 524900 - DNA, 613 bp, Homo sapiens
taaagggaagtaagcctttatttccttgttttgcaaataaaactggctaagttggttgcttttgggtgattagtcaaagagaccaaactcccatatcctcgtccgacctccctccgactctttccttggcttcaacctttagctggggctgcagcagcagcaggagcagctgtggtggcagcagccacaggggcagcagccacaaaggcagatggatcagccaaaaaggccttgacctttttcacgcaagtctgggaaggtgtaactccgtcctccacagacaaggccaggacctcgtttgtccccgtgtgatgactaaaatggggctactgattgcacccagctgtgggtacgccaatctcttgcacgacagacacgtggcaacatttgcgggacaccctctccaggaagcgagaaactgcagagttccccctctggtgatataacagcacttcagggcttgtaagatgctgccattgtcgaacacctgctggatgaccagcccaagggagaaagggggcagcatgttgacgcttgttcagcagcgtggcttcgctggcccccctttgtctccccgtcttgatcagctgccatcactccggattccaatggc

SEQ ID NO: 524901 - DNA, 139 bp, Homo sapiens
  misc_feature (107)..(107): n is a, c, g, or t
gaacgtactatcctccttacttttgggtcgggccctccgggaagatggcggccgtgcaggcggccgaggtgaaagtggatgtctctgatccgaggctgtgcaagaangagctgaagagacgcctgttatctgagaagaa

SEQ ID NO: 524902 - DNA, 626 bp, Homo sapiens
  misc_feature (560)..(560): n is a, c, g, or t
  misc_feature (565)..(565): n is a, c, g, or t
  misc_feature (589)..(589): n is a, c, g, or t
gctcgtaacctgaacggtggcacctgccgtcctcggccgcagtcagaggcatcacgttgctgaagccgctatcctgcacgagtatccggcgcgcgtcttccaccgacaatgcctgggagcatagtgtggagatggtcgggaggaacaagccgcgggggcgggaagaaacgtccaggagatcagtatccagcgggtgtgtgccagcgtagcaacatacacgttggacttatagacgcactacaactgtacccaacaggataccctggcgaatgaaactgtgctgaacgaagagttccaccgcacaagagtgaggctttgtgtgcaacgggactaggatcacttggggctttggtagagcgcgaaatattcccctgacggcatggcatgcgtagatgccacaatcaaagatcagtgttgacaggacgtgggtatcgtgtgtgatgagacgaaggacgctgagatgtaacgctgaggatgtgtattgaaacgcaattgaccggatgtgtgacctctgtggttgtaactagattgcgagagtagccagctaaccataggttggnttctntccgacagggtatgcactttgganaccattacagaccattctagagctaccctccctgttg

SEQ ID NO: 524903 - DNA, 355 bp, Homo sapiens
  misc_feature (86)..(86): n is a, c, g, or t
ctcactcaggtgtgagtctctgagagagtctgaacacagtcagagcagggaagctcaccttggtcaagcatgtcacagatgctcgntaggctttcttgcattggttcctatgcctggggaggtggtgttaagggacaggtgttctgctgttggggaagtcccacctgctgcctccactggagaaagtgactcctctctgctgggtgacagtgagggggagcccctaagtcccaggcaatgtggcttgcagctcattcctgtccttagagacactgcctggggccttgctcagttgaactgtgcccctcgcctgctgcagagacaaggccaggcttctttttccctctggaacccc

SEQ ID NO: 524904 - DNA, 325 bp, Homo sapiens
caaaaatgtgcaaaggactacagaattgttcaagaagcagtgatccagtgcttggctagttaattcctgagtaagccactctgaaaactgattataatcctgtttcaaatggaggattggggagagggccaataaaggggtatattattgttatcttggtgaggagggaggaatcccgccagttattcactggagttatgggcgccagagccttccctctctaatgttattgtaaataattgttgagagtagagagccagctcagcaaagtgagactccagcattgcagttcctctccacgggggtcttatatacgagccctcca

SEQ ID NO: 524905 - DNA, 284 bp, Homo sapiens
  misc_feature (132)..(132): n is a, c, g, or t
aggagagctcctgatggtgatgaatctgtcttctgaaggcggagtgcacagggccttctctctggatgccaggtcacacagtcacttagacactgtctctggtggtcccagacagcgcacagtgcagtacgngcacgcagctacacaggtgtagggggatgcgaagcacagacagcacagaagtggcgctggggccgccgatgggggggtcccggcacatggccggtcaggtaagttagggccctcggccacactcaagttctgctcctccaacaagcgcctgg

SEQ ID NO: 524906 - DNA, 381 bp, Homo sapiens
gatccagcgcgagcatcatcaacagataagaaaaacatgtgtatcacaaatactattcagtcgtgaaaaagaatgaaatctgtgtcattggtagcaacatggatgaaactgggaacattatgttaagtgaaataagtcagacacagaaagataaatactgcatgttttcgttcatatgtgggagctaataaagttcatctcatacaagtagagagtagaagagtggttactataggtagggaagggtagaaaagaggggatagggagaggctggtaaatggagacaaaatcatagctagataggaggactaagttctagtgttctacagcactgtagagtgattaccgttaacaataattcttgatggaagcgtcgcgcat

SEQ ID NO: 524907 - DNA, 341 bp, Homo sapiens
ttcttcccccaacactttttggggcttttcggaatgccccgacgtttctcgggtttccccgtgcgattccccccctggaacctcctattatctggggggtcattcatttctctaacagccgtaatattaataattttcatggtttgagaagccttcgctttgaagcgaaaagtcctaatagtagaagggcccccccttaacctgggggggctatttgggtgccccccccccttccccccctttggaggacccggttacattaaattttggccaaaaagggagggatcggacccccccaaggtgggttccagccccccccctggcccccctggctttttcca

SEQ ID NO: 524908 - DNA, 250 bp, Homo sapiens
  misc_feature (70)..(70): n is a, c, g, or t
  misc_feature (79)..(79): n is a, c, g, or t
  misc_feature (152)..(152): n is a, c, g, or t
  misc_feature (160)..(160): n is a, c, g, or t
  misc_feature (178)..(178): n is a, c, g, or t
  misc_feature (188)..(188): n is a, c, g, or t
  misc_feature (219)..(219): n is a, c, g, or t
acgggcggagagggctaccatggggaaaatcgcgctgcaactcaaagccacgctggagaacatcaccaanctccgcccntgggcgaaggacttccggtggtacctgaagatgaaatgtggcaacggtggtgagatttcggacagttggcatnacatcctnctgatggacagtttgtcnctgaagtggngccggttgcattggcttccatggtccagatnttcaagctctttgcaagttaaattttccatt

SEQ ID NO: 524909 - DNA, 253 bp, Homo sapiens
ggttctagaagcggaaaagcaggaacactttaagtctccagaaggaatgcagccctgccgacacttgactttagccttaatagacctagtctgggtttctggcccctagaactgtaagatggtagatttgtggtgttttaagccactaaatatgggaaactgcaaactatattgcagcagcaagaagaaatgaacatgaagccaggcatgatggctcatgccagtaatcccagcactttaggaatttaggcag

SEQ ID NO: 524910 - DNA, 475 bp, Homo sapiens
  misc_feature (1)..(1): n is a, c, g, or t
ngccgtcataattgaattgtgagcatgtaacgtggctcatagtatctccaggtctgtagagtctctaggttgaagactcgcagcactgaaggtctctaggtcaagcacacgtgcgtcacagggaacatccagtggctatggaatcaagcgcaaatcacaacagaaggaatgctcaagaatggagtctaatcaggaggatgacactgggcctagactaggcgaaagcatgcaggttgctagcgggatcgggacgcgttccagaaccctcgtgctcaatgatgaactcggataacgataggtgctgaggcgtagcacaacacaaagccagcgcgagcggacagacactggtagtcgccgggatcagggaccgcgggcgctcacataatcacggcacctgagaacgtccttgtaacggtccttgacggcgtggtacatgtgcagtaactgcaggatctcgtacagccgcacgtggtcg

SEQ ID NO: 524911 - DNA, 112 bp, Homo sapiens
gggtgcatgcatgtgtgtcggtgtgtagtggtgtgttaccacatggagtcatcagagatttgttccacactttgtatcctggaaaaccgaaaggaattttcttttcttcgag

SEQ ID NO: 524912 - DNA, 190 bp, Homo sapiens
tcctcatgagcttcctaaagcccaggcgagggaagagacccatgcattctcgttctgtctcatattatcagtggtcactgtttagacagagaagtctcagacgcagcgaataaagtgcttactcatttggcaattgtcccagtgagttatataaataagtgaaaccatcagagcgttaacacatatggcg

SEQ ID NO: 524913 - DNA, 141 bp, Homo sapiens
ttatcactccgtccttttcacggttcactcctacttattacttttttatgcagcattttctattgtggtataatacacataaccaaaaaatttaccacctacaacttatacttttcttttttaccagtcagggtcttattc

SEQ ID NO: 524914 - DNA, 497 bp, Homo sapiens
gcggcctactactaccaaattcgcggccggtacgacaagagaagaagcaggaggttcctgcagggcgagaaacccttaccaaaaagcgaaggaatttccgcagagctgaagcactccagcgcctgacaaagaagtttgcccaaaagacgcttcgacaggcaaggagcaagcttatctctgaaaaagcaaagcaccatcacaaggaacccaggcagatgtacagaactcaaattcgaatgccgaggatcgccagaaaagctggcaacttctacgtacctgcagaacccaaattggcgtttgtcctcagaatcacaggtatcaatgcagtgagcccacaggttccaccggtgttgcagcttcttcgccttcgtcaaaccttcaatggaacctttctgcagctcaaccacgcttcgcttaacatgctgccgcttgtacagacatatatcgcatcggggtcccccaaatctgacgtcagtaaatggaactactctacaagc

SEQ ID NO: 524915 - DNA, 310 bp, Homo sapiens
  misc_feature (92)..(92): n is a, c, g, or t
ccctcccccaggttaaggcctttgggcccccaggaaaaaggaaaaaaaagccagccccttctgggtcaggggtgccgggaccccgtgatggnttttgggcctttcctaaggggcccgggaagaattaaaaattttggtccccggggccccagccccgtttgtttccaggggcaggggcagttttgttttttaaggggttttgggggccccccagcccaggttttgttttccctggaaagggttggtgccttttgccgggggctttttattttggggttttttttggggaattaaattttaaatccccgga

SEQ ID NO: 524916 - DNA, 476 bp, Homo sapiens
gtggtgcttgcaatgtacatagccccagatatatagaatcagaatctgtaagagtggggacttaggaatctatgttttaacaagctcctcagggaatttttataaacactgcaatttgaagatcacaggtaagaaataaaaacagttcaggggagaagtgcaatatacactatgaacaccagctgtcagtactctacaatttaaaaatgcccttgatggttaatagtgaaaagaattattacaagaacattttctaaatttgaaatgtaaagatctagggaacatgagctctaagttaaacagatttgaattatcctgtgattttatcaaagatctctagacatataaatagtttacagagagtagtggttggagatttagagattttgggtacgtgtgagtaagtccatgtcagaataatgtcttactatacttgggaaaataaagtgaatgcttttgtggttttaaaaccaaaa

SEQ ID NO: 524917 - DNA, 137 bp, Homo sapiens
  misc_feature (9)..(9): n is a, c, g, or t
  misc_feature (44)..(44): n is a, c, g, or t
  misc_feature (99)..(99): n is a, c, g, or t
  misc_feature (108)..(108): n is a, c, g, or t
atgtatctntggtcccagctacaggggagactgaggcaggaggntcccctgagcccaggaggttgaggctcactgaatcatgatggtgccactgcactnctgcctggntctcagagtgaggtgagaccctgtttcat

SEQ ID NO: 524918 - DNA, 953 bp, Homo sapiens
ggagcttccaggtctctgggtcgccagcgcgcgggcggcgcggtggagccggcgccgggcatggcatcgggggcctggagtgcgcggccggcagcaggccgcccatggagccaggcagcgtgcagaacctgtccatcgtgtaccggagccgcgattcctggtggtcaaacggaggcagctgggagcgttcgcatctgacgagcgaaggcgtggccgggagacttcttgacctcgtgcgagaaggcacgcgtgcgggtcccgggttttccccgaggctggccgacccttgacaccgtgcgtaccgggttcagggttcgtgccaaccaggcgtggatttctccacgcaggtggggcgcctgtgcggtgggccctaaaacgagggggccaggcgcctgggaaggggcgtacggggtggcttcagtggagcaggcgcggtgacccagaggctttacccctggcgatttgctgcgggggggccaccatcccaagggaagaagccgtggagtaaaccaatcaagccattgcctattgtcaagggaaccacgcagctgggaggtggcccggggccccaccgacccattgttgcttcggagggccttcggcaggggttgttagtgaaccccaaaaaggccaaggcctcaacgaagaatctcgggtgggttccgtggcacccccgggcttggtaccgcaaggcgatcttgtcttcgataggtcgttggttgaagccggttcacggggggggggacacaccatgttgcgcggtgcacttggagtgccctgggccacccggtggtgtgggcgacttgcctaaggggaaacattcgggctgggaagccggccgcagaatgagcgacggctctaacggcgttccaggggccgggtgttggggtagacctggacctctggccctggtctgtggcccccatttgtattgccctctgactttggcccaa

SEQ ID NO: 524919 - DNA, 185 bp, Homo sapiens
agggaaaaattaaaaatttcccccatttattttttggaactaaatcaagccttaactataaccttatgagaggaatgggaacccctgctggctttaagtaaataaaaggccttgttttccccaggggataaaaatcaaaggggaacccttttttttaataaaaattttcccttttattgcttcca

SEQ ID NO: 524920 - DNA, 225 bp, Homo sapiens
gggcgtcggccatgcggatgatggccgcggcaatggcggcattctcggcatcttccggcaagccgctgacaaaagatgcatcaagcttcagtagcccgacacgaatgtttttcaggctggcgagcgatgaatagcccgtgccgaaatcatcgattgccagatgaatgccagcatcggtgaaatcatgcagatgagttagggctggggccaaggtaccctggtcac

SEQ ID NO: 524921 - DNA, 378 bp, Homo sapiens
ctgccacagactcccaggctcctacgacagcacatcctcagatagtttgtatccaaggggcatccagttcaaacggccttgtgagtacaaggagggtcccctaccttgggtgccagggagagggtcccctggtgtgggagtgagcgtgaaccttcagacttcccctgccaccttggggctgcccacatgcccttgacctgagctgggagaggggagatggctcccccaggcctgtccagggtgtggggctttcaggggcttagtctgttctttgaggccttgacgatgtccggagtccttctttcaacttggttctgtgtcctcagacacggttgccccctggccacctgcctacccacctatcacaccccatcctga

SEQ ID NO: 524922 - DNA, 167 bp, Homo sapiens
  misc_feature (5)..(5): n is a, c, g, or t
acttntctggtctctgcgtccttggtaggtcttgatgatctcctccttcttggcctgtggcgctcttcacggtgctggcgtgcttccttggtcttagccctgcgggcctcagcctggtcggccaggcgcttcttgcgggccttctctgcggggttacggagctcgaa

SEQ ID NO: 524923 - DNA, 288 bp, Homo sapiens
gtcttcccttgagcacttgctcttcttccccagcctgtttatcttctactgccagctcttcaaagaacgttttactgatcttcttgtccttcttccctttcttcaccactttgctctgatgggctcgtgctctctccgctccccgtatcactcgcggctccgcgcggctcgctgcttggcgcgcctatcgtgcactcgcggtaggcagtgcacacgcttacctttaccgggagatcctactaggagtacgacctagcagcgcttagcaagcttgagcactaggccgta

SEQ ID NO: 524924 - DNA, 652 bp, Homo sapiens
ccgcgaattcggccattatggccgggagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcataaagaggcaggagaatcactagaagctgccaggcagaggtttgagtgagctgagattgtgccagcgccatcctgtgcaacaagagtgaaactctgcttaaacatataaggccaagccattttccccattaaacatgtatttaggacatacgtagcccatacttacattaagggttcttttgcttgatcgatgctctttcgtccg

SEQ ID NO: 524925 - DNA, 307 bp, Homo sapiens
  misc_feature (280)..(280): n is a, c, g, or t
  misc_feature (302)..(302): n is a, c, g, or t
ttcagtgtcatgatcatggctcactgcagcctcgacttcccagactgagatcatggctcacagcagcctcaacttcccagactcaggtctggtgatgataaactccctcagcttttgtttgtctgggaaagccattatctcttctttgtttctgaagcacagtttgccagggtacagtattcttgtttgggcaaatttttcacgttcagcactttaaatatatcatcccactctttcctggggcctgtaattgggaactccttatctgttatatggcttncttttctcttggcttttcaaanttctc

SEQ ID NO: 524926 - DNA, 835 bp, Homo sapiens
  misc_feature (24)..(24): n is a, c, g, or t
  misc_feature (132)..(132): n is a, c, g, or t
  misc_feature (284)..(284): n is a, c, g, or t
  misc_feature (345)..(345): n is a, c, g, or t
  misc_feature (354)..(354): n is a, c, g, or t
  misc_feature (356)..(356): n is a, c, g, or t
  misc_feature (367)..(367): n is a, c, g, or t
  misc_feature (373)..(373): n is a, c, g, or t
  misc_feature (388)..(388): n is a, c, g, or t
ggccccctgctgcaggaggacccnttggccctgccccctgctgaggtccttccctctcctccccatggagataggggccatccccaaattggataatgggggtatgtgtgtgcttcctgaggggcctggtgnccctggagaggaacgggggaaggaggaaggggcaaggagaccgacggggtgagaggtccacacagcacaagaacaggggacatggccagctagcagaaggcacagtctgtgccaagcctggagaggcaggtgcagtacatacaggcggaganactgagctctaggcccttaaatactcgcctgtgcccgccccctgcacacggcctggtacangcaggcgtngngtacatgggangcaaanacagacagggtgcgntcaggcagcagggccagggcggctgggttaactcagttgtgccacgggagaaaacggggtggtgggttcctcccctctcccggggacggggggcactgcagttttggggccctgagtaactacagcccagaagcgacctcccagttcctccgcatccccagagacggaacgatgcccccaaagaccagccccgccccccccacccccgccaaagcgtggccacagaaggccgagggacgcggcgggcgctgctcgaggagcctccgggctgagaggggcggggcgtgcgcgggggaggggccgggacgccgctataaaggcgcagctcggggccccgctccggcccgggacgcacatgtgcgcgcgacgcccggcagctgccaccgcggggcgcagccgagaccccgcgcctcgccccggccggcccgcgaggcccgcggcggccgc

SEQ ID NO: 524927 - DNA, 149 bp, Homo sapiens
  misc_feature (135)..(136): n is a, c, g, or t
ggctggcgcgcatcgctaggcacgaggcactcagaggaggcgcatgtcagaaccggctgggaattccgtcagaaccatgcggcagcaaggctgccgcgctcttcggcccagtggacagcgagcagctgagccgcnngactgtgactgcg

SEQ ID NO: 524928 - DNA, 216 bp, Homo sapiens
caccgattcctaattacgcaactcataacttaatggggcattaatcatgtcagtatttagaaacatatgcaggccttgttttgcttcttgaaatggcctcatccgcaccgatcccctccttctccaccacttgattagtatttagcgctttgctatacattcgagttgcattgttgcgcgccggaatctagggtgtcgtgtatccatcgtacatgg

SEQ ID NO: 524929 - DNA, 250 bp, Homo sapiens
tgacttagaggaccccacgcgcaccgggttcaaaacgaggcagctgtaacactgtaggtaagagatgataaaggcctgagctggggtgtgatggtgggatggagtttcggtgaggtaaattcagtaggacatagtaacttggctggctagctggagtgagagaaaatggttcaaattatattctctgagggatctcgcttggctgcactcgagattctataagcactaatattgagaatacatgaatgta

SEQ ID NO: 524930 - DNA, 234 bp, Homo sapiens
gcggcggaggtacttagctcactcgggccccaggcacctgggaggccggaggaggaaggcaggcattttaggccgcttgtttgttggaggacttgcttgaggattgcaggttggaatgaagcccctttccagggaggacaaaattggaccttaccaaagagagggcaaaagagccctcccacccccttttagggcacccccgagagaaaaaaggttcccctttcaaattcagag

SEQ ID NO: 524931 - DNA, 437 bp, Homo sapiens
tgtatttcaaaggttcattttacaattgtatccttactctttggatcttataagcagtccacttttccaacagtgtgaagccccaggtttctagcatctttctcttgctttgtcatttctctggcgaactggcccgttcatcctagggctcacctcttgtgataccttgccaaagacagctaatagcaattaaaacccacgattaaccttcagttttccagtctcctccccttgagcacaaatctctcaggtaatctaaagatctgcctctcaaatattttgtgatgatttgccatctatacaaaaagatcattttctttatcactcaccatgtaggaatattgttctaggtaggaatattgttgccagattattttttactttttttaacttttattttaggtttgggggacagtacccaaggtttgtcacatagg

SEQ ID NO: 524932 - DNA, 290 bp, Homo sapiens
gagatggagtttcactctgtcgcacaaggctggggtgcaatggtgcaatcttgcctcactgcaacctccacctcctggattgaagcaattctcctgcctcagcctcccgagtagctgggattacaggcatctgctgccatgcccagctaatttttgtatttttagtagagacaaagttttaccatgttggccaggctagtcttgaactcctgacctcaggtgagccacctcacctggcccaacctcacttcttgacccctcactccccgctacccttctgtcgtcttctc

SEQ ID NO: 524933 - DNA, 200 bp, Homo sapiens
  misc_feature (13)..(13): n is a, c, g, or t
gcgtcgacgtganagacagtctgttgtcaccagtggaatgaatcaaaagcatttcaggtttcttctagcaggtggcagaaactggtactacaacacctgtgtaaccagacactaaatctacatttttttcatttagcagacactcttatccagagctacttacaggagcaattagggttaagtgccttgctcgtcgacgc

SEQ ID NO: 524934 - DNA, 108 bp, Homo sapiens
ggtcctgcctggtggttgagtttgataagctgcctctctgctttgagaaggcagtagggcctcccctaactgcaaggggaatgtgcttggattagggagggttattgc

SEQ ID NO: 524935 - DNA, 506 bp, Homo sapiens
gagtgtgagtgtcaccgtagctgctgtcacttaagctctcatttgcccaccattgtgactgttaaaaacgaatgataaagttgttactgataggtttttcgctggttcggaggcgggtgtgtggctctccctcacttgcaaaatgaatgaatacttttcgggtcaaggttagagtgaacatgacagtccccttatgctgccccctttggcactgcgctctagggacacagggaactaacttccagcctgttatctgcctgttaaaaggttcttgcttgtgaatctcactttgatgtgtgtgtctgagccgggtgctccgtccggctattgtttgctgacatggagccagatctgccgatggattcttgtttattttcttctcctgatgctcatctcatcgatggagatttgagcttctcgcctggcctctggcatggagcctgtgttccccgttgcttgccaatgttcatgcttcaactggtcatttgcaagctgaagtgtgcaga

SEQ ID NO: 524936 - DNA, 266 bp, Homo sapiens
agctacagctcgcatgagcagtgctcctatgtgggggaagtagtccgggccatggataagaagaaagtgttggtcaaggctacatccttgaaggtaaatttgtctagtacagcgtggacaaaaaacattgacatcaattgatgtgacaccacaattgccggtattgctctaagtcaatgatagctaacactctgcacaatgatcctgtcccaatcaatggtatatcccatctttattagcgagctatgcttgagcttaatgcagaa

SEQ ID NO: 524937 - DNA, 707 bp, Homo sapiens
  misc_feature (20)..(20): n is a, c, g, or t
  misc_feature (82)..(82): n is a, c, g, or t
  misc_feature (93)..(93): n is a, c, g, or t
  misc_feature (301)..(302): n is a, c, g, or t
  misc_feature (339)..(339): n is a, c, g, or t
  misc_feature (392)..(392): n is a, c, g, or t
  misc_feature (401)..(401): n is a, c, g, or t
  misc_feature (635)..(635): n is a, c, g, or t
  misc_feature (649)..(649): n is a, c, g, or t
  misc_feature (704)..(704): n is a, c, g, or t
gcgcggccaggtagggcccnagcttcagctgccagcatgcttctctggaacctcaaggcaggcagcccaggccctgggcctnatctctaaccnccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagcatgccggccgctggggactgggcccnnctcgcatgcctccccgccctccccccacctccacgantatttattgagcgcctgttgtgtgtcacggggctatgagggccgtggggtgtntgggtggantatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtccccgggcactgtcgcgcttgctgcangcggcccagccgtntatttatttttcacctatctccttcctgtcaaggcaggccgggctccagggctcncct

SEQ ID NO: 524938 - DNA, 687 bp, Homo sapiens
  misc_feature (12)..(12): n is a, c, g, or t
  misc_feature (16)..(16): n is a, c, g, or t
  misc_feature (20)..(20): n is a, c, g, or t
  misc_feature (31)..(32): n is a, c, g, or t
  misc_feature (43)..(43): n is a, c, g, or t
  misc_feature (47)..(47): n is a, c, g, or t
  misc_feature (49)..(49): n is a, c, g, or t
  misc_feature (63)..(63): n is a, c, g, or t
  misc_feature (65)..(66): n is a, c, g, or t
  misc_feature (73)..(73): n is a, c, g, or t
  misc_feature (76)..(76): n is a, c, g, or t
  misc_feature (79)..(79): n is a, c, g, or t
  misc_feature (91)..(91): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (117)..(117): n is a, c, g, or t
  misc_feature (129)..(129): n is a, c, g, or t
  misc_feature (135)..(135): n is a, c, g, or t
  misc_feature (235)..(235): n is a, c, g, or t
  misc_feature (247)..(247): n is a, c, g, or t
  misc_feature (254)..(254): n is a, c, g, or t
  misc_feature (256)..(256): n is a, c, g, or t
  misc_feature (258)..(258): n is a, c, g, or t
  misc_feature (273)..(273): n is a, c, g, or t
  misc_feature (275)..(276): n is a, c, g, or t
  misc_feature (281)..(281): n is a, c, g, or t
  misc_feature (289)..(289): n is a, c, g, or t
  misc_feature (293)..(293): n is a, c, g, or t
  misc_feature (306)..(306): n is a, c, g, or t
  misc_feature (351)..(351): n is a, c, g, or t
  misc_feature (358)..(358): n is a, c, g, or t
  misc_feature (364)..(364): n is a, c, g, or t
  misc_feature (371)..(371): n is a, c, g, or t
  misc_feature (379)..(379): n is a, c, g, or t
  misc_feature (399)..(400): n is a, c, g, or t
  misc_feature (409)..(409): n is a, c, g, or t
  misc_feature (427)..(427): n is a, c, g, or t
  misc_feature (458)..(458): n is a, c, g, or t
  misc_feature (460)..(460): n is a, c, g, or t
  misc_feature (481)..(481): n is a, c, g, or t
  misc_feature (484)..(484): n is a, c, g, or t
  misc_feature (487)..(487): n is a, c, g, or t
  misc_feature (491)..(493): n is a, c, g, or t
  misc_feature (506)..(506): n is a, c, g, or t
  misc_feature (524)..(525): n is a, c, g, or t
  misc_feature (543)..(543): n is a, c, g, or t
  misc_feature (601)..(601): n is a, c, g, or t
  misc_feature (610)..(610): n is a, c, g, or t
  misc_feature (616)..(616): n is a, c, g, or t
  misc_feature (630)..(630): n is a, c, g, or t
  misc_feature (655)..(655): n is a, c, g, or t
tcgaggcttcanttcntatntaagctcatgnnacgaaagtagngtgnanaagacaggctctgnanntccctgncanacnagcagctctgcnatttacacgctgtnanacntcaattnagcgagtttctnaacctntgtgggcttcagtaaaagagcgataatccttcacatcagcacttaagagaatgcccggcatagtataaggtcatcatgtttgctttacaggtagcccttngcaaggatctcntaagggncncntgaatattcagtaancnnaaggnagctcagnactnagccttagctacnctcaagaccgtgacagttaagacacagaatggtcagcacatgtgnatgacantaacantggctgntagagacntctcggctggagccaaatgnnagactgganagcatgaatgaatgcggnagtaagatgaggcattgcagtgagagcaccngncacagcactgattacagcacntgnctngctnnngtcagtgtgatcntcacagcttatgccagcnntggaagagcttatccaanagaggggcctccccaaaccaggttgtacacggccaacgaaacccccttctgacagganatacatccngggtgnagggggctggtcanctgaatcccagcgacggtatggccnttgccctcacgagttactttacactaacccgt

SEQ ID NO: 524939 - DNA, 882 bp, Homo sapiens
  misc_feature (630)..(630): n is a, c, g, or t
  misc_feature (638)..(638): n is a, c, g, or t
aaccacccctattcctaatcccccgactacagatagaggagaaaacggcatctaatctggaggttggtatcccagaacactatattaaagatcccctacaggaacagatgggcactctggttttttaaaaatgataaaagcaaggattaacttggcaagcggatctgacggatgatctgcaagttagatactgtagaagatttttgggctcttgttacaatcgatatccagttgtctaggtaatgtaatgcgtggatgtgactactcactattatgtaaggatggttgattgagcctatgtgggaagatgagaaaaacaaacggagaggacgatggttaattatattgaagaaaagagagagacgaagtgagtctcgaatcgcttaggcgtagagacagtttcatgattagccgtctatgggagaatctatttgatgacctacagatgattgatgtatgtggagctagttgtaaatgttagagcctagaggtgataagatagcaatatggattacatgaagtgtgaagacagagaatgctgtaacacgtatagggagtggtatacaaggacaggttaggaatacctcgtgaagatagtagaattggtataactcatgtccggattgcagnacacctgnctaactataagatgcagggctcgagcacattagaagtaggtctgttggtttatgaagatcaccttctggagtattctccagtaggtggacttggcgttacagcaatcgaagaatttgggaagcttgaaacccaaagtcttttcataaaagcagaaggggcatgctcttcaggttttgaattccatccttaatggtctccgatttaaaacatctgccacgccttggactggtcccctggggtcca

SEQ ID NO: 524940 - DNA, 977 bp, Homo sapiens
agcgggagcagaccccgaccggcgaggaggagtggagggccgccagtggtcgacattgctgttggaggaggttcgcgccggcgaccggctgagctggggcgcgtgcgcccggggcgacgctgctcggatgcgtgcgtgccgccgttcgtgcgagccgggacgctggtgcttcccgatcgccctcaacccgcttcggctcagacggggctgcaggtcactgagtgtctggcagtctagccgccattcgccctgagatgcttgctgaagctggaggtgcgcatgccccgatagtgtcctacggtacacctccgcgtaccacgtccacgttccatagacgcacgacccgtcatctgtgattcctgagacatccctgcaaggtcctagtggacgcacggtggtctgatgtcaacgttgcctgactggcacacggggtcactttccacagtccatcgtggcaggttcagagaggtgtctactactgtctgtgtgtcagctttcatggtcagcgtgaatctgatctccagtctgcatgggacgccatgggtgtctcacatcccttgtgagctggcgactggagagaggggctcaggtacctcgctgtgacattcctgcatggccacgatgttggccccgctgtgatctggggtcagcctcttcaggcaatgagaaccccgttggggttctgtatcaggaatgagaggggaacgacatacactttactctatctcggtatctcctggccactgactgcagttaggggagggagcacagattgtggcttactggtgctgggttggggcctgtgagtgtggggggacgtttctccatgggtgattcctcactccttttggtgtgttcggacaagatgaaggggtcctgcaggacactagccactaaacgggtcggttctttctgcgcctaaggttgtggggcctggaagagaaccagggaaaacatttagagtgaatcagaactcc

SEQ ID NO: 524941 - DNA, 319 bp, Homo sapiens
gtcttctaaaaatggacagatgaagccagtgcaatggctcatacctgtaatcccagcactttgggaggcagaggcaggaggagcacttgacccccgaaatttgagactagcctgggcaacagggttagaaaccatttctacaaaagaaaaacaattagcctggtgtggtggtgcatacccttggccccagctacttgagaggccaaggtggaaggattgcttgagcctaggtggctgcacgtgcggctgtgatcacacaactgcactccagcctgggcaacagagccagatcctataaatgagaaaaagaaaagaaaag

SEQ ID NO: 524942 - DNA, 473 bp, Homo sapiens
  misc_feature (38)..(38): n is a, c, g, or t
  misc_feature (357)..(357): n is a, c, g, or t
  misc_feature (364)..(364): n is a, c, g, or t
  misc_feature (445)..(445): n is a, c, g, or t
tgcagctggatcagatgtaccgtaagcagctgtcgctnaggcacccgcgtgtggatggagggaatgtggtatcatctgaaagcttagaaatgccaggatctgcagagcccccaaaaagggtgttacagcgtgtcacagccctggcttgaggagccctgaggtctgggctcccagtagggccacagctcttctttctttctcgtcacctgcagtgtggcgagtgagggggtgagtttctggagggcagtttcagcccatttgtgttacagctctttcagtcctgccatcccgctccagctggcaactcctgggctggcccggccctgtttgctttttcccatcccatggggtggctanctgggtngaagggcaggagggctgtagtttttacggaagctctggcttttgggaaccccaaggttttggggcccccagaaaatttcancatttttcaattttcacaattttgggag

SEQ ID NO: 524943 - DNA, 389 bp, Homo sapiens
cttcaccatcatgtgatgcacgactgtgagtgtatgcactcgtttgtagctgtacgcgtctgtattatctgaacttaagattacaacccctgctttttcctgatttccattttcttcatagataagcctccatccctttatttcgagcctatgcgtgtcattgcatgtgagatgggtgtcttaaagacagcatactgtcgggttttgctgtattatctgcttgccactccatgccttttaaatggagcatttagcccatttacattcaaggttagtatggatatgtgtgaatttgatcatcgttagctggttatcatgctgacttgttcatgtagttactttatagtgtcactggtctatgtgtttacgtgtgtatcggtatcggctgg

SEQ ID NO: 524944 - DNA, 547 bp, Homo sapiens
  misc_feature (19)..(19): n is a, c, g, or t
aaggaaaagtttatttttnatttctcatattttgtttttttaagtacaatgtaaaaaagaatagtaatattagaataggaaggaggaatggttcgttggggagcttatttagcatactgggagcatatagagatttatctatgtttgttgaacttagagttattttcatgcttttctttataattcacacatatatgtagagaagatatgttcttgttaatattgtatataatatagttttaaatatagtaagatctatactagataatcttagatgaaatgttagagatgctatatgatataactgtggttatgactgaggaaaggagcttatgttagagactgggctgctcttttggaggttaaatttaagaaggtttggtaaagttaggcttagggagactctgtcttgctgtagactttggtgtggatatatgctgtatagagctttctttgaaaatagaggggttttaagacattctgcttacttattagcttttttttatttttttaactttttagggggaaataaaaagacaagcctcca

SEQ ID NO: 524945 - DNA, 164 bp, Homo sapiens
aggatacaaagaaagagaatgcctgaggatggagataaaaccccgaaagaagtaaaggaagaaaggagctctaggaaagaagagcatggagaagcacacatgcgctcccctgattgaaaaagggaactgaataacacatctgcgttgtgcgctcatgacatgtc

SEQ ID NO: 524946 - DNA, 240 bp, Homo sapiens
gggacgcttcgtcaccataatacatttggttttgtccaaaataagctgccaagccaattgccccaaggccaatggcatgccttttcttggttacccttggcaattgatgggaccacatcccaagtttgaacgtattcagaaaacaaacgtcaaggcacgtaccatcgtattcatacagatgtttccaaattcaggcgttgcatgcatgttcacaatgttgattggtcccaagttacagct

SEQ ID NO: 524947 - DNA, 602 bp, Homo sapiens
cccaaaaccatcttccccaatctttttggcaccagggactggtttcgtggaagacaatttttccacggacaggggaagatggttttgggatgaaactgttccacctcagatcatcaggcattagttagattctcataaggagcaggcaacctagatccctcacaagcgcagtttacaacagagtttgtgctcctatgcgaatccaacgctgctgctgttctgacagaaggcagagctcaggcagtaatgctcacctcctgctgtgccacccagttcctaacaggccccagataatactggtctgcagcccaggggttggggacgcctgctttaaaatactgtaagttactacagacgggatttcactaagaaataaaaaatatggaaaaaatataaaaagatgccaggcacagtggctcacgtctaatcccagcactttgggaggctgaggcaggcagatcacaaggtcaggagattgagaccatcctggctaacacagtgaaaccccatgtctactaaaaatacaaaaaattagctgggcatggtggcgggcgcctgtagtcccagctactcgggaggctgaggcaggacaatggtgtgaa

SEQ ID NO: 524948 - DNA, 343 bp, Homo sapiens
actacatacttccgtattagtaatgggatgtatccgtgttggtgcagggccttacttagtaacaatgtatctgtgttggtgcagggccttagttagtaacgatgtgtccgtgttggtgcagggccttagtaacaatgtacaatgtatccgttctggtgtagggccttagtaacaatgtatctgtgttggtgcaggggcttagttagtaacaatgtatctgtgttggtgcagggccttagttagtaacaatgtatctgtgttgctgtagggccttagttagtaacaatgtatctgtgttggtgcagggccttacttagtaacaatgtatccggaagtatgtagt

SEQ ID NO: 524949 - DNA, 954 bp, Homo sapiens
gaggatgacatactggcagctgttgtagaagaagatacacgtctgatttgaatacatgcttaccccaagaggcctgtactctgaggaatacacatgtggactaggatagatgcgtgggtgaccactcgttagttcccatgtgaagtacaatcgtacgtagtgcaatctacgaacatgagagcgctgatggcttaccgatttgtctacgtttcatatagctaaacagagactccactttcgctagaacttcattaagcctgtacgataaagacgtcatatactagcgacaagtcgtttaattggctgcatcactaggtattttgaagtggaagaggaaggtaaatttcgaatcaacataccgtgcaagattaatggggctgtgattagctgttgggacgaatgtatattgtagactaatggactggcatactaatagtattcgaagaatcgctagtagagaagataggctgtatagcccgaatgacacgtgggcgaccaaagaccttgtacaactcgcgcgtgcagcatggatatagccgtggcacatgagcgatggaaagatgccaacatcggcactatgcgtgggagctcggggccggacggctcacaacataatatccgaatgcttaagacctggtgggaatgtggtgagcgttgcggcatggttgaaccctcttggtttgtggacgttgttgttacctgatagtgtggctatttacacgggtgtacctgttacgagttgcttgaagggccagggccacgtgcgtctgtttggtggcttctccatcttccgtttccgggtaccgttaggatttgattacttctctttcctcccctaaggttaggaccctaagtgtgtcctataacttggaggggcgggagaaggttcccttagcctaggggggctgtcgtggattgcgggtaaaagcccgggggtttggccctcttcgttgg

SEQ ID NO: 524950 - DNA, 408 bp, Homo sapiens
gttacttaccctctctctatgccttagtttcttcatttgtaaaatgtggataatttacctgctccatagggcagttgtgaaagtgaaggcacttagaaaagtgcctggtagtaaagatgaagggaggctgggcgcggtggctcacacctgtaatcccagcactctgggaggtcaaggcgggcagatcacttgaggtcaggagttccagaccagcctggccaacatggcgaaaccccctctctactaaaaatataaaagttagccggtcacggtggtgcatgcctatagtcccggctatgctggaggctgagacaggagaattgcttgaacccaggagatggaggctgcagtgagctgagatcacactactgcactccagcctgggtgacagagcgagactccatctca

SEQ ID NO: 524951 - DNA, 386 bp, Homo sapiens
  misc_feature (26)..(26): n is a, c, g, or t
  misc_feature (28)..(29): n is a, c, g, or t
attgcaggtcagtaagaccaagaacncnnttttcagttatcggcagatgggatctattgatccagcagacaccagactggtcttgggtctctgttttagtgcagccctcacgggggcgggggagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcagtggggggttttctaccttaaaaaaatcactgaggatacttatttaatgaacatcaattccttttaaattgtcttagagaaatttctctgtggctcaggtgtaccacccataaac

SEQ ID NO: 524952 - DNA, 310 bp, Homo sapiens
gatctaaggattcccggcaggcaggctcgtcttggcttgttcactttgtatataaatataaaagactccagagtgcaaaacagtacagagagatctgtgtcctacctctccatcccaggcctcaagtactaggacatgagcaaacaggacactaaccaggcacactgctatgacctgggactagcaggcccttcagcacgctgcatcaatcttctacacacaccaacattcttacatgtcatgtgtagttacacacaaactgtgaagctttatcacacacacagacacatctccccaccactgtactcga

SEQ ID NO: 524953 - DNA, 288 bp, Homo sapiens
aagggggacaaaggtaacattaaacaaaaatcaggattgagaaaggatatgggtacatatgaagattgttttgttttgtttttgagactgagtctcgctgtgtcacccaagctggagtgcagtggcacaagtctcggctcaatgcaacctctgcctcctgggttcaagcgattcttgtgcttcagcctcctgagttagctgggattataggtgcccgccaccacgcccagctcatttttctatttttactagagacggtgtttcaccatgttggccaggctggtctgg

SEQ ID NO: 524954 - DNA, 350 bp, Homo sapiens
ttgggggagcaggcggcacaggaataatgatctacacagtgcagtgtaattgctgtaaaatatatttccggctgggcgcgttgactcacgtctgtaatcccagcactttgggaggccgaggcaggtggattacctgaggtcaggagttcgagaccagcctggccaacatggtgaaaccccgtttttattaaaaatcaggcgagtgtggtggtgcgtgcctgtaatcccagctactcaagaggctgaggcaggagaattgcatgaacccaggaggcggaagttggggtgagccgagatttcgccattgcccttcagcctaggtgacagagcgagactcagtctcaaaaaaa

SEQ ID NO: 524955 - DNA, 431 bp, Homo sapiens
  misc_feature (128)..(128): n is a, c, g, or t
aataactttatccccgaagggccaaagtcagtggaaggtggataaccccctcccatcggggtactccccggagggggtcccagagcggggcagcaagggcagccccttcagcccccgcagccccctgncgttgagcaaagcagatttcgagaaacccaaagttttcgcctgggaagtcccccctcaggggctggggtcgcccgtcccaaaaagcttcccccggggagagtgttaaagggggaagggcccccccctgctccccagttccagcctggcccccccccctcctttggcctttggccctttttccccagggggcccccccctattgggggcccccgggtcttttttccccccccccccccccccccccctggcttttattttggtaatgtggggggggaatgaataaataaaggggttctttccca

SEQ ID NO: 524956 - DNA, 252 bp, Homo sapiens
cccccccccggggggggggtttttgggggaaaccccccccccccccccggggaaaagggggttcccccggggggtatagggcccaaaacccctttttttccctttggggccttttttggggggcccgggggggggcccctaaaaaccggggtttttggccgggggggtttttttttgggcccccccccccgggccccccgggtttttttttttttttggggggttttttccctttttccccccccgggggga

SEQ ID NO: 524957 - DNA, 1160 bp, Homo sapiens
ggctgggctgtcggcctggaccttgcaggcgcaagggatacacatgttcgagatatggcaactttgaaagatatactacgcaggagaactaagagtccatcaaaaacatccagaaggattaccaaggtctatgaacaatggtagcggcagcaagagattatgcccgagcggagagagagctgaaagccagctcgaactatactggacttgggatcttctagctctcgtagtgacaatagaggctggatatcgaatggggcctagaagacaacgaacgaaagcacctgcacttaatccgtgtcgtggtaccatcgaggagtgcgatggcactggtgtaggtcgcgtgattgcattacctctgattgtctaatagcgaggatgcaacaaagcgaggtctgctacaactagagcagctagacttgtgcgaagaggaaagtctatagctctggtctggacatggtgggtgaacaagaagtcatgacggccagtactctatcattcacggaactcattactcgaacactagtttgtactgggttggctatatccgagagacgaaaagtggagagacgacaagccccgctcgcgacttgtgggggagaatggcggtcaatgttcgatgtgcgcctgtgaaattgactaacattcgtggaatagtggacattgtgagggaagggctcccatcaatcctttaagtagagattcagggtcggtcagtctcgctagtaagcaccagtaaagaacaagccgcatctttcttgcgccgttaagtaaccgttttgcaaaggtgtcatgtacgaggacaatgaggtaatcctaatggaccgaagactttgagtgcctgaacagtagccgagggaaaatttacccaaagaatacgaagtcctggccaaaggatcatctactaaattcctctggaaggagtccaccactagtgagcagagttgccaggaatgacgagcattggcaccaaatggccaggcaaagaaatggtttctgacgatgattggaccaaaattggacaatgggagcattccaaccggtgaccccgccaaaggtggtgcatcccaaaaagaagttgatggaaacttaatctctggtgctgcagctctggcgtaacgggacaaccagtccgtcctcagaaagaggaacgagggaaa

SEQ ID NO: 524958 - DNA, 366 bp, Homo sapiens
atcttcagagtgataacactcctacaggcacggctgtgacaaggacacaggaaggttactgtgcaaatggaaggtgaacacagaagttaagcatcacagtgaggaaagaggatattttatcacagtaaaaggaatcattcaccaggccaggcacggtggctcacgcctgtaatcctggcactttgggaggccgaggcaggtgggtcacctgaggtcaggagaccgagaccagcctggccaacatggcgaaaccccatctctactaaaaatacatcaaattacccaggcgtggtggcgggcgcctgtagtcccaggtactcgggaggctgaggcaagagaattgcttaaacctggggcggcagaggg

SEQ ID NO: 524959 - DNA, 453 bp, Homo sapiens
gtgtatctcgagctaatcccacacagcagagtaacgtattacgacaaattagcaggtcattcctctgcttcaatcctttcgattggccgagcacggtggctcacgcctgtaatcccagcactttgggaggccgaggcgggcggatgatgaggtcaggagatggagaccatcctggctaacacggtgaaaccccgtctctacgaaaaatacaaaaaattagccaggtgtggtggcgggtgcctgtagtcccagctacttgggaggctgaggcaggggaatggcatgaggcaggagaatggcatgaacctgggaggtggagtttgcagtgagccgagattgcgccactgcactccagcctgggcgacggagtgagactctgtctcaaaaaaaaaaccaaaaactagccaggcttggtggcacaggcacatgcctgtaatcccagctactagggag

SEQ ID NO: 524960 - DNA, 311 bp, Homo sapiens
cacccactttggggtaaaatattaatttattgggggaatgacagtgttaagggacccaagctcccttaacaaccaaaaaagggtttttgtgggcctggcaagaaagggcatttgccaaggaggagtcatatttgatccttcccatttttaaagaaaatcaggcttaccctcctgggactgggggaagcaaatgtgctgacctcccacatgggggggggaggggccctgggaccacaaccggaaattgcctttttggacctttccaggtcaaaaatttgccctggtaataaacggggctgcccacggcccca

SEQ ID NO: 524961 - DNA, 831 bp, Homo sapiens
  misc_feature (205)..(205): n is a, c, g, or t
  misc_feature (333)..(333): n is a, c, g, or t
  misc_feature (453)..(453): n is a, c, g, or t
ggtacgcggtggtgtatccgctctgcagttcacagcgccgtcctgatgacttcgacttgatataaagtacttgtgatcacgcacgtcatagtgtgctatgggtgaagtctaacgtaacctaacattatgcaataatgattgtgaaaatgtctcgtggagtatgccattcctgacgggtggcaaccaacatagtgccttttgcatngaaaatcggcagagtggcattgcgtggagtgacctcgtacttcagagctggctgcgtataatgtcctcatctaactcagtgactaaattgttgtagtgagactgtcaggggagtaagcaatatgactntccctgtgctcacagctaggagtggtcaacatgtgtctgatccttagcaaagtatgcgaagaagtttaacatcgaggcacatacatcgctgccatggcttagacagcgccgtgttcacgntgtgggagtggacttgggtgtcagtagatgcgtgtatctgataggagaatgttcgctgtcagtggttcacgtttggtgggcctgagcttcttgtgcacaaggtaatgtgggctcgtgtctatgagattgcacgtgattcgtacccagcctcaggctctgcttaccagccgcttcttgagatgggtgctgccttatactgcttccattgtgggagagcagctacgaaggtcgaaacactacagcgatgcagtgtgtgagacactgtctggtattagtaactgaagttcacttggcctttgatacataaccctcattaaatcacttctataggggttccattatcaactagggggacttgtaattggaaagtggtaaccc

SEQ ID NO: 524962 - DNA, 418 bp, Homo sapiens
  misc_feature (391)..(391): n is a, c, g, or t
agctgcgcgtgcgcgaacatgtaactgatgggatctgcgacggctcccagatgatgcacgcactactgggcgcgacgaccctagtgctcgtcgacgtggcgccatgggtgttgtccgtagtcgcaggtggaaaaaatctaaaatctcctcagaaagtagaggtcgacatcatagatgacaactttatcctgaggcggaacaggcgcgatgagtctggcggtaatgtgactttttcattcgagtatcaaaaaactgcgatggataattggataaaaacgtctgggcgtcagaatattactagtaccaaatgcaactttgtttgactgaagctgaatgttcatgaagaaatttggcgtataacagcggagatcacttcttcatggtatgaggntgactcatgtacaccatttcagatgct

SEQ ID NO: 524963 - DNA, 155 bp, Homo sapiens
ctatatatggagttctaagttgaggagggcatcttctcgtattggacagtatagagaacaaaagtgacatgagtttgaaaaatacatatcaatatgggattgctgtcttggttgcagtggtgatacagaattggtttcattaattcctacatggt

SEQ ID NO: 524964 - DNA, 720 bp, Homo sapiens
ggctccccgaatagctgggactacaagcttgtgccaccatgcctggctaattttttttttactattagtagagatggggtttcaccatgttgcccaggccagtcttgaactcctgagctcaagggatcctcctgccttggcctcccagaatgttgggattacaggcgtgagccactgcgcccagaatttttggtatgttggagcaacattgcattatgggcataaattccacttgtgtcattatgtagagtcctttttatatatttctggaatcagtttgctgtttgtggtgttgaaggtgctgttttaatatttataacagacttttgtatttagacttattttctgtgtggttagtttaatttttatattagggtaatactgggccttacagactgagtggggaagtttcgtatgtgtgtctttatttggcatttatctgaaaatattttctaattgtgtctgtgtgatttagtggttttacccatttacgtgcgttagtagcatgtggttcatcttccatatcttggtaaatttcttaacatttcgtgttattaatttctaattttattcctgtgcgcataaaacatacttcttatgatttcagttctttcaaatttatggatggtggtttaatgaagtagcatataatctatcctggataattttattagtggacgtgagaaagaatgtggttctgctatggtggggtgaagtgtc

SEQ ID NO: 524965 - DNA, 242 bp, Homo sapiens
ttccccggggtgaggaaggaaattttggggacccctgggcccgaattcccttttccctttggggccaaaaccccccaaaaggccggtccaaatttccccaaaccctttccgggcccctttttggttttgggggggccccccgggccccctttccccccccctttggggcccctgggtttttttgggggggggggaagggtgggaattgccacccctccccggggtttttcccccgggggggg

SEQ ID NO: 524966 - DNA, 252 bp, Homo sapiens
gataacctgcggtggaacacccaatgtccatcagtgcatacatgcaacaatagtggatgaaccttgaaaacattaagttaaatgaaagaagctgggtcatatggtaattctacattgagcttttagaggaactcccagactcttttccaaagcaggtgcactattttgcattcccaccagcagtgtacacgagttccagtttccctacattctcaccaacacttattattgtctgtcctcactacatgccat

SEQ ID NO: 524967 - DNA, 855 bp, Homo sapiens
ctagagtccggctgttggctagagtgggcgcgctctggtgtggggaaggcggcgggactcaggcctgcctgcgagatttgtcctacataatgtagaggacgaatggcacttttcgataaaggctataaatgaatttgggaataaattcaaagaggtacggacaccctctgtgtcagagtgggggactaagagatacctacaaggattccatcacgagcatttgtgagaaaagctgtcttgtgaaattaagtggaagaagaacgaagtggttgagatgtttctgcaatatcaaatcagatcagcaggcaaaataagctcattcaagaaaaacagggtgataccctgtgttacaatggatgtgctggaagtaaaagggcaaaacgcaggattgtgcaagtaacgtgactgcaaatatccaggatcttaagggaagaatattctaggaaggagaggaaactatttctagtgtaataaagcggatggcagagagttttgaaagtgttggcagaattctgaagaatttgtataaaggatcgattttggactaagaacttcgaacaattttgtggtgagaaatggcgtttaattttcactaatatcgaccctaagatcttgagagccatttatttttcctaacttcaatgacgcatgggatatggagtgtagatagtggcctatttgggggctagaaattcagggaatgtggagccacactttcgttttgcaatgtcggaagttatgaaggtaataatacataggttacaggatttccaaaaatatacgggaaataaagaggatgcagggtgaattatcatgtggcacatgtttttttccccccgaggtggtttaatgatg

SEQ ID NO: 524968 - DNA, 931 bp, Homo sapiens
  misc_feature (26)..(26): n is a, c, g, or t
  misc_feature (118)..(118): n is a, c, g, or t
  misc_feature (333)..(333): n is a, c, g, or t
  misc_feature (335)..(335): n is a, c, g, or t
  misc_feature (346)..(346): n is a, c, g, or t
  misc_feature (357)..(357): n is a, c, g, or t
  misc_feature (371)..(371): n is a, c, g, or t
  misc_feature (405)..(405): n is a, c, g, or t
  misc_feature (407)..(407): n is a, c, g, or t
  misc_feature (410)..(410): n is a, c, g, or t
  misc_feature (435)..(435): n is a, c, g, or t
  misc_feature (442)..(442): n is a, c, g, or t
  misc_feature (448)..(448): n is a, c, g, or t
  misc_feature (452)..(452): n is a, c, g, or t
  misc_feature (459)..(459): n is a, c, g, or t
  misc_feature (462)..(462): n is a, c, g, or t
  misc_feature (472)..(472): n is a, c, g, or t
  misc_feature (476)..(476): n is a, c, g, or t
  misc_feature (480)..(480): n is a, c, g, or t
  misc_feature (486)..(486): n is a, c, g, or t
  misc_feature (488)..(488): n is a, c, g, or t
  misc_feature (495)..(495): n is a, c, g, or t
  misc_feature (498)..(498): n is a, c, g, or t
  misc_feature (503)..(503): n is a, c, g, or t
  misc_feature (523)..(523): n is a, c, g, or t
  misc_feature (535)..(535): n is a, c, g, or t
  misc_feature (539)..(539): n is a, c, g, or t
  misc_feature (541)..(541): n is a, c, g, or t
  misc_feature (547)..(547): n is a, c, g, or t
  misc_feature (549)..(549): n is a, c, g, or t
  misc_feature (557)..(557): n is a, c, g, or t
  misc_feature (562)..(562): n is a, c, g, or t
  misc_feature (571)..(571): n is a, c, g, or t
  misc_feature (582)..(582): n is a, c, g, or t
  misc_feature (589)..(589): n is a, c, g, or t
  misc_feature (610)..(610): n is a, c, g, or t
  misc_feature (630)..(630): n is a, c, g, or t
  misc_feature (721)..(721): n is a, c, g, or t
  misc_feature (756)..(756): n is a, c, g, or t
  misc_feature (779)..(779): n is a, c, g, or t
  misc_feature (785)..(785): n is a, c, g, or t
  misc_feature (811)..(811): n is a, c, g, or t
  misc_feature (817)..(817): n is a, c, g, or t
  misc_feature (823)..(823): n is a, c, g, or t
  misc_feature (832)..(832): n is a, c, g, or t
  misc_feature (840)..(840): n is a, c, g, or t
  misc_feature (866)..(866): n is a, c, g, or t
gctggcgaacttggtgcacagcctcntggtgaaggtaaagatatgccagaagacggtgaagcgctacgatgtggtgccccatcctccatcaccatcagcctgccaggcacagaccctnaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctaccccagaatccaatctaatcaccttcgaagcaactcccccnangctgtaactcnaaaccaccttnaatatggcacctcncctaaaaaaccccccttaaaatcctatcagctantnaanaaaacctaactaatctaaaaaaaanaaaaaangcctgntggngctttcnatngccttcatgntgtntatnaccaanantacccanaantcttnctacctggttccaactccanacaaccactatnccananccggancntctgaggnatcgnccagtccangccctcatctnaggtaanaatgtacatcagctggcagcnccaagcaagtggctgcaggnacactgatgccacagctcctgggccggccctcacatctgaaactggttgccgagagccctgagccaaggcaaggatttgccaaaaatgttntgggggcccagcaaatgcaggagccgacctggggntgcacatccctgcccatccccanaaagantgttcctgtcaggatttgtttccctntgctgnggcggngactgcttntggaccanaacagctccagctcccaggtattttntacaggccccttgagtgggcagccaagcccaggcttccagtatcaataaagcagttttttgagga

SEQ ID NO: 524969 - DNA, 102 bp, Homo sapiens
gcattcttacattactaaaagaagaatagggtcttttctggaatcactttttttgtaagaatctccctgatgtcggtctacatgatgatcatgggtaacaga

SEQ ID NO: 524970 - DNA, 244 bp, Homo sapiens
cccccgggggtccccctgaagccccaaggggcccctgtcccccatggccccccccgggggggttaagggtttttttcccccccccgccccgggggggagggcagtaaaataagggggtcaacccccctcccccctttttttttgacagccgggtgggatgttggggtttgggggtttttttttttttttccttttgttttggaaataaaggaggcaaaaaaaagaaaagcccgtttttttccca

SEQ ID NO: 524971 - DNA, 762 bp, Homo sapiens
  misc_feature (113)..(113): n is a, c, g, or t
  misc_feature (223)..(223): n is a, c, g, or t
tggaaacagggtctcgctctgtcccccaggctggagtgccaggggtgtgatctcggcctctacaacctccgcctcccgcgcccaagcaatcctcccacctcaagccctctggnattagccaggactacgagggcttgccccaccacaacccgagcataattttgtgatattttgtgccagaagaacgagggtttgggctcaatgttgtgcgccaggctgtggncctcgaaaacctcctgtgagcctccaagcaagtgtgcccgcctatcggccttcccaaagtgtgcctacgatttacgaggcgaagaaggcaaccgaaaacccagcccatgtggtttccctaacgacgtgccctcacttgtgtgactcctgtggtggttgaaaccagtgtggtggacctcaggtgcgtgagccttatagaaccccaggaataaatgttttgagggggaattcacagaaaaaaaatttgcacctttctcgtgaaaacaggcctcaacactagtttctctaaaggggccaagattttttacctcccagccgaccttgttacgggggtgcacccatgaaggggtcacatctgtggtaaacctggcccctctaccagtaccccaaagcaacaagcgctgaggagaggagacccttttccccaccaacaggacaacacctatggctggggggggcccatggatggtggccccccaataggataagaagtctaggaggacaacttttttggagccctatttttcaatttaaagcaga

SEQ ID NO: 524972 - DNA, 128 bp, Homo sapiens
tcagcattaatatgcttgtatcattacgctgttatgatgatagcagtgatgatgccgggtgaaaaagctgtctttagcttcagaaaaggtagggagacaattgtagcaagcagaaaggcaacacagat

SEQ ID NO: 524973 - DNA, 117 bp, Homo sapiens
agacaactggcgagtaaagtcacctcgtggggcggccatattgcgcgtccctgagtcctctgggcagatgcagagccgtgtaagctcatagaagcaacgccagtggaacagtgggag

SEQ ID NO: 524974 - DNA, 242 bp, Homo sapiens
  misc_feature (1)..(1): n is a, c, g, or t
  misc_feature (187)..(187): n is a, c, g, or t
ntttccgggcgcatctcagggttatttttcgaacgtgtacatacaaatatgcacaaaaataatcataattattttctgagattgattatgatatgaacaccaatttcgtatagagtctcactatgtctcaaatttttgcttactgtcggatatcaacgctggatcagaccaccgaaaatcaacgccntggaaatcgaaagtgcaggttttaaaatcaaaccttatcaaataatcgaagaaca

SEQ ID NO: 524975 - DNA, 627 bp, Homo sapiens
  misc_feature (85)..(85): n is a, c, g, or t
  misc_feature (282)..(282): n is a, c, g, or t
tctgtggtagttgatactagcaagtatataattaaggctattgtgcccgatgtgagcaatagtgaggttatggagattattgagngtatttagatagaggtggatagctatattatgaaggtggtgtagtagattgtgtactaggtaagtgttggtttattagattattgtgtagaaggttattatggatgaggagatggtgttgggtttagaggtggttgcttgttgatactattaccattgccacctctgagagcttgatagagcaggtggccatgatgntggctttggccattagtgagggcactgtgtttgctgtccgggcagggacaagtggcattgaacaggtcactgtgaccatggtgtcattagaggacattgagattctggagcatgcaggtgagttggttattgccttgccggagggccagctggaggtgcagatggttattgtttagcatgaggtttgtggggttctggccgggcagggacagggcagaggactttgagcgccccacccatgcctgcctggcctggtagagaagatggcacaggatggaggcgccccaagacggacagtgtacataagagttttttgttgctttacaataaaacatgagaacctga

SEQ ID NO: 524976 - DNA, 270 bp, Homo sapiens
ggggggggggtttttttaaaaaatttgtttagccctccaattttccccctttttcccccattaaagggaggcggatttttggccccagggggccccttttttcaaataaggccttgggttttgcccgggccctttttttttttttccccggggccccccaaagttttgtttttgggggaaccaaaaaaattaaatgggccccttttgggtatgggggggggtttaaaaaaatggggaaaaaaaaaaaaaaaagcgggttgggttttccca

SEQ ID NO: 524977 - DNA, 579 bp, Homo sapiens
ggagagagagagaactagtctcgagtaattatctttctagtttaactttattaaaatactgagttaatacacatgtatattttggtctccccaccatttccatgttctgaccaccgctactactatgtcctatcataacatcccatacatacttaaaaccaagcaaagggtgagagtgccatctattaagaaactaagacgcggcatttgggatcaacacatatcttggcaatagaccctggcacaacattctatcaaacagctggtaggcgaaagtcctcactcgtgcatttactaaaagggacagccagattactcacacgtgttaccagaaagagtgacacatacgcacggaaaactatgtagaagcacactgggcctacgccaattttcctttaagagagacttccatccacgtgccaggagaattcttgtgaattaggccatttttggctcaagccaactccggaaagcaattcttcacaataagtggagtgaattggggcttccacttgtggaaaggagaaccaccatttctctatacttgctggaatattggcttaaatgtctcctacagaa

SEQ ID NO: 524978 - DNA, 126 bp, Homo sapiens
caatcagaaaatgacttccaatatttcttctgtcaccgtagtagccaagtttctcacaaacaaaactttaccttagccatgacttctggatctggttctgccattggaccagcgggtgccattggg

SEQ ID NO: 524979 - DNA, 507 bp, Homo sapiens
tggccgggcacgaggtcaggagattgagaccatcctggctaacacggtgaaaccctgtctctactaaaaatgcaaaaaattagccgggcatggtgggcgcctgtggtcccggctactcgggaggctgaggcaggagaatggtgtgaacccgggaggtggagcttgcggtgggcagagatcgcaccactgcactccagcctgggcgacagagcgacactctgtctcaaaaaaaaaaaaaaagatggccgaataggaagagctccagtctgcagctcccagcaagaccaacacagaaggcgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatgg

SEQ ID NO: 524980 - DNA, 139 bp, Homo sapiens
ctttttttttggggcaaattttgtgtgcccaaactccagtttaaatgttttttttaccaagggaaggtagcctttattcccatagctttttaatttaatacatcctttcatggatgtaacccttaaaggagtttatact

SEQ ID NO: 524981 - DNA, 1933 bp, Homo sapiens
taaagaaagctaaatattacattatgtaaatacttcttttcaccaacttctgtagtttcaccattgcatggtgtcatttcaggttatttaacagttatatccctctatgccaataattaaaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttaaaaaatgttacagtatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaag

SEQ ID NO: 524982 - DNA, 276 bp, Homo sapiens
tgtcttgcgcagtggctcacacctgtatcccagcgcttcgggaggccaaggtggagaggtatcgctatgagcccaggagttcgagatcatgcctaggcaacatggcgaaagcccgtctctacagcaaaatttttgaaatcaccgtggtttcggtggcactgtgcctggatttggtggtacaagccgattgtcccagctacccaggaggctgaggcaagaggatcgcttgaatccaggaggttgaggcttgcaatgagccatgattgcaccaactac

SEQ ID NO: 524983 - DNA, 117 bp, Homo sapiens
taggtgctcttggccaggctgctcttgacccgcgtgatctgcccgtctcggactcccaaagtgctgggattataggcatgagccacatgcccgtgcggcccggctatggtggcatat

SEQ ID NO: 524984 - DNA, 625 bp, Homo sapiens
taaacaaacccgggtcctggggtggggggggggtataatactaagtggagatgatatcatttacgggggaaggggcttggtgaagtaggccttatttctctggttcctttcgtacagggaggaattggaagtagatagaaaccgaccgtggattacctccggttctgaacctcagaatcacgtaggactttaatcgttgaacaaacgaacctttaatagcgggctgcaccatggggatgtcctgatccaacatcgaggtcgtaaaccctatggttggatatgggactctaaaataggatggcgctggttatccctagggtaactggtcccgtgggtcaagtttatgggatcaatggagtatagtagttcgcttggactgggtgaagtcttaagcatgtacggctcggaggtggggttcggctccgaggtcgccccaaccgaaatttttaatggcaggttgggaagtttaggaccgtgtgggttggtaaggtacgggtggcgttaataaattaaagccccatagggtcttctcgtctggcggggtcttgcccgcctcttcacgggcggtcaatttcctggttaaagtagagaccgtgaccctcgtggggccgacctttccagggtg

SEQ ID NO: 524985 - DNA, 424 bp, Homo sapiens
ggtcgactttttttttttaagagacaatgtctcgctctgtctctcaggctggagtgcagtggcgcaatcacagcttactgcagcctcgacctcttgggatcaagcagatcttcccacctcagtctcctgagtagctgggactccagacacacgctgccataccaacctaattttttaaattttgtgtagagatggggtctccctatgttgcacaggctggtctcaaactcctagactcaagcaattgatcctcccacctcagactcccaaagtgtcgggataacaggcataagtcactgcacctggatgaaaatgaatttaataccctgataaactcatcacagagctgaaaaagcataaattgagccatcatgaagtccagatgctcctcaacttacaatggggttatgtcccgtcgacgcgg

SEQ ID NO: 524986 - DNA, 1272 bp, Homo sapiens
agcggcgtctctgccggaggagccgcggggccgccacactcgccccccgacccccgcccgcgctcactcgcactcacacccggggcgcaggaggcagggcggcaccgggccccaccgagaacacaccaatgaacgcacccaagacacaggagagcgcatgagaacacacgcagatctagcatgcccaaagaaccagaataacaggggacagccacaagacaagaaaaggaatcatcatgcgacaaggagacacagtacatccggaaaagcgaaggccgcgagcaggcaacatcgaggccagggcgagcgagaccaaaaccaccagacgtggcaccacacaaggaagagaaaagacacagaacaagagagggagggcgaaaaaagaaccaacaaaaggggcagaaacccagccgaaaacaagagccccaacccacacggacacccgacgaaaccgcgccacaacagcagggtcacgaccacacgggcaccgcgcgagccgcgcgatcacgcgacacgcggcgcccccaagccagagcgagcgcagcggacggaggcgccagccaccccacagcgccacacagcgccacaaggccactccgaaggacaaacacccagcgcaaagcaccccgaagcacaaacgggcacccgaacacgccgcccggcgaccgaacacgcgcccgccgcgacaccacccagccccccccctcagccgccccagacgggagcccaccacccacgcacgaccacacacacgacggcagacaccgcaccccgcacccccgagcccccccgactggcgccacccccccgccaccaaccgcaccccccgcgcacgcccagccgccacaccaaccagcaagccgcaccgcgcagcgcaaccgccacgcacagaacagccacacagggcactacaagcgcccagaacgaagaagacacacatacacaagcaagcaagccaataccacacgcgaaaacagagtcgagcagagcacacggacgaccagaccggaagcggcgaagacggaggagcgaccaacacgtcaacgacaacggagggccgacgagaccagccgaggaaacgcacacgggacaccacccgacaccgacgccacaagagcgacgacgacgaccagcggacgcgaagagacgaccgacaaccacaagatgaacgagacagagctccgcacgaccgaccgacacaacagtcgacgcagacgctagcagccacgacgaccagcgagcgggcaacacggagatatcaccaaacaagag

SEQ ID NO: 524987 - DNA, 791 bp, Homo sapiens
catctttgcagatacacttactcttctgtttgaagggattgcccgcgattgtggagaaccatgcagccaatagtggagacctattatgggccaggcagactctataccctgatcaaatatctgcaggtggaatgtgacagacaggtggagaaggtggtagacatagttcatcaagcaaagggactaccatcagcagttccggcatgttcagaacaacctgatgagaaattctacagcagagaaattcgaaccaagagaactggaccccatcctgactgaggtcaccctgatgaattgcccgcagtgagctatacttacgcttcctcaagaagaggattaggctctgacttttgacagtgggacgactccattgtgcctcagaggaaggtaaatgcatagatgcaccagaatgtgtcttggtacaatactcactcaagtatactgccttattgacgcttgtaccaatgcatggatgctaacttggtcttatactgttaccattggacggatgtactttcatgatgggatgactgtcaattagatggtctgtggctctggacacctatgagaatgggccagtctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtcataagctgcggatgggctttcctgccaccaccttccaggacatccagcgcggggtgacaagtg

SEQ ID NO: 524988 - DNA, 980 bp, Homo sapiens
gaacatgtatggagacctggtcattggagacacagtccctgagaaaggtgcattcttcaatagtttcttctatgataaactccgtaccaagggttatgatggggtgaaaaggtggaccaaaaaccgtggacatcttcaataaggagctactgctaatccccatccacactggaggtgcataggtccctcatctctgatgatgtgagagcgacgcaacatcacctattttgactcaagcagcgtaccctaaaccgccgctgcctaagcatattgccaagtatctacaggcagaggcggtcaagaaagaccgactggatttccaccagggctggaaaggtaaattcaaaaatgaatgtggacaggcagaatagtagacagtgactgtgagatgatatcatgtgtagcagatcatgcagagcattctggacacctgtatcagacattccagacttcaacacagcaggacatgaccaatctatcgtcggaagagcagaacaagggagcatgagtcacatgcaaaacccaacagagatgaggcctcgaaaacccaagaaaccacaaagcccatacagtgggcagcgacacatagggagaaacaaacacaaaaacatcaaacacataaacaccacttgacaacccccacaccaaagaaccaaaagaaaacagatgaaaaagcaaaagaaacagaaaaacaccacaggaacaacaaaacagacaaggaggacaagggaagacaagaacacacaaccacaacggagggcaggaaaagcagacgagcacagagaagcacacgcccatacagcaggcgcagagcagggcagcagagggtgcaaaggacgccgaaagacaaacaaaaaaaagagcaggcaacgcacagagggagggacacaaagaagagagagacgaagaagaaaagaaaacaacacggagacgacagagggaggacgaagaccgagagtgaaagcgaagacagagagcag

SEQ ID NO: 524989 - DNA, 257 bp, Homo sapiens
tgaaacctgggacgtttattcggacgatattacagctgggtgacacagttctctaatttcctagctgaaactatcccgctattgcttgcctgatctccctcttgaaatggtcacctgaataactacctgctttcatttaatttccctaaagcctcttataagggtcagtcatgtgctggacaatagtaattcaattgacctttttctttcttctgaggtcgaaaacacccccatttcactaaccttcactatcagat

SEQ ID NO: 524990 - DNA, 400 bp, Homo sapiens
  misc_feature (296)..(296): n is a, c, g, or t
gcaggcctgaagaccaccctcccgagaggaaccagcccggtaaaagggcacacgatgatgcggcttcccggtccctccgcgtgtgccgattccagatgaccttacagtgtccccaaggttattccatcttatagactgtaaccctgcctccctgcttactggtccagagcctccctccagtgactgtggagcctaagaaggcccccgggccccagcatgggccccgagcttggaagtagacatggcagttggtggcagtgaaaaccaacccacccaccacaaaaagacacaaactntgggaaaacacaagtttctcgggggccaggggtcatcggtttgacccctgacctataagccaagaaaccccataaactcactcagaaagccgagcaaaagaaaa

SEQ ID NO: 524991 - DNA, 88 bp, Homo sapiens
gtgggttgacgtggcttgggcagagagagcctccatctgtggtggcatttgagagctgttgttctccaggatgcagtagctccacagc

SEQ ID NO: 524992 - DNA, 125 bp, Homo sapiens
gggtctgttcccctcaaagctacattctatccagtcttcacatttagctgattatcttgcctgtgtaatcgtggatagctcgaaagagaatccattcagggattaagccgtacctatcctatcca

SEQ ID NO: 524993 - DNA, 86 bp, Homo sapiens
tgaggcccagcctgcacctcctccacctcactggatgctgttaaccccctctgctcctcctccaggtacagggaagcacaaaaaaa

SEQ ID NO: 524994 - DNA, 982 bp, Homo sapiens
  misc_feature (89)..(89): n is a, c, g, or t
  misc_feature (108)..(108): n is a, c, g, or t
  misc_feature (172)..(172): n is a, c, g, or t
gagtccgcattcgctccagggttttgggacccataggttgctggagttccttaccgctacccgtggctcgtctctgagcagttgtcccncataactcgcgaatctatngagccgctgttgcgaggcagtgagcacgtggcaatcaagtacgcttcccatgtccctgaacgcncgccctgtccaccaccccggccggtggcccaactagcaatcgaaacctctgtgacaggttgcgagacggcggtaactggatggcacgtcccgcctgctggcagcccccgcctgttgtctacgtgggctttcaggaaaccaagtttgtatgtttacgtcagggagtagtgtacgaccttgtctttaacgggctgtccgccccggagacacggacgggacgtcaacacccggtgagtatcgacctgtaagcacgagtgtcacggactgtcgattttcagaaatgcgtggatgggtaccgtcgtgctttcattaaggcccccgtaggcaagactggccacacctaagactggatgccttatcagtccatcacccgtgtattccatactaagcgtccgtgtgtcacgtgagtttctaacaatggtctagccatatctggtaaagattggccttagacacacgaatcatgggagaagtatgtcaagactaccagaagattggagaaggttcattcgggccaacagccaattctgtgttacagatctaccagaaagatggcagcacagcatgttgatcgagggacattacgcatctcaaggaagtgtccagtcacggagagaggacgacatccaagggacgagacagtgggcacgtatgcggcaaacgattgaggccttccagttatgggcccaggtataagacgcaaatccttttggagacacatcgctgctctgcaccatagaactggattactggcgcggcacggggatctgtaaagacgaatgagtgcttccaaaggcggtggacacaagga

SEQ ID NO: 524995 - DNA, 316 bp, Homo sapiens
ttatacacaacctagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 524996 - DNA, 195 bp, Homo sapiens
  misc_feature (184)..(184): n is a, c, g, or t
tgtaatcccagcacttcgggaggccgaggaagcagatcacctaaggccaagagttcaagaccagcctgaccaacatggtgaaacccatctctactaaaaatatttttaaaaattagctggggttacaggcacaccaccacgcccagatagcagaccccacgttagcgtgaaatgggaaaaaacnttgaaggaggc

SEQ ID NO: 524997 - DNA, 266 bp, Homo sapiens
gtgaactccacagtgtatcctttaacttacacgtgttggagttcctgtcgtggctcagtggttaacgaatccgactaggaactgtgaggttgcaggttggattcctggccttgctcagtgggttaaggatccggcgttgctgtgagctgtggtgtgggtcgaagacgtggctcggatctggtgttgccgtgactgtggtgtaggcgggcagctgtagctccaattagacccctagcctgggaacctccatatgccggggtgtggcc

SEQ ID NO: 524998 - DNA, 504 bp, Homo sapiens
  misc_feature (47)..(47): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (115)..(115): n is a, c, g, or t
  misc_feature (167)..(167): n is a, c, g, or t
  misc_feature (215)..(215): n is a, c, g, or t
  misc_feature (223)..(223): n is a, c, g, or t
  misc_feature (283)..(283): n is a, c, g, or t
  misc_feature (340)..(340): n is a, c, g, or t
  misc_feature (394)..(394): n is a, c, g, or t
  misc_feature (403)..(404): n is a, c, g, or t
  misc_feature (406)..(406): n is a, c, g, or t
  misc_feature (412)..(412): n is a, c, g, or t
  misc_feature (417)..(417): n is a, c, g, or t
  misc_feature (498)..(498): n is a, c, g, or t
ttccccaaggaaagtacctagggagcagaggcactccgttgcccccnacactgctcagaantantctcanacatggcaggaattcaaccagtatagattgaattcagagactcanaggaggagcctttacaacaaagtgcaaaggaaagggctgaggctatgtaggnggagcaggttcaaatcccagtctgttgggtataggccaagttttagtntctctgtnaaatggaaacttatcccgtcagaagactgtaaggattggtgatattacagaatgtacgtngaacatagaatgccctcaatacatgcgaactctgattcttttgggtaccattcagcncagtatctcattgtaaacatggggaaactgaggcccatacagggtgggtgaatnggccagggnngnagacanccaanatgatacataacatagggttgagattcttaactcctgacacaccgttctccagggcacacaccttaccgccactttgtgtngtaaaa

SEQ ID NO: 524999 - DNA, 111 bp, Homo sapiens
atacatatacgacttgagttggtacctgaacattcgtgtacgtccgtcagttgggcacgagtcttagccgggtattgctctccatcacttgtaggacacgaatgttcagga

SEQ ID NO: 525000 - DNA, 668 bp, Homo sapiens
  misc_feature (20)..(20): n is a, c, g, or t
gcacgggggcgcggggcgcnaagtgtctcaggcgccacaaagggcacagtgtgggctccgtcactctgtatgtccgaaggggtgtgtgccagtcaagtgtctgcacttcttgagatgcggtgacacagcccacaaaaacactctaggagcgagtttaaataatattattctcctgagtagttctctttctctcaaccacgcactcaagggcaagtatatgataaatatttaggtccacccctccccccaaagagattggggggtgaagatctgggcacgcatctgacatttcttcctctattcctataaaaataaaaggaaccagaattgtgcttcaatgagtaaccaagtcacccacactccaaaataacccatgcacactgtttctgggaaggaagatggccagcacagaagagttggcccacatgatgggggacattctctctgccacttgcagcacccctgttctgggaaggggtggccagtgccacagtggactctgagatgaaagggtgtttcttccactggcctttggcctgtcaccagcttcctccgcggtgacagcacagtacaagagtgatggcaatgtgactggcacagaaatagtttctcccaggcacacaagagctcgtgtaagccccgtagttccatcctgcaaagggcctcag

SEQ ID NO: 525001 - DNA, 959 bp, Homo sapiens
  misc_feature (956)..(956): n is a, c, g, or t
aagatttcatattacatgagaattcctaccaatgtaaagattgtggcaaaagccattcaactggttctctaacccttactacacacaggagaattcatactgcgagagaaaccatacaaatgtgaatgaatgtcggtgaaagcattgtaactgccgtgtcctcacacgcttactacacgataagataattcatactggagagaaagcatacagatgtgaagaatgtgggaaagcttttaaccggtcttcgacagcttactacagcataaatagaattattcatactgggagtgaaatcgtacaaatgtacagaatgtggaaagcttttaaccggtcgtcattaccttagtacatatgggataattcatactggagagaaaccctacaaatgtgaagaatgtggcaaagccgttttaaccagtcctcaaacaccttactaccagcataagataactcatgctggagagaaagcttacagaactgtgaagaatgtggggaaaggttgttttatacgatgactcataccttattaaatcataggacaagtcatacctggagagagaattctacagacatgtgaagaatgggcaaaggcttgaatggtcctcaggcctcactaacatatgagaattcatactggagagaaagcctacaatgtgaggaatgtgggcaagcttgtaatgagtccgtaaaacttataacataaggatgatcatatgggataacctacatggacagatgtggaagacgttaccggtgctcacattaatggactagatgttctatgcagaacttaaatggagattgggagttaaggatcagtttaattgaactatggagatgaatggaatgtgactaggctagactgaaaatatcggagaaaataatgcatgtgactttaaaaagggcgggaagtatacataacgcagtacttcttttggtaaatattcttaaangtg

SEQ ID NO: 525002 - DNA, 141 bp, Homo sapiens
gcacggcctgattacccaggaggatgagagtcgttacaatgagaaaacatatttaataaatcatgtcaatttttataatgtttcaagcccattcttggttgatagccagtgctaaaattcagatgctgttagtacctacat

SEQ ID NO: 525003 - DNA, 1423 bp, Homo sapiens
tatgtcgacccacgctgtcgccttacaactactttttccctcttttgctcacgcacctcgagggaactggtgctcccgcgggaagcgcacggggcggcgcaacgaagcgaaagggcgcggccccagaccgcgggatcccgactctacaggcagcggctccgccgacccgggccccgtcagacgaggcgggcgcacagcagctgggtgggcaactgcaatcacacccgggcgcttgtgcgggcgcagccatgatcggccaacgatccgcgagccgagccggacgtgacagtcacgcctcagattccgccgaccgatcagcgaggggctgcacgacagggggcctggatggcatccgagaactgcgagagaaacatatcgtgactggtacgatgccatcagcacgataaaacctactgacgtgaataatcagaaatccacaccaggaccgatccaacttgacacacggccctaacagcacatgactgcacgttgatcccaaacgaggacgcgagcacagagcggcctagaagggaccccacccaatggaagcctggacaacacacacacagacaacaaggaacaccgcgaaacaggtccacaaacccagcaggaccgtctgagcataccacaagaagacacacacgagttaaccaaaagcggcacgacaggaacaaccctccgatcaatgccaagaacagacaagcacgacaagcaacacatagtgactgcaacactgaacaaacataacaaacacaccaaagggaacccctgaaccccgaccgggagctcaccagacagaccaaaaagcaacacgggaagagcacaacaacgaacaactcacgccaacgacacctacacaaacaggaatggccacacaacagcgacaacaggacacccagcaagcccgaagcagtagagggacacgacgacaacccacaccgaggcaccagcgggcccgtcgccgagagggcactccacaacaaagaccccacagaccaggacagacatcgagaaaggcaccagaacagaccacacgcacagggccacgcaaggccccaacagggacaacaaaacagcacaagacccaccggaacaccaacaacacaaaagcacagcgaaccgacgagacgcaaaacacccaggaccaaccgcccccacaacagcccggagcgatgacagacacgcacacaccgcgaacacacaacgagagcacagcagacagcaagcagccacgcacgacaaacacaagcaccgaccaacatgacagagcgacagacaacagaaagaggaaagcaaaccacgaacaccacccaggaggcgccagcgcgagcgagaacacccaccacacagaaacccggacaccgcaagacaaggaagagaacgcagggacagagaaaggcgagagtcacagccgacgcccacc

SEQ ID NO: 525004 - DNA, 188 bp, Homo sapiens
gcggccgcctactactactactactgctcgaattcaagcttctaacgatgtacggggacatgcctgtggtcccagctactcaggaggctgagacaggagaaacgcttgaacctggaggcggaggttgtggtgagccgagattgaaccattgcactccagcctgggcaacaagagtgaaactccgactc

SEQ ID NO: 525005 - DNA, 892 bp, Homo sapiens
gctcatttttctcttggccgccaccacgaatgaagtgccttgttgcctcccgtcatgattgctgaggcctccccagaccatgtggaactgttgtgaggcacagcagctgtatatacaatgaacagtgatattgatcccattactaattatgacaacatacagtgatcttccactgtaaacaggtgtggaacgctccttatggtcctgatcctacagttcctgttccatgacgcaggggcagatcaccaaggagcggcaggcatgttcgtcgtcagtggcaggcaccattgcgagcactccggaggaaggcaagtacgtgggtgatatattcctgtattcttggacaagtacactgttgacatgtagctggattcgagagagatcacactaggcgggcgccgtacgatcggcttaatccatcattcactttccgatctggatcaactggtagtcaagtcaggtccactgtgcttccctgcgtggtgcgacgatggatgctcagactccatcctcgaaggctggtcaagaagacacgttgagacatgtgcctcctgatacgtgtgatggctgtggagcccataggactggagactctcgactgaggctggatggcgcggccattacggtactgtgcctggggggtcaacggcaagaaggctcatggagcaaaggacccaagttcccaactctaaagattgctcattcactgccgagacaagaaagtggtgtccaagaactggggtccccgcggcagggcggggccaccggggggggggaccgggaagacagcgcaaacgctggccaggggagggcctcccacaccgaagggtggcacaggtgacccaccaaaggcggccagacccagataagcccctacaggcagcgcccaggt

SEQ ID NO: 525006 - DNA, 203 bp, Homo sapiens
  misc_feature (32)..(32): n is a, c, g, or t
  misc_feature (47)..(47): n is a, c, g, or t
  misc_feature (55)..(55): n is a, c, g, or t
  misc_feature (77)..(77): n is a, c, g, or t
  misc_feature (110)..(110): n is a, c, g, or t
  misc_feature (145)..(145): n is a, c, g, or t
  misc_feature (169)..(169): n is a, c, g, or t
gatcgagctggtcccgccacagcacgcccagnagcgttggcgatccnggatacangattttcttatacacttccgcnggaccgtctacccagctgtagttctggctaccnggggtacgcccatgcgcgtcaccaatcgatgccanctcaacaccaagaagcttaagttnggtgctcatgtccgcgcccttaaagacggcgtcg

SEQ ID NO: 525007 - DNA, 272 bp, Homo sapiens
atctgatatactcgtcgggtacaataccagtggtggccaatttgatttgatggtaagggatggatcgatgacctcgtctgtcatgtaccggatgcgtaaggatgggagggcgatgaggactcaggatgatggcgggcaggatagttccaacacggtttttcatttcctgagcgtctgagcatgttcagtcatcgttcagttatgttgtgagtgtaaggcaaaagggcatacaggcactaggaagcagataaggaaaatgattaagaggggtc

SEQ ID NO: 525008 - DNA, 668 bp, Homo sapiens
  misc_feature (192)..(193): n is a, c, g, or t
  misc_feature (197)..(197): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (225)..(225): n is a, c, g, or t
  misc_feature (254)..(254): n is a, c, g, or t
  misc_feature (263)..(263): n is a, c, g, or t
aaattggctaggtagaggccggggtgttaatcggccgaggcttctccaccgacccagtggagaactgcagtgatgaagatctacacgtacgaacaatgaccagagacctgggtgaagctgggtgtggacaccattgccaagtacctggacaacatccacctgcaccccgaggaggagaagtaccggaagatnnagcngcagaanaaggtntttnaggagcgcatnaactgcctggaagggacccacgagttttntgaggccantgggttccagaaggtgtatgcttccctgcccaggatcaggagtgaccccgaggagatcatacgtgctgagacgagaccaccttggcccagccccagagcctggagaggcacaaggaacagctgcatggcttgcggagcaccgtgctgctgccaatgctggacaggcagcgccgatgtcttccagccctcgacccctggcctcgcagttcgaactgcctggggacttacttcaaactcacagcagaggagatcaagcgggagcagaggctcaggtccgaggcggtggagctggctgagctgtgctgctggaccaaggacatgcgtggataatggaggagcagctgggggcttgcgcaagtaaaactacacgcttgatgatgcgtgcagcctccccgatggcataca

SEQ ID NO: 525009 - DNA, 405 bp, Homo sapiens
  misc_feature (385)..(385): n is a, c, g, or t
gaagggtacaaggactttcttcacattgtggcaggtaagagaggggtagtggtaaatatttttaaacaagcagatctcgtgagaagtcactcttgaaacagcactagtgggatggtgctaaaccatcagaaactgcccccaggatccaatcatctcccacagggcccctccttcaacactttcggattacgatttcacatgagagttgggtggggacacaaagccaaaccctatcaggcagtaacactaacatttcaaatattaacctcaatatggttagaattgtatcatcatcaagtatcctaaaacatgggaaaatattctaaattctaaattttcaagaattaacttcaggaaatttatctattcctaactctggaaaagnccaaatctgaagagcaaaaa

SEQ ID NO: 525010 - DNA, 430 bp, Homo sapiens
  misc_feature (32)..(32): n is a, c, g, or t
  misc_feature (272)..(272): n is a, c, g, or t
  misc_feature (305)..(305): n is a, c, g, or t
  misc_feature (327)..(327): n is a, c, g, or t
  misc_feature (346)..(346): n is a, c, g, or t
  misc_feature (361)..(361): n is a, c, g, or t
  misc_feature (393)..(393): n is a, c, g, or t
  misc_feature (417)..(417): n is a, c, g, or t
  misc_feature (426)..(426): n is a, c, g, or t
tgagacagggcctcatcctgtcacccaggctngagtgcagtggcatgaacctggttcactgcagccttgacctcctgtgctcaagcagtcctcctgcctcggcctcctgagtagctgggaccataggtgcatgctgccacgcctggctaatttttaaatttttttgtagagacgagatctcactttgttgcccagcctggtctcaaactccaggtcttaagtgatcctccagcttggcctcccaaagtgctggggattacaggcatgagccnttgtgtctggctctaattttcttttgatcattnggaattcagggacttttttttncaaccagggatatgccttngtttgtgtttgtaanacatttaaccctgcctttttagtccatggccntttttcagtgttcaggttttaagnatttgcttncatt

SEQ ID NO: 525011 - DNA, 574 bp, Homo sapiens
aacgggtgatgcggttgtaggagcacactctggagcaacaggacatttctgctcatttagagcaaactgggaaaacggcaaagcatgaaagagcaaagataaaatctcactccgtcccaccacccaccacacgaaagggtgcccagcaccttccctggacaggcctctgcacggctaggactgtgtgcggagatcctcacatcgggaagagggatgctggcgggggtcgccagtgtgccgtcccaggatggacattgcacatttggtccctggcaagcccctgggtgggtcctgaggcccccaggctgccctgtgcactctgacctcccctagagccgcccaagcgatggtggggactggggtgtgggcctgacagcttgctggacagggcgagccagcggcccaggaagaagcaatcaggcaccaacctgcccgccgaggcctgggtctggcccacacctcaccttcccacgctgtccccagagtgccttgcagccctgggcttgccgccccaaaggtgacccgacactgtcccctgctgtgggactgtgagcctcttcagagagaagggagt

SEQ ID NO: 525012 - DNA, 176 bp, Homo sapiens
aattaattaacaatatattgtattcttgaaaaatgccaattaaagtaggatttgaagggttctcatcacaaaaatgacaactatgtgtggtaatgcatattgctaattaatttgatgcagcattccatgcaaatatatatttcaaacatcatgtttacaataataaatatatacac

SEQ ID NO: 525013 - DNA, 852 bp, Homo sapiens
ggcagacactgaccttcagcgcctcggtccagcgccatggcgccctccaggaagttctcgtagggggaaactggaaatgaacgggcggaagcaagagtctgggggagctcatcggcactctgaacgcggccaaggtgccggccgacaccgaggtggttgtgtgctcccccttattgccttatatcgatttcgccgcgggaagaagctagatcccaaagaatggctgtggttgcgcagaagtttgttacaagggtgactaatggggctttaactggggagaatcagcctgtggcattgatcaaagactgcggagccaactgtgtggttggctcctgggacactctcaggaagaagaaagggcaatgtgtctagggcggagaagtccagattgacgctggatgggccaaaaaagtgtgccaatgtgcttctgggccaagagggggaactcggagagataatttcggccttgatttgggggagaagaaacgcataagattgaacagggaaagagctgtggccattcatgttggaaaacagggtgtggtgcttcggacagccaagaccaaagggtctccactcgggcaagaattacaacggttgaaagggcaactggaaagggcaaggggtccggtccgtggccattaattgaagccctttggtgttggacccacatgtggttacgtgggccaaaggactgttgaaacaacccccaaaagaagggccacaggaagtgtacacaggagaaagctcccaagaggatggggtggaaggcacaagcgttctcatgatagcgaggaggatacagaaacaccccggtatcaatttagggaggggggctcttgataacttggc

SEQ ID NO: 525014 - DNA, 268 bp, Homo sapiens
gagatgggcctcactatatcgcccaggctggtctcaaactcctaggttcaaaggatcttctagcctcagtctcctgagtagctgggactacagtgcgtgccaccatgcctttttttttttttttaatgagacagggtctcactatgttacctaggctagtatcaagcaaccctcctgcctcagcctcccaagtagctgggactacaggcacaagccactgcacccagctccaactcctttctttatgcaaatacaaaaggcaaacctt

SEQ ID NO: 525015 - DNA, 257 bp, Homo sapiens
  misc_feature (217)..(217): n is a, c, g, or t
  misc_feature (237)..(237): n is a, c, g, or t
aacaatcagttctcactataactaatgaaacgagaactcattcattaccacaagggacagcaccaagccatgcatgagggatccgttcccatgacccaaacacctcccactctgctaagttgctaaatcctatcaataacatcagtacttcttatctgcactctcagatacatctgacacaacagaccagtccctaaaccttgaagtgctctattcnccttgacctatgaaacaccntactctgttttcctccgtga

SEQ ID NO: 525016 - DNA, 352 bp, Homo sapiens
  misc_feature (298)..(298): n is a, c, g, or t
  misc_feature (306)..(306): n is a, c, g, or t
cacgagagacaatccagatgatgcttctgctacagcgacatggcccagtcccaaggcgcaagggccacttgtgtcagcagtgtgcaccagcagcgtgcgccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgcaatttaaggcttnagcccgcntggaacccagggcactgattaaaacagcatgttggttccaaaaaaa

SEQ ID NO: 525017 - DNA, 192 bp, Homo sapiens
tgatacgaatcgagtcgtgtacctgcagctctctctgatgtggtcaatcccctaatctgtataatgtgctgtttacctgtatttaaaatgccgtataaaacacatttccaggctgggcgtggtggctcacgcctgtaatcccaagcatacttgggaggctgaggcaggagaattctttgaacctgggaggcg

SEQ ID NO: 525018 - DNA, 84 bp, Homo sapiens
ctgccgtgcttctagaggatcccggcaccattgtgcggtaggacacttggtcactttgaagcatgttaataaatgtcactgatt

SEQ ID NO: 525019 - DNA, 115 bp, Homo sapiens
  misc_feature (37)..(37): n is a, c, g, or t
cttcagctaaatctttctttgctgtcctatgatccancactcgtgaacccattacttgttttctgaattcacaaaccttcttcctcatcttaaggcaaatttctacttatttttc

SEQ ID NO: 525020 - DNA, 149 bp, Homo sapiens
tttctgtagttgaatcttaggatctccccccggacagacattcttggcaatagaacccggacaacatttattatacacggtagggaaagttctcactctgcattataaagaggacagccagattcaactattacagaaattaaataaga

SEQ ID NO: 525021 - DNA, 86 bp, Homo sapiens
ggatttgctggtgcagtacaactaggcttaatagggacatggcaagccaacgccacttatccagtgaaccactatcccaaaaaaaa

SEQ ID NO: 525022 - DNA, 152 bp, Homo sapiens
gctaacaggagctttgtgtgctggtagaaactattctgtcagtcacatgcatcaactctgtactggctggccacgggaaggagctgggtgaccaggccaaagcgcagtggaagaaaaccctttcatctcagagtccacagtaagtggcggag

SEQ ID NO: 525023 - DNA, 700 bp, Homo sapiens
  misc_feature (552)..(552): n is a, c, g, or t
  misc_feature (586)..(586): n is a, c, g, or t
  misc_feature (615)..(615): n is a, c, g, or t
  misc_feature (622)..(622): n is a, c, g, or t
cagagagcagtgacttcaccagtgagcgccgaggggacaaagaggcacccccaccagtactgctgacacccaaggctgtgggaactcctgggggaggtggaggtggagccgtaccagtgtatttcagccatgtccctgctggatgatcttgagccatgagatgccaatggatttgatgtaaactggagcttctcaagtcagctgtgccagtgcatggaactggcagaatctgtgctgccctgtgcccagtggtgtgcaatggctggcatgcagtgtgcatgcatgcatgtggatgtgatgtgctggtgtgtgtggtcctggatggaagtgacctgggccagtgacgatggctgacaagaggagctggccctctcccaagaaccgaagtctgtcctccagaggagcgtcccccgtgggcttcccctgcctcccccacctcccagcagttctgctgtcttccgcctggaccaagttatccacagcaaccctgctggcatccaacaggctctggcccagcttagtagccgtcaagggagtgtaactgcaccaggnggtcatccaaggcacaagcctgggcctccccagnccctcagggcccctctcctaggccccaanccgatangagccccagagggtcacagcggcctcagttctgacgcccactttgaggagccgggccatggtgagaggggtgggtggg

SEQ ID NO: 525024 - DNA, 354 bp, Homo sapiens
tatttctatacgaacgactattccataggttgatatgaggataaccccctaggttttatgccaccttaacgtagcctagactgtcttggagggacagcaatacatacaactaatactactaggacaaagtaggctctattacctaaggccaagttggactacacatatatatagccacctaccagacacacacacacacacacacacacacaactacacagagtaagatatacacctacgaaagccctataaaagtagagaagggatagacagctacctactactagagccctagcgggaccactactacctgctaaatagggatagtacagtcctactttacataaatagggc

SEQ ID NO: 525025 - DNA, 285 bp, Homo sapiens
  misc_feature (18)..(18): n is a, c, g, or t
tctgggatacaggtgtanccactgtgcccagcccagtgtatcattttttaatggcctctaatgaaatcctagttttatcaactctaatttttgtcttttttgcatctctgaaccttctcttttttttaaaggattttgtttttactgtggtatattatacataacattttaccatttttaagtgtatggttcattggcaggaagtatattcacactgttgtgctgccatcaccaccatccatctccagacctttgttatccctaattaagacacccacctgatcg

SEQ ID NO: 525026 - DNA, 737 bp, Homo sapiens
agcgggttttcctctggctcctgcgagggctatggtttagggcttcagctctctgcgttctcggctccgggaggcctcggtgattcagccacagcctctgcctcccggtggctctgtgacctagagggtatcggacaattgagtagctaagactcccggataccctgaagtcagggaactggaactcgtaacattcagggcatgtggccatacgaattctcccctgaagagtggaaactgtctggacccgtgcccagcagaagttagtactagagatgtgatgttggagaatctacaggaagctggtctccctgggtttggtgatctctaagcccagacgctgtgtcacctgtctggagcgaagataaaagagccctgcgaatttgcaagatactatgagacagcagccaaacccccagctatatgtgctcctttcagccaagacctttcaccagtgcaggggatagaagatgcagttccagagaacttatactgggaatagatacgagaaattgtggacatgagaattgacaattacgaaaaggtggtaaacgtgtgaatgagtgtaaggtgcagacaaggagttaataatggacgttgaccagtgcttgtcggctacccagaagcaaaatatttcaatgtaatacatgtggtaaagttgaagtaaatgttcaaattcaaagcaacattagataggaccatactggagagaaacccttacatgtgcagaatgtggc

SEQ ID NO: 525027 - DNA, 228 bp, Homo sapiens
aggtcatgactttcatgaaggggttaaagctggtaagtggcaaatgggaacttcccattttggggaaaagggatttgtcagcaaatgctgttaattaaaaaagatccagattatgcatcccaaatcctaaaatccaaaatggaccaaaatttgaaactatttgagcccccacatgaccctcaaatgttcattggcccataagtataatgcaaatattcccaaatttga

SEQ ID NO: 525028 - DNA, 125 bp, Homo sapiens
tggtgtgtgcgtggtcccagctcccttggaggctgaggtgggagggatcgcttgatcctgggaggttgaggctgcagtgagcaagttaacattttttgttacaggtggatagatacttctcaaga

SEQ ID NO: 525029 - DNA, 158 bp, Homo sapiens
ccacagtaggcacagatacccacagtagggtcgtggatgcaggacgtttacgttgagtagatagaatgcggtagtagttacggatactatcaactgttaaattaagaatggttatgttagggttgtacggtagaactgctattcttcatcctactgtg

SEQ ID NO: 525030 - DNA, 88 bp, Homo sapiens
gatccagaggatccctttctctgatcgctcagtattgtccagagggagtgggtttatacttttaccaaaattataacacaagttcctt

SEQ ID NO: 525031 - DNA, 830 bp, Homo sapiens
  misc_feature (628)..(628): n is a, c, g, or t
  misc_feature (665)..(665): n is a, c, g, or t
gtcaactgtacctggacaccaagcttgggagtttttttcacaattgctagacagaaagttatatcaattacccagacaagctaggcatctcaccattcggtccaaagtatcttccaatcaaagagaattcttatttttcttattacaagagaaaataaaccagactagaaggtaggatagaagacaaatttgtcttttgacaaagtaccacataattcaaacaaaaatctattcagtgtaaatgacagtgagctgccccagtggcacgtctgtccatgctccgctgtgccatctccgtcatgtgtgaagcagcccgtgcttggggatttgtcctgttttttaatgtagaactgaacaaactatagcattttgtcctgtttctcttgtgactatggtcacatgagtttttgctggataagtgagaacctgtgaccacataataaggtttgaaccataatctaggtaacatttgtaccttgatctaaaccaaccataccctgtactctccattactactactgcataagcacataacatcagtggtaaccaattcgcttggaatgattacttacccaaggcaaatgcatgatcaattagttcaagtatcccaaaaccaaccattactcanaaggccaacaaaatttcagtgaccaacaaagcataanaaagggctagaaacaagtaacctctctacacctttttgagggagagaactacttgtccaaatgaatatcacacaggggatctctaacctatccccaaaccctgcaacacgaagtggatgacactcattgttaatactccatcacttttgaccaccacccaccccc

SEQ ID NO: 525032 - DNA, 420 bp, Homo sapiens
cggtctcgccacttcctatgagatcgacccaatatcacaggcacctgttccgcttatccagataaccctatcctataccctctgtctgtcccaaggaaaatgagcccaatcagtacaccaggagtggggctccatatcatcccctaaggtcatgcctgtgtccacggtggaaagtagttgatggaaatgagggaacactcaaagagtacatatgccattttccatgtctaattcaacctctatcacaggaaagaattggccagttttacagatcacccagcacacagcttatacaagcagtttgttacgttgactatgttcttcaaattgccacaattcacaaatattgtcatccgattgctgtgctgtgggaacaacaagtataggcacaagtgtgtggttacgccaatcaatgatgac

SEQ ID NO: 525033 - DNA, 639 bp, Homo sapiens
  misc_feature (280)..(280): n is a, c, g, or t
  misc_feature (565)..(565): n is a, c, g, or t
aaagcaaaagtttatgtttggatgtaaattgaaaatttagttggggattaaaacagaaagtgaggaaatttggggcaaatatttacttaaagtccgtggaagcctgtgggtacaaaaatggttaacggtagaaacggtcgaaaatggggaaggaggactctagtattttaaagggttttggggggggaaaaaaaaaccaatttatttgtataagcggtgcttaattatttggttagggtggtttttttttaactatggtgagtagggtgattgaaactcntgatgcgagtaatgggatgtgtttaggagtgggacttctaagggatttaaggggggtaatgcgtgttgggggctagtgccatcctagttggggggtaggggctaggctggagtggtaaaaggctcagaaaaatcttgcaaagaaaaaaacttctgaggtaataaataggattatcgggtatggaaggcatttttggaaacctggtgtctggtggccttggtatgtgctttctcgtgttacatcgcgccatcattggtatatggttcgtgtgttggttagtaggcntagtatgaggagcggtatggagtgaaagtaaaataacatcgtagcccggacggtcttagaaggctcgagactag

SEQ ID NO: 525034 - DNA, 662 bp, Homo sapiens
  misc_feature (40)..(40): n is a, c, g, or t
  misc_feature (42)..(42): n is a, c, g, or t
  misc_feature (121)..(121): n is a, c, g, or t
  misc_feature (236)..(237): n is a, c, g, or t
  misc_feature (245)..(245): n is a, c, g, or t
  misc_feature (252)..(252): n is a, c, g, or t
  misc_feature (254)..(254): n is a, c, g, or t
  misc_feature (270)..(270): n is a, c, g, or t
  misc_feature (300)..(300): n is a, c, g, or t
  misc_feature (302)..(302): n is a, c, g, or t
  misc_feature (329)..(329): n is a, c, g, or t
  misc_feature (389)..(389): n is a, c, g, or t
  misc_feature (392)..(392): n is a, c, g, or t
  misc_feature (417)..(417): n is a, c, g, or t
  misc_feature (427)..(427): n is a, c, g, or t
  misc_feature (436)..(436): n is a, c, g, or t
  misc_feature (446)..(446): n is a, c, g, or t
  misc_feature (464)..(464): n is a, c, g, or t
  misc_feature (478)..(479): n is a, c, g, or t
  misc_feature (486)..(487): n is a, c, g, or t
  misc_feature (496)..(496): n is a, c, g, or t
  misc_feature (498)..(498): n is a, c, g, or t
  misc_feature (510)..(510): n is a, c, g, or t
  misc_feature (513)..(513): n is a, c, g, or t
ccatttttcccccagcttggtggttccttgccttttatancnccctctccccaaaccccgaactctgtgaagtgcagttcttctccacctaggaccgccagcagagcggggggatctcccnggcccccaccccagttccccaacccactcccttccaacaacaaccagctccaactgactctggtcttgggaggtgaggcttcccaaccacggaagactactttaaatgaaacaannagaaatgnaataatnanatcaggagtcaaaatncatcgtcttcaagcccctctttctagcctntnctactactctctgcttggtcaaggttngtgccccactacagaacagggctaaattagccaccaccactgaaaactcagccgaatttnttnataccactctgatgtcagcatttcntccatctgtnggggctttncctcttttcnccattctccccaaatatnttatctggcttcannaattaannaggattatntnccagactgtccnatncagtgtggccgattcctcatctgattcaggctgtccagtcaggcccctcccataccaggagctggagccttcattatgaacagatactcatctatgaacatggatctcgtgtgtacatcttctattccattcacaaagctgtaacgact

SEQ ID NO: 525035 - DNA, 129 bp, Homo sapiens
gacgggagttcttcccgttctcgaagcaggtacgggagcgggcggaattatccgggaaaatacacagaagaaacgtgattattacagagatcagcgacgagagcgctcgaggtcgtatgaacgcactgg

SEQ ID NO: 525036 - DNA, 1086 bp, Homo sapiens
accatcaaagaccagctagaagcagcggacgcggatcctgcaggccatctatccggtggcaacagtgaagagctccatcaagatccaggagcagctctgcctggtccaggactccaatcgtccatgatgttcctgctatgactaggcagactgtatccctgagtcttcagcagcatccagcgacctgaggctcatgcagtcagttatcgagcaagaggtcaggctgcacgtgactcaagccccagctcggggcgggcccccaactttccagggcagatctcctcttgccctaggtctgcaagctcgagcaccgtgcgtctagagagatcatagtgatgagtatcgaacccgagggtccctaaatgccgatgcagaagcatcacattgctaaatgcgaggatgctcagctggtcctgactcgtggagatgcagacttaggtgtgccctcggttgctaggtcagcgaccagcagcaattgcagctccactgctcaaatgtccttggaattctagatcctacaaggcttgcattcacaccatcgccagtggatgcgcaggcgcagtagcctagacaccattgcccaagacgtttcatgccatcgattcggacacgtcctcgaaggcatgtttgccttgatgccagactccatcgcagcccaatgtatgccccggtgtcctagttgacggcaagtggctatgtcctacaggaaagtacacgcagggacgtggaccggcaaagtcgaagtacacgcccaatgagccagcatcgtgtttcaaacagtgcatgacgcacacctccggtgcaatcaggcatgacatgtgctccctgagtgccccgtccttgctgatgggggcagtgcggtggtgccatcccatggttcctcttgcatgcgaagcagtcgccccctgtttgcctgcaacagtggcccggccagtcagtccaaccgtcaggcgctatcctgcagggttcttgggcaccatcgtcttaggccgtactggacacggtgaccatgtgccccgcgtaggcttcgcggacgggttgccgttcgtgattggcgtttgttgatccccgggagtcacggctgtc

SEQ ID NO: 525037 - DNA, 166 bp, Homo sapiens
atatcccatcgaaagagcatgtacagaggctcccctacggagtccctcacgaaggtatacagacagatggacatccagatggtgagcagcttctccaccacagtctctgtcctgcgcagacatcagattggggttcttggccacatactgggcaaccaggtcactg

SEQ ID NO: 525038 - DNA, 748 bp, Homo sapiens
gctcgacgcttagctgtcggggacggtgatcccggggacccggtgtcggcagccaggtcgccgttgctggctgcctagactccgctagagcatctatgcgtgagtgcatctccatgacagggttggccaggctggtgtccagataggtgatgcctgctgggagctctagtgcctggaatcacggcatgcagcccggatggcctacatgctcaaagtggacaagcaacgatggggggcagagcagatgtatcgcgttcatgacttcttctgtgctgagtagggggcgggtgggaagctctcgtgccccagggccggggggtcctcgtcaagacgtccggaaacccaggaccattgcgatcgatgtaagttctgcctactggctccctgaccggcaggtccttcccacccgtgtagcaggatcttcaagaggcttaggtcgggatgctgcgcaaggtggagtaatggccgagggggctacaccatgggcgaggagatcattgaccttgtgttggaccgaattcgcaagatggcgtgaccagctgtgaccggtcttcagggcttcttggttcgcccacagcttgggcgggggaacacggttctgggttcggctcgcgctggtcatggaacgtctgctcagcgatgtatggcaggaaactgcaagctgacgttctccatttaccggagcccaggttaccacaggctggtgggtgagcccgtacagcttccatgctcagcaagcagagcaacc

SEQ ID NO: 525039 - DNA, 283 bp, Homo sapiens
  misc_feature (19)..(19): n is a, c, g, or t
  misc_feature (53)..(53): n is a, c, g, or t
  misc_feature (63)..(63): n is a, c, g, or t
  misc_feature (65)..(65): n is a, c, g, or t
  misc_feature (90)..(90): n is a, c, g, or t
  misc_feature (232)..(232): n is a, c, g, or t
  misc_feature (265)..(265): n is a, c, g, or t
ggtttcaaccgggaaggancctttgcaaccgagcagcggattgaccggatggncggacgtcancncgccggggcacaccgaacaggccangccggtgggggcaccgatgcgtaccccggctgaaccctggacaatctaccgccatactgcgtcatgtcgccctgacgcgccgccggttttccgctcatctgctcatccttgttttatcgggttatttgtctgctgacaagcnaaaccctaaaaaatttataaaaaaaccttaaantgaaatatctgtcatgcc

SEQ ID NO: 525040 - DNA, 346 bp, Homo sapiens
tcgcacttcagaaacagcgtgcaggggccaagcaatcagaagggtaacaaccttccaaatccacatgttaaaagaccaccctgctccccagatcaggtcccaaggataccgttaagcaccccaagccatatccactttgaatctgctccaacattgggtgtaattatttgacggagagttatattgttaaagtgtaaaaaaaattgtgttataagtgcctattttttttttttttgtagtactattttcatggaaattagtagataaaatttgcctctggtacctgtaaggatggggcccaaaataaatatttagaaaaacaagtaaaaggtcaagatcaatgtgt

SEQ ID NO: 525041 - DNA, 373 bp, Homo sapiens
ttgactgaaacgatgatctgtgatggctgagtttctggcattaatccaatactaaggtaaggtattaaaggcatgttcttagcatccatcctcctatgctttaggcagacccacttgcatcatccacgtgaacactggcctcaggtatggtgctgatttaagggaggttgccacttacagagctctgttgaaagatattcgtaggacaggtctgaagtcagcacaaatcaagtggcatcagtcattaactgtggcatgcactgtgtgacaggtagaagtggaatgagcactggactactttgaggggcagtgacatcatgtgcaaattgcttaagaaaggtgaccaatgtttaagttcaagtgtgtgtgtgag

SEQ ID NO: 525042 - DNA, 318 bp, Homo sapiens
  misc_feature (257)..(257): n is a, c, g, or t
aaccagtcacaaaaggccacattattgtatcattctgtttatataaaatgtccggatttagcgaaatctatgagagacagagggtagatttgtggttgggtaaggctggaagggttggtgggaaatggggagtggctgctaatgaggtatgagattttttgggaggtgatgaaatgttctaaaatagattgttgacctggctcactggctgttgcctgtaatcccaacactttgggaggtcaaagtgggagaatcancttgaggctagaagttcaagacccagcctgggcaataaagtgacaccttctggtctctaca

SEQ ID NO: 525043 - DNA, 370 bp, Homo sapiens
  misc_feature (31)..(31): n is a, c, g, or t
  misc_feature (53)..(53): n is a, c, g, or t
  misc_feature (232)..(232): n is a, c, g, or t
  misc_feature (240)..(240): n is a, c, g, or t
  misc_feature (278)..(278): n is a, c, g, or t
  misc_feature (342)..(342): n is a, c, g, or t
gggatgccgacgtcctccgcgccctcggagncgcactgagaataccgacgggnccttcgtacgtcgagcgctcgatgccgagctctgcgcgcacggccgccgactcgctggacgcgaacaccgagatcggccgggtgtgcgggacgtcggcgagcatcgcccgaggaagacgatcactccgatgtcttcggcgagggcggcatccatgatctctgcggtgaagctgcgccantgcgtggnacggctccgtgccgagcagtaggaagatattgcccgcnttgtcgccggtgatatcgagttcggcgtcgcgcgagcgcattccccgacgcgcccgggtcgcgngggacccattcattcacgggccgacgca

SEQ ID NO: 525044 - DNA, 136 bp, Homo sapiens
tgcacgcttactatcttcaataagcttgcagtgccagcagcatagacagcagtccaacatctgcaccaagcatgttgatgtgggataagagaattctctgctccccacctctaagtgcccgccaatcgaagggtca

SEQ ID NO: 525045 - DNA, 168 bp, Homo sapiens
ctccccgggaacacagttacatcacatcagactgcagtcacctgagctgctaaaccaggagaacactgtgcaacagggcctctccctctacacgtttcatagtccaaagccgtgggagaaaaataatgaagctttacgatatagagtgtctaccatattttaaaagtc

SEQ ID NO: 525046 - DNA, 225 bp, Homo sapiens
gatcctcaatacttgttggtcattgatacattaaatataacctgcttaatgataaaggtgtagctattgttttagaagttgctaaagacaatacagcaatagggttgagagactagtcagagattcttaaacaatagaattaattaaattatagtaatcgtaataataagattgtgttttattcgttcaaagttgaatagtttattaatttattgaatgaacccg

SEQ ID NO: 525047 - DNA, 838 bp, Homo sapiens
  misc_feature (123)..(123): n is a, c, g, or t
aggtgggtggatcacctgagttcaggagttcgagaccagcctggccaacatggtgaaaccctgtctctactaaaaaattacaaaaatttagccgggtgtggtggcaggtgccgttaatcccangctatttgggaggcagaggcaggacaatcgttctgaacccaggaggcagaggtttgcagtgagccgagatcaagccattgcacttcaaacctaggggacaagagcaagacttctctcaaaaaaaaaaaaagggtttacaaaagaaaaaaaaagttcccccgttaatttcccacattgagccaaaaatcctaccttcaagggcattttgcccaagagaattagaacccttttgttcaccacaaacctcttgtactgtgtacgtgttcacaggcaggctttttccatattaggccaaaaagttgggcaaaacaaagcaattatctggccacttggatggacctgggctaattaaaataccggctgggaagcaatgggatcaccgcctacaattcccagcattttgagaggccaaggtggatggctggcttgagggtcagagagtcagagaccagcctgaccaacattagaaaaacccctgtctttactaaaattccaacaatttacgctgggtgtcggtggcattgccccctgtagtccccagctactccgggaaggctggagaccagggagaaatcctctgaaccccgggaggccacaggtctgacttggagccaaagattcgcaccattggcaactcccaggccttggggcacatggagagaaacttctgtctccaagacattacattcaacgcttattcatattatggacactt

SEQ ID NO: 525048 - DNA, 620 bp, Homo sapiens
tcgaggatctctggcaggtggaaatcaggaacggactgctatatggggagcatgccaactttttctgtaaagggccagatagcaaatattataggcttggcaggccatgtggaatctgctgcaactactcaactctgccattataccttgagaacagcccttggataatacacaaatgaatggatgtcgctgtgtgtcaaaagaaaacttcattaacaaaaaaaaagcagcacgtagattgggctctctgccatagttggttgaccctgtacggggtccccaagtcaagccagggctttcatccaggtcgttgtcatttctccactaagttcctttgatatcgacagaaatgcactctatgtttctgtgggtgaactgttataactgtccttcattcatttctaggcacctttgtcaagtccaaatctggtcatgtcactcttagtttaaatttttagaatagctcctgaacaaaatccagactcctctgtgtgaagcacggtagacaaggtctccatgattgggcctctgcctatttgtccaacagcaagtcttacatacctcacccacctaataattgtaccaagctcttgccatctcctgatttccaccttgccagg

SEQ ID NO: 525049 - DNA, 163 bp, Homo sapiens
cgtggccagcgaggtctgttaagacgtctgtacttcatgaagcccataccccccatgattgggatgcattcactctgtcaccttccaggctgctcctagggacaaatgaacatgatgagactggtttctgggagctgagcacccacaactggactcccatccc

SEQ ID NO: 525050 - DNA, 195 bp, Homo sapiens
gaactaggatggacgatgacttgttgcacactgaagagcctcatcatcggtgagagtggggtgggcacgtacagcctgctcttgaagatcacagatgatacctctgatccacaacctgcagcaacaatagacaatgctggaatcacatgaacctgtacatccacagataaagtggtcaagaaactgccgtattag

SEQ ID NO: 525051 - DNA, 273 bp, Homo sapiens
tacatatacgacttcgagtctcggaccggaaggtagctgtactgccacgggatgccgaagcggcccaagcagcagcgcgacgccgagttgatcggggagggagagagccgaccccatcagacaaggtggtgaagaaggggaggagggccaggaggatcaaaaaacgtttcttggaggagctggcagaaaaagataaccgggctgggaaaaaagagaacgtgctcagggaggacgggagccggagcagaagaaacagtaccagcttaccttgcg

SEQ ID NO: 525052 - DNA, 1976 bp, Homo sapiens
gagcgctacgcgtacgcttcactagggcgcgagcaggctctgttatgtccacagctcagttcaaccgaatatcgtatacgggactaagggagatagcagagacgccggcgggccaggaaggaatagttggtaccagcaaaggggcagagacgatggaggatgaatatatagcctggccactgaaatactaggccaggcatgtatcgccctgatacctcgcgtggcgagtaaatgacacctcacgctagaacaagtatagcgtctcagcgaaagaggccgcaggccaagagaagacataagacggactcccccctgcataacccgaggcagcggaggtcgaaacgcataagacgcatacaatgccgtcataaacacgtaggccacgagcgcactgctgctgagtcggtcatgtcagaaagaatgaagtttgcgggacaggaatacttccatgaagaggttaccggaagggcgggaagccatatgaactttcctaatccgcggagtgaccactgtcgtgggtccgcactttatgcgcctaaggctgtggtttcgcgataggaaagtgaggaaagaattccttgtcagggcttatggcgacatctttttctcaaaaaaatcttctggacccgcctagcaaggcgattatctccccattgcaatgacaggactacgccccccatttcggtgaatagacttgctttagaccatgggtaatgagcttcaccgacagaagaaagggcggataaccaccgtcgtggcgttgtggtgggtgcatcgatcttcacggcagaaaggaaaataaaccaccaccatcatcgtttgattggattggaccggcaagtttccccaacacgaccattactatggaaaggcaaggcttccaattcaaggttccaaaggtgggcccttcaaaaaaacgggaacaccagtttcccaaacggcgcaaatggtgtacataccggaaacaccaggggcaagttataaccaagaagggggataccgaagagaaaaggaacggccatgtgtaaacggcttgaaaaatcgaggccaatgccccctaaataaatctagttgacttgaggtatcctttggatgaccggttcactatactatccaagtgcgccaacactaatggaggactcccaaaaggtgccttaaataccaatcgctcgtacagataacggacaacggacaactggaaaatggttaaaaagttgaagtacacagaggtgaaaaccaagtgggacaaacgaccacattttccggcacattcccgagcgaattaaaaggccccataggttggttctcaggaatctgacaacagagcagtcgtaggactagggtggagccaaagttaggacaccatgagctccgaacttgattagtaaccaaaagttcgaaacgctaggacagaaagtttcagatgtgagatctaacacccggtgagcaacgtggtacagagtgccgcgaaaagcaacaagtgggacaatcagcaccaggtacaaagcgggaagacacggcgtcatcaccacaaggagcagaccaacaccaagacatagccccaacgggacaaccacaaggcacactcggcaaaccccagcaccatcgccaacaggagacgacccaacgtgggcaggggacacacaagaagcacacgagaacgaccggagtggaccacgggagccgcacgcagaaacaccacaacacagggacccacaccacaccgacaccgcaccacgagacacacgacagccgacacgcacggcaacaaagagccaccagacagacatgaccgcagcgaccgacacaacaggggcccaccaaaccaaacgccgacaacgtgagacacaccaccgcgcgcaggacaacggtgcccgatgcaacaagcgcccaccacgcagaccacccggtggaacagcacaaccacacagtgacacacaacacgaacaaacgatacagacagacgaaacaaatcg

SEQ ID NO: 525053 - DNA, 357 bp, Homo sapiens
catgcaacgagacctcaataaatataagaaaattgatatatcatatgaaagcactttctcagaccacaatggcatatacactggaaatcaactccaacaaggaaccttcacatatcatgcaacatacatagtcaattacaataaccatgctcctagcatgagcattggagtcaaaaacaaacatcaagatagaaattattagaactgcaataacaataagtgacacaacctcatcaaaacctctgagggtacacgcaaaggccagtgctaaagaggcaaagttcaatagccctcaaatgccgtacatctacaaaagactgtcaagagcacacaattgacattactatggattgtcga

SEQ ID NO: 525054 - DNA, 128 bp, Homo sapiens
ctagaggagcgtggaagcatactgcacagagataccaattctttcaaagaaatggcatctataggtgggaacactccagtgtcacagagtccgttgtgtggcccagaactacgctggaatggaattgc

SEQ ID NO: 525055 - DNA, 390 bp, Homo sapiens
gttggcaacgggagtggctttagcaccccgaccaccctaacatcttgcactgtctgggggctccccgggctcagcaacacccacctctgtggctgggagctgggttcagccacatccctgcaacttctccgggacaccgccatccatgtacgccaagcgtgacggcggctccatgtttcctgccaatggcggtgctattaatttatacagaaagctcacatttgccatcactcccctttacgaatcgcttcaccctctgaccagatcccctcacagtcactttctagaactcattctggtgccagctatctttatggacagaaaactacattttgaaatcaaatcaagtgtgttctattttccatccaaataaatctggagcactttcaa

SEQ ID NO: 525056 - DNA, 493 bp, Homo sapiens
  misc_feature (150)..(150): n is a, c, g, or t
cttatctctgacctctgggcttgaaccaatgacgcaaaagagggtgtgtgcctgcagcatgttctccttttcggggtctcttgacgtggcttgatgtctctgagaccatttatgtgtggagccaggtgccccttccctgtctagtttctnccgggtcagagaaagttttctggggaaaaggactgggaaggagagggcacccaggtgaggaagagaaagctgttctgggtttgggagttgacccaggtggcactttctccttggactgattctgcaggtgcagtgggactacatgtcttctgagactgtaagatgttcttttggggactgggattgctgcctgccttccccgagacgtgtgtgtgtgtgtgtgtgtgtgtgtgtgtgtgtgtgtgtgtgtccaacatgtgtgcagctggggccttaacccccttctttcccatcctactgttctcccactgaaagaggcagctaggttctaaagtgatccatc

SEQ ID NO: 525057 - DNA, 174 bp, Homo sapiens
ttcatgaagtcggagagtgaagaaatatgaacaggattcatcaagaactgtttcctcagccccaaggatcgcgtggggatgtttgaggcaaggccggcatgtttctgtggtatcccaatcacagacacaggccggatggggagccgcttggtggagtggtatagggtggtatag

SEQ ID NO: 525058 - DNA, 1050 bp, Homo sapiens
gatgtaggatagaatattgacatcagcatattggagataacagatcaatcgttcatatgatccgtgagttcttgccctgcactggatagaatagtgattggcgatttgcacacggtaaaaggtcagataggatgtgaacagtgccagatgtctatgaatctccattgaaagcacgctagaagtacgtatgttgacaccgttagagagataggggcggtgaacatcagtaagtacaaaagaactcgaaggtgatgcagtatacagtaggaggagcaagtgacatgtgaggtgtccccctagctgtattcatagagacatctcggtagcctagtgtggagttccgagtgagattcacgagtcatacgtaactatccaagagtttccctgtgaacaacgccgcgtacttccttctctaagaaaatttagaacagtattgtggtgagctatttggaaggaggtatgtggggatggtgttaaatgtgggtgaagtgactctttatgggagaagaatgattggttgaaggtcggcgaacaatttagtggccgtgttctaaggatcgaggtgtacattgtaaggaaggaaagaaaaaaagcaaacagttaagcaaacggagatggaagaggcaatacggcctggacgggacctaagcgcaaaaaagaagaacagtggcgagcgaaaacccaagacggaaggacaagagcaagacaaccaagaaagggagcaaaacaagaggaaggaacggaaacacggaaggcgtccacctgaaggaccgcaccgagcgaacaaaagaaacggcccgagaaggcacgaagggcggacaaaaacgaaacgaggaggaagaaacacagaaggacagaaggaaagaataaagaaggaaagaacgcacgaagaaaagaaaaaggaggaagcagaagaaagaaggtaacaacagagcgaaagccagaaaacaagatggtaccagcagacacatgcgaacagggcggcagcagacgacaagagaggcaccggagaaaaaacgacaacggacagcaaaaaacgaggaggagaac

SEQ ID NO: 525059 - DNA, 117 bp, Homo sapiens
  misc_feature (11)..(11): n is a, c, g, or t
  misc_feature (21)..(21): n is a, c, g, or t
  misc_feature (73)..(73): n is a, c, g, or t
tggacaggagngaattattgntgagtattagaggggggcagcacatggagcctcatgagtgcaggccgcactntcagagccagcatggatgtcatacccagacactgatgagccgtt

SEQ ID NO: 525060 - DNA, 292 bp, Homo sapiens
gttccttcagagctgtccagttccaactgttagttggcataaagatggcaaagaagttaaagcaagtgatagattaacactgagatgatcacatctctgcacaccttgaggttccaagagtgtccgtgcagatgccggaatttataccattacactagagataagctcgctcagcacagcctcatcatgtcaagtcataggcctacctgaccatgcaagtattaagcagtacatacaggtctgtagtactgggactcagattgatgtgacccattctcatatgcctggccag

SEQ ID NO: 525061 - DNA, 1729 bp, Homo sapiens
  misc_feature (24)..(24): n is a, c, g, or t
aagcagtggtaatcaacgcagagntgccattacggccggggcaggcagactcatgacggtcaggggtccacagcaccatcctaggccaaccatggccagaaacacccaacccacctaccacaaaaccacacacacactacaagcccggcgcaagcagcccggccaacacacaccccggactcaccaacgcacacacccacaaaccacaccacgaggacaaacaagaacgaaacagcacacacagagaacacaacaacacccacaacgcacacccctgcgcaccataccacgactcaccggacgcacccaagagaacacacaaatgcgcaagaggcggactcgacaccaacagcgaaaggcacagcaaaagagcaggcaggaacgtgaccgacacgacagccaacaccagcccgaaaagacacaataagcgtcaccgagctgagcaccgcggcgacgcaggacaacacgagcgcgagcagagacgtaaccacagtagcacaacaagagacgccagcaagacacagaggctacacacgcagcggacagcaacagcagacgccccagcgagagaacaccgcgaagaagaaaggagaaagcgagaaaacacacaacgcagagaagaagcgcacggacagcgcacaagagacgactacaacaaaacgcgaaagggagcgcacgagtgcagcacagaggagcagcaaacaaaacaaggagtacagcgagcgaccaacaacgcgaacaaccaagcggcacgaacacacagcgcacagcgacagcagagagaggagcgaggcagggagacggaaggaggatgcgggcgaacgagagcgggcgggggacagagagagaatagggagagagagacgccggaccggggcgcgcgagccggggggaagggagagagggggagacagggggaaggggacgcggcgaggagagcaaggaggacagggcgcggcgcggaggcgggacgagggagagtcgaagggcaacagcgcggaggagggcacgcgggaggaggggaggggccacaccaaggaggaaacgggaagagacaagaggagaggacggagaaagacggaaggaaggggagaaaacagagacagaggagacagaggagaaacgagagaggcgacggcgagcagagagagagaaagcacacaacgagaggcacgaggacacagaagaacgaacaccggcacgccagaaggagacgcacagagaccagaggggcgacaagaagagcaggaagcacgaacgcggaggtgcaaacgggacggcgcagcgaggagaggcgacgaacagcgagagaggacagcagacgacgagggagcagcggccgcaggacagggagaggaggggaaagcggaggaaggcgcgaagacgggagcgggagcgaggaggcaggaacggccggcggggagacagcagccgaacagccgaacgcccgcgcgggcacaccgacgcacgcaagcgacaaggcaggccgcgccgccaaacaagtatcacacagcgccgaccagccgacccacgcacggcccggacgcacaccgacgagcacgggagcactcgccatgacgactgtgagaccgaccgacggcgaccgcaacgggagcccggaccggaacgggaagagagaagcagagaagcgacgcaggcaacacacaacgagacacaacgcacgatcgaaacaggaaagaacgaccaggacgacgacacacgacaagga

SEQ ID NO: 525062 - DNA, 104 bp, Homo sapiens
ggggggccccccccccccccccttttttaaccaggggttcttgggccggggaaattttgccggctttgggatttttaaccctttaaataaattgggaaagggga

SEQ ID NO: 525063 - DNA, 224 bp, Homo sapiens
taacaattattaatattttttattgtaaaagccatcagacttttaaatgaattttaaaatttttcaatattatttaatgaaaaagtctcacactgttatgttttggatttttcaacattttctacttatttggcatgttaggaaaaacattattttttcacgcttgggaaaatcttaaacccatttttagtggatgtccggcattaatttaaaggggtgttttt

SEQ ID NO: 525064 - DNA, 171 bp, Homo sapiens
tgcacacgccgaagtccatacgcacacgccgagtcttttactttttttaacctttccttatgtagcatgcctgtgtgggcgttcggcgtgtgctgtatggagcttcggcgtgtgcagcaacaacttcgtccatcgcgacatgaagaagtgtgtgggccctcggcgtgtgca

SEQ ID NO: 525065 - DNA, 1446 bp, Homo sapiens
  misc_feature (507)..(507): n is a, c, g, or t
aaggatccccgaatgaaccgggaagtacacgacacacaatgatcttgacgctgtgtgctgcgtttctcagttgctcgtgttgttgttcattggattacccgcaatcctgttggttccatcttggcctcacgaattctttacgcgggacaatgtaatggcaactcattgtagcacgactcctggatagaatacgtgctgactcgacggatatcaggtgagtgatcatggtcaagccgctgttctacagagtgtatggaaatgtgcaacctatcactctcccgtatctagtctcaactgacaaaagtatcttgatgacgcgcttctgtacatttgtacccctaattctcgaggtacctgtgtgcacacttgtaccctctctgtctctctgtgcatctatagaacttcgcggagacggggtggcatttacatggtgctactacaacctatactagagcacgtccacgacgggcacattacaaggcgcaggagtttctccctacatgggcnacgccagcaatagtagtctcataccgttagtgggttgagtgcccccagttgcacacagaccttagccatgtactcgggcgcactcttagggcgcgggtcgagaattttgtggtccccactgactgctgggcaggttgtgtacattactcaggaagcatactatcgtcgccataaagccctacggtcccgttcctgcgctcacacggtccaacgtattgcacgcacttaaccgttttattggccctccctttatttttgagcaccacagcgcaggaacgtgggcattggcggtttctaatgctctacatagtttcgcacagaaatggtccctcggttttaacccaaagtggacccatggatgattgtcccggtcgagatgggttacctgagttattttgagcttagattcacgcatggttccgtagtagttccacccttccttgttatactacgtggttcacgggagaatctcacgcggctgaggaaggcgctttaacgtcacgcagaccaaaggaccccttaagaagctttgctaaggacttatggactaacggggcccaacggcttctggaacaaacttcttttcactttgtgggcgtgacacgaagcattgtcgttcacagccattgctctaatggggagaagacacacacatattcggaggcacatttggacgatatatcctctaacgacgtctattagcgctttgagcgatcactcttacacggcgctcacttgtgatatgcagtcactttgcgcgatccgatactatgcgccctgtgtaacctcctagtgggcaaggattcgtataggttcatcctgatagctgtgctacagaacatgtgaagtgaacaccgaatatcggggtcgtaccgacatggtgaattcttcccgaacagagttaccccaaccctatggagtgtcgcatcacgagtgtac

SEQ ID NO: 525066 - DNA, 333 bp, Homo sapiens
ctatatactatgattccttttactcagcacatcatgttcagctatacaagagaaaacgacaaggcacactaaagggccaaacaacatagttggaagagacagcaagcatcagaaccagatttagatatggcaagaatgatggaattactagaccaggaatttaaaacaactatgattaatatgctaaggcctctaatggaaaaaacagacaacatgcaagaaatgagaggtaatgtaagaagagagatggaaattctaaaaagagaataaaaatgaaatgctagaaatcaaaaacagctgcaacaaaaataatgtctgggatgggcttagtag

SEQ ID NO: 525067 - DNA, 365 bp, Homo sapiens
cgaccccttccccacagtgagtatatggtacctgccccttccctgcagccacgcagatgtatatcagtgtatgtgtgcacttccttatgtgatgcacttaggcacgcatagctttcagcgttctctgcctgtctcgctctgcatgtgcttctcgcgctccatatcattaattgctccatatcatatcattgatttgatatggggggacaggagggctacctgatggaatagctgtctcttacagcagatccttgttgtagactattggggagagtctcataacagtgacctcatcgacttgcgtctcgggtggtattgtatcagcacgcgacttttatagaaagtataccccgttaaagcccctt

SEQ ID NO: 525068 - DNA, 283 bp, Homo sapiens
ccccggggacgcctttattggctttcggccttggcaacgcccgttttcatggttaatggcccctaggggccaaaggccgaggccgcgcctgccccccggggggggttcctggttggccgggcccaggcggggggggacccggaggccgggcatccttttccagctcccccccccccttgcctttgggggggcgacaaacaatcgctccggggtcaggggtgggcggcttttcccttcattccatgggcccttttttgggcccaaaaaagggttttacccctta

SEQ ID NO: 525069 - DNA, 868 bp, Homo sapiens
gtggaagagctgaacatggggcagcccctggcgaggttggggcaggacgggcagggactgagattgcagtctcatcttccctccccttctattgccccagtaatctccatgcaccccgagggaggcatgagccggtgatcagtgccccgatgggcagcatggctgtgggtgttccgttggattcagtggagatgcattccgttcctgcaatgtcctaatttgtgtgggtggaagagtggcaggcgggcatgaatggtgggcacagtcttgggcagtgcggttggtcttggcgttagactttgcctgggagttagcacccagggctctgctcctgttccccgcagaagggcctgtactcacttgtcctccagcctcctacggagacttgcagttagttgatgctgaaagttgcctcccctgtgagggctaggaatgaaaagctatagagcaccttgttctctgagatcttaggcaaagcccatggcgctttagaggaacgaccacttggcctggcgagtcttaacagacctgttccctagtcttggattactgcatgtcggctctactgtgtcaccttgggagcagagtctcgtcaatcctccggcatgtctcagcggatttgcttccattcgtgtcagacacagcggcaggcaccaaggaggactgggcaatggtccacggcctcccttccgacgcaggattggcatggctgcaagcgcatccgcagacatggtggggcattacgggaaagcaccatggcgacgaacacagcacgaggcacaaggggcccagacacatacaagggcgccagacagagtgaagcacaagagggcaccacgacgtggcacgccgggcgaagcacagcgcg

SEQ ID NO: 525070 - DNA, 837 bp, Homo sapiens
aatcatgtcttcactgtaactgaccccaggaagcattctgtattaaccaacgaaacactctcgagagtgcgagacaaaatagtagatgattacaggctaggaattgttcctcctggtcttacagaatatgaatcgtgtagagcagaggacatctatgattacagcttttcatcctgtacactggtgagaaagatgattttgataggaagaatgtcagcccccagagttaacccatgaacatgaccatacgagtaggttgtatgtatgacgtatatacaggactacagccggctgtgctgttctggcagctggattgaaccagtccttcaatgccgtcgtgcaattacggccaacagaagtggacgacagcacccctcactgtcaatgagttgggaacgagcttacgtttctgcaacaactggtgccgatagcaacagctctaggactcaatgcattgaccaagcatgtctcaccactgataggacgtctgttccctttgctgccgtagctgctgctaattgcattaatattccattaatgaggcaaagggaactcaaagttggcattcccgtcacggatgagaatgggaaccgcgttgggggagtcggcgaacgctgtgaaacaagccatgcacggccaagtcgtcgtgtccaggattctcatggcagccctggcatggcatccctccattcattatgacactttggaaagaaagccttttgaagaggtcccatggatgagtgcccatcagttggctaaacggccccgagggttcgcaaccccgtgttgtgcccgttccccaaaagtccgtctgtaccgttggagcgttgcagaaaa

SEQ ID NO: 525071 - DNA, 126 bp, Homo sapiens
catatttaccacacaactcacgccacacaccacacactacataccacatacatcacacacaccacatacaatacacacaagcattccaatttctctacatcctcagacaaggagatccctctatga

SEQ ID NO: 525072 - DNA, 3774 bp, Homo sapiens
ggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctactgcactccagcctgggtgacagagtgagaccctgtctaaaaataaataaataaataaaaaatgggggcagcaaaccagagactagaaaccatttcatatttgactagaaatatgcagcgatggtcgctgaggaaggtctgatgatgctggtacttctgcctacgcacacaatacagagaactatattaatccacatgtaaaagtgaaccctgtaaatatctcttgtctgaagtcctaagccaaaaggaattttcttgtaaccactaaaggatttttcttgtaatcttttacattgacataattttctagtatttattaaatccccatctgccaatggcagatccacttttaaaggagaaaagtacaagaggaaaaatcttttcaggaaagttacattaggtagtaaaattaaagtattaaaaattatatataaattcttccagctcatcacatcccatatagatggcaatcacatagtgttcacattctatacgttgaccatagctaaagtaaactgcaggtgtcctctttttacaaagaaatgttcttcacagaagtgcaatgtacatatttgattttcctacaccattagaaatgattctgcaaagcattctcagaagaattctatgcatatggatgagacagaatgagaagagtataatatgggtaaaaagtcaattaaatatattgaacactgaaaccgtattaatagtttggggtcaaaatcggagcagctattgcgtggagtttataaggaaccgtcctgggtccaatctccctccatattttctattaatagctctgaggatcctatgacaaatgcactaatcaatccacagaaaatgcagctctgggaaacattgctaatgctttggatgacaatattaaaattcaggacgatcttgttaaattgaagaaatgagccaaaatcaatagagcagcacacgcagttctgccaggtgttccacattgcaggatacagggagccctcgaacggaaaggaagaccagcctggtaggcgaaactccagctggtaaagctatccaactcctgttctccctctccctccctgacagccacaaggatatccagacaggtgtttagggctgtcatctacacatgatttaactccactgcctacagcttctcaactctttcccccagagcccagcagtgagggaagagagatgatgaatttcctttaatataagttgtagggcccacactgatgaatttagactttagaacatcacattagaagcaaaaaaaaaaaaattaggaaacaactaaagatttctaagtaggagtataatgacctcttcctaaggagtgtcataatatcttcctgacatttaaaaacatggtctctattgagaaaggggtaaggggagatgaagatgagggttctttaacaactcatttagctacccaaactctgagaaacctgagactttaagaaacttaaattcatcttttctttcagctacaacccttatccagagtcatccttaattacacttactttcttgtccccagttagcaagtcaataaacaagccctgccgctttcaccttctaagcagttttctgacctgcactctcttctccatcctctcccccgctgtcctagctgaagtcttcatcattctttacccagactgatacagaagccttggggggcctctctgcttctctattcctttagagccctccttcacaatgttgccaatgtgatccagaatgaaaacacaaatctaaccttgagttttccctgtttaaacatttcaataccttcagtgctcacagaatggggtttaggttttccaaggtggcatgcaaatttctgtggtggttttctaccaggagcaccatgagcacgcagtatgcggggcatttcttcatgtctcattggtaagcactgtgtgggggcatttctagatgtctcagtgtctgggtggcgctactggcccttcatgcccagggcctagggatactaagcatcctgcagtaatcaagacaactcacacaatgaactgtcccacctgaatttccagaggtaacaccattgggaaagggtcctcaccgttcctgctcatttctatatccttctagctcacttttctgcactgcagctacataactcttcttccgcaacacaagccatgcttatttcttgcatttataccttaattcttgctctatgtgtctttattaattctgatacctggaaagactcatcactttactgattcatagtttaagcttctgctctggtgtcatttcccaagaagcatctaacgcacatggtctgacttagatgcttcttcctgataaggcagtagtgctttcttattgtgatatgctctgtgctcagcagtttgctttaaaaccattagtgttctcctttactaaggttcattgggcagaaactgtaggcacttagtaggccttatatagacctatgaatttaaagaatggaaggaaggatggatggatgcatggatggaaggaaggaaggaaggaaggaaggaaggaaggaaggaaggaaggaaggaaggtaggaaggtaggaaggatggaaggatggaagaatggatgggtggatgggtgggtgaatgaatggttgggtgagaggaaaaacttctctgaggctgttttagtccaggtgcccataaaataatacaagcattattttatagctcaggcaacagttgaggtcaaagtttcggatcaggtcatctgtctttagttccagcattctatgatgtacaagtcactctatatccctcatcttcagtcactaaatacctctataaaatgtgccaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcattc

SEQ ID NO: 525073 - DNA, 435 bp, Homo sapiens
gtggacgaggtgataatcagcaaggagtacgtagtgtaggatgaagctccgcttccaacactcagacaatgtcttcgaccttgccgccgagcgagaacgattccctgtaactatcctggatcctgagtgatgcggagcgcgctgactcaggaagagtgacggcagtggcagtaacgaggatgaggaggatagtcaggatgcagaggaggaggaggaggccgatgaggaagatgatcaggaggatgatgaaggtgaagggggagatgaagacgatgacgaaggatggctctgagatggaattggatgaggattatcctgatatgaacgcttctccctatgaaccgatttgagcgcatagaacggaaaaatgctctcatcattgagtaggacaaacaatgagctccagagaaacagacatccccccatccaccaagg

SEQ ID NO: 525074 - DNA, 685 bp, Homo sapiens
ggggagacaaagacagacgcccgtctgcttcgggcctctggaatttagtcgctcgcccagactagactcagcaggaaattgactgcatgtccatgcagtgcaaacagtaaacattcaagagtgggatcctagaaagtctagagatcaggtactctgagcagatatgatgagacatgttgggagcctcttgattacagcaggttacaacccttgtaagaacacctagattcagtccacacaggagccctcctcaattaagtcacagcagcaggtccgttcgtcatacgacaggccgcactgtgtttaggcttgcgtatcgtcgtttcgaaccacagcgaacgtgcagaatgttgctttgggcagaccggcgggactaaacatctggcggcaacggagcagcccacgtcttcgtcaacggtagggcagccttgtcgggcttgcggtgttcacgcaacaatgtacccgtgcgacgcacaggctggcacctcgactcgaacgtgctagcatcgaaagcgaagaagtcatcgacaaagagtgcaatacctctggctcgtccttgtcgaatggccgagaggcaacatatggcgttcggggggcaatgcatccgcacgacatttaggctccctcctggcttgtgaagccacgggtcggctgggcatcttgcggcattggacaattgggcgag

SEQ ID NO: 525075 - DNA, 677 bp, Homo sapiens
aacatctagtagtagagaatatctggaagagagtgagaaccatgcacaacgcatgaccagccacatgcgatgtccagggactgcgtccataactctggtggaacgaatggatgaagaattaccaaaataatgcaaaatactgaccctcacacccaagagtacgtggagcactatgaaggatgaggcccaggagtgtgccatcatcgagcgtgatgcagcgcataccatggaggagaagggcaactaccgaggaggctctgccgaaatcataccgtgacatgcgcagtcctgacacacacatacatacaagtagcatacaaggcccactcagcagacagcatgaccccgacctgagggctcctcaaagtctgagcaagaccaggcagaaaatgagggcgaggactcggctgagatgatggagagacatgtgcaagataacatctacaccaaggaccgcaaaagaccaggatccgaaaaatgtgccatacatcggaccacatcatacacaacatgacctgacacatcgcgctggtaccaggaccgcaaacatcatggctcatgagaccacatagacaggacaacaatcagcatgacagaaccgaacaaagcagatcctataaaaaccgcaaccatggtgcagaggggcaatcatgtgcacatcacgacagggcagaaca

SEQ ID NO: 525076 - DNA, 93 bp, Homo sapiens
  misc_feature (65)..(65): n is a, c, g, or t
gatcctctagagtcgaaggtctctggagggacaaactcactcagtaaaacataatgtatcatgangaaaactgattctttatgacatgaaatg

SEQ ID NO: 525077 - DNA, 151 bp, Homo sapiens
gcacttcaggttctagaccctttaagtcatcaaggtaaatatcatcaggtccctggtgttggcttcttttgtgaacacctttcttctttgacggcgagtctacttatagctgccggtttggatgtgcagagggcgcctccgctaaggctgc

SEQ ID NO: 525078 - DNA, 1100 bp, Homo sapiens
cgggagctgagccagtgcttgactcgggtacagaacgaggcaccagtccccttgctgaacctgaagtggcctcgcagtggatgtgagtgatggcccatgccctgagtgtcaactgccaaccacgtgctagcctggcactgtgtggcctacatgtggtgtgtgtatggctgtggctgttgccgcagcctgtccaaggtgccttccctcatgtgtccctgtgtgctgatgtgtgtgccatactagctgctgtgacctgtgcaagcaatggccctgacatctggaaccctcagtgtgaccaaagaagccccacacctgatctgagaatgctgtgatcactttaccatgtggcccataagtgccatgtagacatacgtgcctggggccattgggggccttcaccaatctggagagcctgtgacatacgtgactgatgtggccccctgcggtgatgtgacacccatagtgtacgtacacgatgaacacccatatattcctcaatgatgccaagagaccaaggcaccagacccaacggagcacacagggaattcgcccacagactagttaggcgcaccataggacgcaaaggtgagctggcccacatgcaccatacacaccctttattgtctggatgtgcccccattctcatgtggtggcccaatggccatggccacaagaacagagttggagacttggagctacgaacaatggagcactccagtaggagtaggttcggccgagcatggaggtcaaccataacgttcgccgacattcacgtaaacagccagtcgggacgttccatttccctctgttcatcaggacaccatgggttgtgcgaaccaaccagaactgagatgaacattggcccccttgggagcaagtggtagcagacagcagcccactggatgagccatatacagacagttcaagtattatacccccagttaccagctcaaaaagacaatcatacggatggctgatacgtcctttagagggacgagccacatttgagaatccacaagacacccaatttgcggcaggcacctttggaaatcaggtgcatcgccacgcgacagactaaggaatacgttgagggaggaacc

SEQ ID NO: 525079 - DNA, 1214 bp, Homo sapiens
gagaccagccctcgtggcttggagagtgaatctggtttacaccggctccgtgccgtgccgttcactcttctcccctgattcaagactcctctgctttggactgaagcactgcaggagttgttgaccaagaacttcaagagtcaagaccagaaggaagccaagggagcagtgcaatggcatttctcgagtaacaggtcagcacatcagcagcacaggcaggtgcaccttgccccaatctgcctggcagctcctgacagaacctctgagcctagattgtgggccaacagctttctgcccaagccttgcatcactgcaaagcatccacaggagtcagtgatcatctccaagaggggaccagcagcttgtcctgttgtgtcaggaccagattcccaagctgggaacctccgacctaaatcgggcatctgggcaacatcagttggacgagccgtcaaagacggtcaccgatgagcccaccaggagcgggcagacaggagcgcatgtctggtgagacaccaacgggaaaacaaaacttccaggatctttctggtaacaggacggatgggcaacaacggtccattttgcatgggggatagtcgaacggtggtggtccagggacacaacccaatggtcacccaaaactattcccgggatcaaacgaggtgggtacacacgggaagttggtccactggcaacaaccgcttggaagggtaaagccctggccaagacggccgtgacaaacagggacgacttcaaccgaaggggttggagaacagccttgcgccggcattgggcctcaagaaccacaggacgggaacacccggtcggtggacagaaaatgatattcgccacagctatcgacgaacaaccgactacgattctggcaccacggggtccacagcacacagcaccccaggacaccatggggaccaaaggtgaggggccacaaccagaggctgggcacaagccggaccggcaagcggcaagggcaagcgtagcagggaacacacggcgggcgcgcacacgaccaagggtcgacagggaagcagcacacaaagacaacacagcacaatctaaacagcaagcgacggaggagctgaaaacacacgggagacgaagacagcacacacagaaagagagcaagacaacacaaccaagcaaaccacgtgcacaaaccgcaccacgacaccaagagagacacacgcgacggcaaccac

SEQ ID NO: 525080 - DNA, 138 bp, Homo sapiens
gtgagctgtggttagacgtcgggagacaggttagcttataaccctactgatgatgtgttgttgccatgggtactccgtgctcagtacgagaggaaccgcaggttacagaccatttggtgtatctagctcggcgagcct

SEQ ID NO: 525081 - DNA, 1204 bp, Homo sapiens
tggctgcccggacgcggagcgaaaggctgaaaaagtcggaaacactatccgtttccatccgtcgcgcaaaccctgccggacccgctgccgctagtggatgactcgagaggatctgtgggtgtaccaggcgaagctgtggccgagcaggctgagcgattacgacgaaatgtgggtggagctcaagtgaagaaagtaccacgggatggcatgtgcgacctgcacagttgaagaaagaaacctcctatctgtgtgcatataagaatgtgatgggagctagaagagcctccgtggagaaataatcagcagctttgaccagaagcgaagaaaccagagggaggagaagacaacgctaaaaatgatccgggaatatcggcaaaatggttgagcactgagctaaagtaaacctggtggtagacattctgggatcgtcactgggacaaacacctcattccacgcgagctaaccacttggcagaagccccaagggtatcacatataatacaaatgacaagggggactaccacaggtatctcggcagaacttgggccacacggaaacacgacagggacaggagggctcgcggaaaaaccacgccataaggggcctatataaagcgctcgaagcagaatatggacatgtgcccagacacttcacaccagggcaatccatatccagacacaagagccaggcccatcaaacaacacccgaacaccacccacccaaacagactctataaactatcccctcttgaaacccgagcgccattgccactgtttggcacaaacaacgacaagcgattcagtgaatgaatagcaaatgccggccacaaacctgggcaacacccgacgaggaacgtggcaaccaacacagctaactaagggcgcctttctcaccactaataatccatatgcacagataaagactacccgtttataatataagccttgacccccaccatcatgcgccctcactccgcaaacctttacacccggtgcatagtccggcagtcacaacaacaacccactatataaacacacaaccgactcttctactgcgacacacctttcacaacaatcacccacaccagctcctagtccgacaaccacattacatgccacaaacagcaacacaacaccccatgctacttgtaacaccaccccacatctctaccaacatacaaccccctattggaacaacctccacat

SEQ ID NO: 525082 - DNA, 223 bp, Homo sapiens
tcgtctttaactgcggtgtgggtcatatcgacctgccgcgcgccaaaaagggcggacggcaggaggacgtgcgcgatttacgttccgacgccatcgccgcagaagaatgccaatggcgttacaacacgccggatatggaaagcgcgctcagtaccaccctggccatggccgcgcttctgacacggatcgaacgtcaggcggaggaccggctgcgcatttgccg

SEQ ID NO: 525083 - DNA, 169 bp, Homo sapiens
tactgctgtcagtgacaggctggttgagtgggctggtgtgtgacccagtgccatcatggagctgggatgccacctgagttctacaaagaccttgtacctgccctgtgccctatcctgtacctggccgtccagtggtggcaccatgatactccacgccatgtgctgtgac

SEQ ID NO: 525084 - DNA, 248 bp, Homo sapiens
ccacagtgctggctgcacatttgactgcatcgtccctatgatggaggctgtcccagaaggagattggtcctgtactgtctgtttggctcagcaggtggagggagaattcactcagaagccctggtttcccaaagcgtggccagagagcggaacaagtggttattacgctgaacttctcagcagggtgataggcctgccgaacgccgatctacttgttagagatggcctgagaaacgtcccagctagca

SEQ ID NO: 525085 - DNA, 682 bp, Homo sapiens
gaaatgtttttttaaggtcgttagattcgttagacatagtataactaaggtaggctagtgtcgcttttgaatactttcaggaattgtaatagccaggaacaagaaaaaagacatgcgcacactaataagctacaaaaaccaacatatttatagtatcaaccgagagaggggcagatatgattcacgataaaaagttaataaaaggataacagcggcgctctaattcgttaatgaaaaccatagtccggtatggacaaaaactatttccttctttttttttttttaggtttttttttaatttgcacttgcaataatctaattcactgtaggagtttaaaaaaaaacatctagaaggattggaggaggtaagccattattatggcggtgctcttttagcgggaaaaaaaaaaaatacacctacgacgttaaaacagatcgtgctgtcgtctcagcggcagtaaaagtactgtagtagttacggagcacgcagatgcaatgctaattaaataatcatgctcccatttttaagaagcagaaaaaggccgcagtaatttgagccgtgaaaagatttcggagggttgattcttaacattttccaaaaaaatgtcctttggtctgtttgcttgggtctgaaaagaaggactgcagcgccacctccgctggttaaggacaaaatccatac

SEQ ID NO: 525086 - DNA, 864 bp, Homo sapiens
gctagaggatcattactggattgcagtcaggccataaggccccagcatccctgtatgatatctacctcaggatgactggaagaggcccaatggatgatgcaaacaataactgccgctcgttccgacaaagtctcagtggtcgtggctctggaatatatgccacaagtcacattctctggtggttcttgggacacctcacgtggcatgagatgtcacaagattgtttacatcgacatccaaagctagaaccgcgtagagaggatgcacacagatctgtcagatcattgattgtgcccggcagacgtgagcattggggtccccaataatctaagacgaacatcactgcttgggcatctcacgagagtcacgatattgcaatcgacgaaggtggtttgggtcgtgcctgcgagtcagaaacacctaattcttgcttgcaaggattggcggtagactagtaacaggtctgttggcttttgcactttaccatagttcctggttcgaatacgcatcgagtcgtggccgccactctagccatagggaagggatacacaagaaactgggcataattacaaatactcgtgcgtacctaatgatgcgtagcaggtcttggtggtaagaccaaccttgattgtgagcgataagggtctcgaacgccagttgcgatggccacctcattagaggaagtgagctcgagcaagacgctagatgcgatgtccacgactattctcaagacccgatgctcattaacctagtggggttgactcttacacaatgttctagaccgactgaaacccctgttatcccttgtcactctgcgaaaactgtggtaaagagaattcaaaccaacaaaagatcggagttgag

SEQ ID NO: 525087 - DNA, 418 bp, Homo sapiens
gttaataaatcctcaagtctagctggtttctaggtttcttttttcctgagccaaatgtatttccttattatttaagatagtctgaatttttgttgctttgttattgttgttctcacttaaacaaaccacctctgatatggtttggatgttttgagccctccaaatctcatgttgaaatgtgattcccagtgttggagtgagttctcactctgagttcatccaagagctggttgttgaaaagatcctggcatctgttttgttccttctcttgccatgagacacactggctccttttcaaattttgctatgattgtaagcttcctgaggctgccaaccagaagctaagcagatgctgttactttgcttgtgaagtctgcagaatgatgagacaaataaacctcttttctttctgaaaaaa

SEQ ID NO: 525088 - DNA, 913 bp, Homo sapiens
  misc_feature (2)..(2): n is a, c, g, or t
  misc_feature (48)..(48): n is a, c, g, or t
  misc_feature (73)..(73): n is a, c, g, or t
  misc_feature (83)..(83): n is a, c, g, or t
  misc_feature (86)..(86): n is a, c, g, or t
  misc_feature (156)..(156): n is a, c, g, or t
  misc_feature (201)..(201): n is a, c, g, or t
  misc_feature (212)..(212): n is a, c, g, or t
  misc_feature (216)..(216): n is a, c, g, or t
  misc_feature (247)..(247): n is a, c, g, or t
  misc_feature (295)..(295): n is a, c, g, or t
  misc_feature (331)..(331): n is a, c, g, or t
  misc_feature (351)..(351): n is a, c, g, or t
  misc_feature (368)..(368): n is a, c, g, or t
  misc_feature (378)..(378): n is a, c, g, or t
  misc_feature (381)..(381): n is a, c, g, or t
  misc_feature (385)..(385): n is a, c, g, or t
  misc_feature (392)..(392): n is a, c, g, or t
  misc_feature (406)..(406): n is a, c, g, or t
  misc_feature (424)..(425): n is a, c, g, or t
  misc_feature (438)..(439): n is a, c, g, or t
  misc_feature (450)..(450): n is a, c, g, or t
  misc_feature (459)..(459): n is a, c, g, or t
  misc_feature (476)..(476): n is a, c, g, or t
  misc_feature (481)..(481): n is a, c, g, or t
  misc_feature (535)..(535): n is a, c, g, or t
  misc_feature (543)..(543): n is a, c, g, or t
  misc_feature (553)..(553): n is a, c, g, or t
  misc_feature (571)..(571): n is a, c, g, or t
  misc_feature (593)..(593): n is a, c, g, or t
  misc_feature (689)..(689): n is a, c, g, or t
  misc_feature (882)..(882): n is a, c, g, or t
tntttacaaagagcttttaatgatgtggaagatggtggttaataagtnggaaaaaactggttataaatgatancacaatatgntgncaacgatgaaaaaatgcacaaaaaaagacttttttaaaacgtcgaaacatcagagtggtctctagttggnggaataattttttttttaagacaaacttcttcatactttttgtanttttaaaatgntttnctatgtacatggattacttccataatcaagnaaaaaagtaaaaacttttaaaatgctgtgaacgtggtttccttttttnttttctctgttgggtgactgcacatcagcatcttgngttatgctaactacttaggntggtcacgacacacacncacatacagngangtcncacaggntgtaccggggtggntgttgcaaatgtacatgnnttacacgggttgnngttgtttggcngctagttancatatgccacccaatgncgggncacaatctggtcacacgctgcctctcctgcctgttgctgttctttacaaaggtncgtgtgtngggctggcanagtggcatcctgctggcntctctgtggtggccccggaatngtggagtgcccaggtcagcatctactctgggtcccattctcaactgctctggccttgacatcagagcttccggttccctgctggctcttctgcacnctggatccatgccagtccaggccccctccaggcacacacctgaggcagactgagagcacaatggacgctgtcctgatgtgaactgtgcccagacacaggatggggggaagcgggagatgtgaccacgacaccacacacaagctcgatctttacagatgggccctctgggactgctatatgggtggtgcccganagacacgggggccatgtggagccctccaggg

SEQ ID NO: 525089 - DNA, 294 bp, Homo sapiens
cggcggccacagcttctcagcaccacattacacttattccattatactgaccgacatagttgggagtatcgctctcttcaccaatctgtacaagatactatgagaatcacaagcagactgtctgctcagactacgatgctgtctgattagaactatgaatttagaaactcactctataccgcacaactacattgatactgagcaacctgttcctgaatgactattgggtgcattgcataatgaaggcagaaatgaagatgttctgttaaaccaattagagcaaagacgcgatat

SEQ ID NO: 525090 - DNA, 136 bp, Homo sapiens
gattgacagatggctaaggagctgatactttgacagtgtttttagacctgtgttactatgaaaaagatgaatgtcctgaaaagggtgtggggaggggggttcagaaagaaacaagatgtttggtgttagatttatg

SEQ ID NO: 525091 - DNA, 764 bp, Homo sapiens
aaatgaaccctcatgatcttccccaaagaaaccttagtttcccggtgggtaactcaccattcgggaattaaactaccaccattggtctggggggcgattcgtttcgaggccctttttcgtattattcaaggacatgttcagaaagaaattgatttaattatgggccctaatggaaagcctcttgggaccggcaatgcgaaaatcccttatactgaggcagtttgcaatgaatttttaagattctgtaaattagttccattaggcatttcccatcgaccctctcaagatacacctgtacgtggttattccttcacaaaaggcgccacagtaattccaaatctttattctgtacactttgataaaaagtactggagagacccaaaagtgttccatcctgagcgatttctggacagcagtggatattttgccaagaagaaaactttggttcctttttccctaggaagaagccattgtcttggagaacacttggctcggatggaaatgttcttgttttttacagcattgcttcaaaggtttcatttgcattttccacatgaactagttccagatctgaagcccaggttaggcataccattgcagccccaaccctacctcatctgtgctgaaaaacgctgaagctgcctggtatgttttcgggatcaagaatgtatatttgccttatccctgaacttggtttaatcaaatcaatgtgtgtattagaataaaagtcacagcatcagaaagccgaaaaaaaagaatcgccg

SEQ ID NO: 525092 - DNA, 1296 bp, Homo sapiens
tttttctctttttgcttgtggctcgccttttttgttgttgcttctgtctctgctttttctgtctcctttctgttttttctgtttgttttcttttctgtttcttcttcgtctcttttcctctgcttctgtttcgctgtgctgctgttttttcttttttgtttaggtcctgtttgtgccgtgttcttctctgtttcgtcttgttttgttttttttttttttttttttcgtgggggggggggggggggagaggggagggaaagaggagagaaaagaagaaaaaaataatatgtttttggtggttgtgtagcatctattgtgttgtgtatgttgttgggacacctttggtgcaccagtggtgtgggtgttctccagttggtcgcccctgttttatattggtgccgggttctccccttcagtttggggtcttttaatgttttttgggggccccaatttgtgaaatgtgggccccccgcggttaagtggttctccctttaagggttcccctccgggtgccacgaagaccctgtgtgcccaaaggtccttctcagggtaaaattgggggaaaactttgggcccccctctgggagaccccgcgtttcttttgaatctagaaattgtctgcccagtgggaaacccgattatatgtaggccctctggggaaaagtcataatctgggatcaaatggaatggaaatttgggatattccctggaggattcgggacctctggggtccccaaaccctcacattggattgagaggccttccctgcttgtatgggggggacccaactgccaccctcgcgatggggactctttttgagacccgagtacttcacaggacccgttcccacacccccgcgtcaatcactcaatcttctctttacacccccaaaggttttgccgcggtgtggtaaactgttttttttgcgccctctttggggtggagaaaggtggaatagtgatgagaagcccataaattcacggaacttattcctcttttgttttgtgttttttttttgcccttgcacccacgagtatgaaatagcttccacggagctccacgctataagcttggagagtgtctgtcgtgattgtaatcaccactggtgagccacacactccagagaatctaaaattggagcttctgttgtaattctcaccccctccatattgttttttacaccgtttaatggggaccttttagagtcttcccttttgttggaaatagatcctcccccttccaatgctgtaattaaccaccacctttaaaaacttggataaaatattggaacctcca

SEQ ID NO: 525093 - DNA, 1128 bp, Homo sapiens
agctcttcttcattctcaccctgatccctgggggactcaaagccaaaactgcccaaagaggaaagatttgaatcctaaaggtgtgatccttgcccccatgggatggccctcctacgtagaatgtgactgctgaaatgcatgcttttttgtgtggtgaacacttgatgtgcagctggtggaatgacagatgcacgaatgatgccctcaccctgtgctggtgtggtccatgcacatgtgctgtatcttgcatgatgtggtcccagaggaacgctggagccaagagaagccctgggaaggaggggtggggaacgacactgcactgctgacgggcatggcacactgatgtgttctatgcacctgtacacaggagcgcactggccatggccttcggaaacggcacgcacacggacacaatacgaagaacggtcggccgggcttggctggcttaagcctgtaaccccatgcacttatggcgaggccgagcgtggcgcggatcacctgaggtcagcgagttcgggaccagcctggcaaacaccccatctctactaagcgaaaacccatctctactaaaattacaaacacattagctgggcatgggttgcgcatgcctgtaatcccagctacttttggaggctgaggtgcggagaattgcttgaacctgcgacgtggaggttgccgtgagcccaaggtcgcgacactgcaactccagaccggcgtgacagcagtgagactccagtctcaaacacgaacgcgccacacacccggacacctacgcagcaccgtcggaaatgggctacccacgcacgaagaccccactaactgcatgaccaaccccacctaccggcgggcccccatggggcaaaatgaacaactctcaacaaacccaacggcaccaaccgtctgccaacgcgacgacacccacaccatcgaagaacgcggcatgcccaacccgagccccccaacggtgcccgttacgagccccccagaggcgaccactactaacactccgcagaccgtcgcaccccagcggggccacaccgcgcgacacaaggcggacaaagccactacgcacacaccaaaaccagacggcgcgccgcgcacaacacacgcgcaccagacctaccctca

SEQ ID NO: 525094 - DNA, 956 bp, Homo sapiens
  misc_feature (16)..(16): n is a, c, g, or t
  misc_feature (35)..(35): n is a, c, g, or t
  misc_feature (51)..(51): n is a, c, g, or t
  misc_feature (582)..(582): n is a, c, g, or t
  misc_feature (700)..(700): n is a, c, g, or t
  misc_feature (712)..(712): n is a, c, g, or t
  misc_feature (862)..(862): n is a, c, g, or t
  misc_feature (867)..(867): n is a, c, g, or t
  misc_feature (870)..(870): n is a, c, g, or t
  misc_feature (876)..(877): n is a, c, g, or t
  misc_feature (944)..(944): n is a, c, g, or t
tcatctgtcatacccngcttaattgtagcgaggcngggtggcgagcgcgtntgacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtcctttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagnctgacccactcactgggcgggggcacaggctctggaatgggcactctccttatcagcaagatccgagaagaataccctgatcgcatcatgaataccttcagtgtggtgccttcacccnaagtgtctgacnccgtggtcgagccctacaatgcaccctctccgtccatcagttggtagagaatactgatgagacctattgcattgacaacgaggccctctatgatatctgcttccgccccctgaagctgaccaccccaacctacggggatctgaaccaccntgtcncanccaccnngagtggtgtcaccacctgcctccgtttccctggccagctcaatgctgacctccgcaagttggcagtnaacatggtcccc

SEQ ID NO: 525095 - DNA, 988 bp, Homo sapiens
  misc_feature (16)..(16): n is a, c, g, or t
  misc_feature (35)..(35): n is a, c, g, or t
  misc_feature (51)..(51): n is a, c, g, or t
  misc_feature (614)..(614): n is a, c, g, or t
  misc_feature (732)..(732): n is a, c, g, or t
  misc_feature (744)..(744): n is a, c, g, or t
  misc_feature (894)..(894): n is a, c, g, or t
  misc_feature (899)..(899): n is a, c, g, or t
  misc_feature (902)..(902): n is a, c, g, or t
  misc_feature (908)..(909): n is a, c, g, or t
  misc_feature (976)..(976): n is a, c, g, or t
tcatctgtcatacccngcttaattgtagcgaggcngggtggcgagcgcgtntgacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtcctttttgggcccccccaaaggggaaaaaatttttccccctccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagnctgacccactcactgggcgggggcacaggctctggaatgggcactctccttatcagcaagatccgagaagaataccctgatcgcatcatgaataccttcagtgtggtgccttcacccnaagtgtctgacnccgtggtcgagccctacaatgcaccctctccgtccatcagttggtagagaatactgatgagacctattgcattgacaacgaggccctctatgatatctgcttccgccccctgaagctgaccaccccaacctacggggatctgaaccaccntgtcncanccaccnngagtggtgtcaccacctgcctccgtttccctggccagctcaatgctgacctccgcaagttggcagtnaacatggtcccc

SEQ ID NO: 525096 - DNA, 334 bp, Homo sapiens
  misc_feature (38)..(38): n is a, c, g, or t
accagactgatgcaatggcatggtctcggctcactgcnaaaccccgccccccgggctcaagcgattctcctgcctcagcctcttgaatagctgggactacaggcacgcaccaccacagtcggccaatccttgcatctttagtagacacagggtttcaccatgttggccaggctggtctcaaactcctgacctcaagtgatccatccgccttggcttcccaaagtgctgggattacaggcatgagccaccgtgcctagcgtgtggaggcttttaaagggcaacagtatttattcctatgatgttaccatttttttttttttggaaaatggattct

SEQ ID NO: 525097 - DNA, 139 bp, Homo sapiens
ccgagattgtgccactgcactccagcctgggagacagagcatcgactccgtctcaaaaacgaaacaaaacaaaaaattttaaaactcaaccatcctagaactgaagtttcttctgcaccttctccgcgatcgaagtgtg

SEQ ID NO: 525098 - DNA, 399 bp, Homo sapiens
  misc_feature (16)..(16): n is a, c, g, or t
  misc_feature (326)..(326): n is a, c, g, or t
  misc_feature (357)..(357): n is a, c, g, or t
  misc_feature (393)..(393): n is a, c, g, or t
gtcatttctttggtancgttatctgattataagctgttagaagccactaggcacttcttgaatgtcttactgcttagaaatttcttctgccagataccctaggtcatcactctgaagtgcaaacttccacacatccctagggcataaacacagtacagccaagttcttcgccagggtgtaacaggggtgaccattactctagttcccaataacttccttatttccatctgagatctcagtctggacttcactttccatatttctatcagcgttttggtcacaaccatttaaccagtctctaaggaagttccaaactttccctcatnttcctgtcttcttctttggacctccaaactncttccaacctttgggccattaaccaggttccaaagntggttt

SEQ ID NO: 525099 - DNA, 414 bp, Homo sapiens
atgatgacgacaacactggttactttcgtgactccgcccagtgccctgtccgtccgcctgcagtgacatactgcggctgatcaacggagctggctaaactatgactacatggaacgaacacgtaatcttaactgaaaaagatctgctagaagatggttttggagagcaccccttttaccactgcctggttgcaaagatgtgtcactagcgcaggatgccggactgggtaggcaaaagggggtgagggcatgcctctatagtacgcaatgaaccgttgatagctaggtactggtctctcgaggacatcttacgtgatgagtgattatagaggctttggcataggctcagaaattctgcagcatctaagccaggtcgccaggaggtgtcgctgcagcagcagtgcaacttcttgga

SEQ ID NO: 525100 - DNA, 715 bp, Homo sapiens
  misc_feature (478)..(478): n is a, c, g, or t
  misc_feature (592)..(592): n is a, c, g, or t
  misc_feature (608)..(608): n is a, c, g, or t
cttcattagtcttgctagtggcctatcaattttgttgatcttttcaaaaaaccagctcctggattcatttttttttttgaaagtttttttatgtctctatctccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctatacatttccctcgacacactgctttgaatgcatcctagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgactgcactgtggtctgagagataagttgntataaattctgttcttttacatttgctaaggagatctttacttccaagtatgtggtcaattttggaataggttgtgtgtggtgcctgaaaaaatgtatttctgttgattttggngtggagaggtctgtanatgtctattaggtcccggttgtggcgctgagtccattccttggatatccttgtgactttctgcctcggtgtccggttcatatttgccggtgggttgtgcctccattt

SEQ ID NO: 525101 - DNA, 240 bp, Homo sapiens
ttgctgaatcctcctaagctctcaggcaggagtgacgtgttctgattgctaggctagtccaagccactctgagcctagtgtcctgcagactatgactgaggaacatggtgatgttcccaaaagaaactgggagtcttgcagaaaaaaggtgcatgatctagcagacggggcgaagtgccactcagagagaaggagagcttgtctttggatttctgtacacatgcatgcacccaggtggta

SEQ ID NO: 525102 - DNA, 298 bp, Homo sapiens
gcagctagaacagcctggtcaggagcgtaacggaggtgcgccaaccgtgagaggaaacccgctgcgcggctgctttttcctgtccccaagccgttctagacgcggccaggagtaggatcaccatcaggaagagttctgacacatatgccataattgagcaaagaaacatgtgaattcatgtattggccagacataatgaaaactgcgtgacatgaaatacaaaatcctatataaattattctgagagtgcacctgacatttttttttttttttttttttttttttttttttttttttt

SEQ ID NO: 525103 - DNA, 421 bp, Homo sapiens
  misc_feature (421)..(421): n is a, c, g, or t
agactgttgattatgatctacaatccacagggacattgcaacactgtgcctattatagagggccagatctgtaaggctatgcacagctgtaaagctccgtaagagaaccgagccggacccttcaggcagccttgctgggcacaatcacatctacaacgttcatgcgaccagcaaggcatatgtgctgatgaagttcgtgaatctgctcaatcatgtcgtacgcatgagctactggatacatgccgcagtaaacgtcgtacccgctatggagtctacccgtgtacacaacacacgctgctgactatcacagtggtaacggctgcatctggtggcatgacgctatagtggaagacgctgcaggaacaagttgcacatggattacctaccctagcctggctactgccgtctaggctgcagagcn

SEQ ID NO: 525104 - DNA, 420 bp, Homo sapiens
accaagaatatccaaagcaacattgaaaagaacaaagttgaagaatcgatagtagctgaatttaagaatcaatctaaagctacagaagccagacagcagggactgcaacagcagtcaataaacggatcaatgagcagaactgacaattcaggaacagacacacacttacatgacgatttgtttttcaacagaagtgtcaatgcaatccaatggtgaatcttccaaccaatgacacaggcacaactgggtatctgtacaccccagactcagtcacgatgaaccacagacctaaaggctaaaccgatcatgcttaaaagaaagaaatttagatgaatatcttcacagctttgggattggagaaagtatcttaggacatgaaaagcaagaacatatgagaaaaatattcataagttagatttc

SEQ ID NO: 525105 - DNA, 313 bp, Homo sapiens
agagttctagcagatcacacgcctatatcagttcctcaaatatctttaacatttggtggaaagaaaagcatctatactggcacctgcgtacacagaccctttcttatcttccctttacagatctcagaagttggttgacacaaaaacagttcatacagcatggtaggcagaattctcaaatgatcccaatgactcactcccttgcataatccccttgagtgtgggtggaacctataacttgcttctagccaacagaatatgacaagggtgatgaaatgtcactcttgggattgctacattatgtaagactcta

SEQ ID NO: 525106 - DNA, 905 bp, Homo sapiens
  misc_feature (21)..(21): n is a, c, g, or t
  misc_feature (905)..(905): n is a, c, g, or t
ctttgactactgattattgangtccgtcttagacattatagggccgattttgttgctaacagcacacccgtatttcagcctgctcagacagtggttctctgtgtaggttgttcaacagagttgagccaacctacaggaggaaaggccagactcacagaagggtgtccatttacaagagagcgcactaatgatcaaaacagctcgctgaatgtccaccgttagtgtcgtctcacagatcgccttcccatctatgccataatgtctattagagtaccagcccccctcacgtccgattatgttcagtcaggcctatcacccgaaacccctacgaccgagacaaactccccacaatgttgtcgacggtggtctaatacagtccttcatggaccgagttagcgtctgggggaggaatatcacacacccgacactccagcgcacgcgccgcacctcacccttcgcttacgccacagcaacaccaataacgacccaaatctgcagccgccatgaactgactatctatgaaacaaaaacccgactcacagttgaccctcaatcaagcatcacataaatatcaggtgtatcgaacactacggcgcgccggctaagtccacaccacccacgacactaacaccccccactctatcaaatcgcgttgcctccgccggacctgcttactaagaacatcagcaaaaacgctatcccggcgggccggttagatgcggtaagagtgtcggaggtattagaacaggacctatcacagcaacacaaaccccgccgcctcgacggtacacgcaactcactccaggtaatgtcagtaggacgccacgttatctcttgttccagatcccgtgtcccgcgtccatcccactccaacgcttacgacagccacatcgacgcccactacn

SEQ ID NO: 525107 - DNA, 235 bp, Homo sapiens
ccggcacgctaccttcgcatcgcagaggaggaggacttgcacggacgtcactgtggcagcctggtcctcaacgcaatattcgagacacacagaacctcatgccaccctctttctagtggtgcagaaccctggccccacaactccacagcccacactctccgtcatcagggactacctcggttccaaaaactacagaaacagagcccagcagatttgcacaggatgagctgcgggt

SEQ ID NO: 525108 - DNA, 895 bp, Homo sapiens
ccacgtgttacaatagccatgtactatgctactattccttgattgtccccattctaatcactatgtcattcctatgtgtttaccgaacgacatacaatgctaagtgatatacacttacgtctaagggcccgaatcgtttgatagagctcccgtacgggtgcgtactatcacacccatatcggcgtgacagccagtaaaaacttgttcatcaaagatcccctaatgggccgtcacaatctactcggtgggtttgcagtctactgagggttggtttcctctaaacctacgatagaaggaaaacaccatgaattcttatagagaataggtaccagctcgtagaatgggttgcatgtgatccatgtatgtagtccctagatctcctggcagaaccaagggactatgttgtccccactatgtaataaggtgaccggtgttgtcagctgctggaaccaaatgctaaacatgacctatgagattccacggcgatggaaagtcacccgataaggatggaaatgccaggtgggaaccacgctgcttgaggctcatggactgcatcctaaccacaagctcgtccaactgacaagacccttgcgcctgccctctccaggatgtctacacacaattggtggtatagcgtactagtcctgcttggcccgagtgcgacgaacctgcgtgttcctcaaaaccccggtatggaacggtcaaccctttggctccagtcaacgcttacaacccggcagctacacatcctgtacgaaattgccccattgacgcctttgagtcgacactccttcctggcgaaccattgtgcgccccaactgtcccagcaatgtgtctcgcacagatgtcccacacgccaagttcgacgccgacttaaacgccccccatctgaacc

SEQ ID NO: 525109 - DNA, 259 bp, Homo sapiens
  misc_feature (58)..(58): n is a, c, g, or t
gggggatgtcacgttgacagagacactaatgcttgtagtgtcaaggctttcagtaaantctcctgcagtctcttcactctcagttctagtttcctggattcagagggaggcttgccatctttaacatttccagctctgcttcagtttttattcagccaagtagtgatggcgctgattcagagttcagctgtagcaaatttgtttattttgagcttattgtgaagctcctgtgcgtgaaccatctccggcttacgggtac

SEQ ID NO: 525110 - DNA, 437 bp, Homo sapiens
  misc_feature (351)..(351): n is a, c, g, or t
aagtgctattgtcaaaaaaaaaaaaaaaaaaaaaaaaaaaaaaagtgtgtgtgggccgcgcccgcgcggccccgcgcgaagaagcgcttttataaacacccattgcgcgtgtggggcgcggcgggggccccggggggtaagggaaacagtgggccatagaggtggttctccacataggagagaatcgcggggccaagggacacatgaggggcggggacttcccaaaccaaaataaagaaaagcgccgcgggggggaacaaacgcgaggcgttctcgtgaaacaaaaatctcaagagagggaagtatcaagagggaggcgacaatatagacggggagagctcatatcacaancgaggagagtgtccaaaacggagaggcgcgcgcgagatatatctcaaatattcacgcgccccgggcccggggggcggaaaaaccag

SEQ ID NO: 525111 - DNA, 904 bp, Homo sapiens
aaacacaaaggacttattttccattccaagtagaacgcgttttctccctcatttacccccgccacacgacgatggtttcctattttatacaacgggttattctccccctgctcgtgcgccgatatgtatgttattagcaactagtccccgccgcccccttctttggacaacatttttctgttgagcgcccccctagtgcttcaccccaaacacaattaatggatgtccactcgtcaacacactccttcaggctgtctagctagtaagaaatagtcccactcacacatctctatccccccccccccctatacgaaggtattgtctgcatcactcacccccgggagggaaaaaccccagcttatttgtaaccttttctactaggccccccctcctcagctagctttcccttagtatttctgtagggcgactcttgcggaattgtccgcgggttgttacatacaccaccccgcctgttgctcagaccctggccgtatattatcttattggttctcacatctgcgcactccgcaccgcccctggttgctaacccatcaccgttgctactgcccccgcacacaccttgtgtgggcagagggacgcagggggaggaggtaggaaacaaccagaaggctccaggaggtgcaggaacaccgccctcgcgcacacacacacgcaggcaaacaccgcactctgtacgtatacagagaaccccacaatgtacccccgcggcatgcagggaggtcagcacccactgatgcccccaagacccaccgcgaggcggtaggaggctccaaaaaagtcaaaatggcgaaccccggggggccacgaggggccccctaaccccggggcaccccccctcacccccccccggggcccgggtcgggactccttcccccacataaca

SEQ ID NO: 525112 - DNA, 478 bp, Homo sapiens
tttaatttagcaattgaaagaagataattcagtgcagattctgaagaaatcactgattttatcccagtggtagcttgaagatttcatgcaattaatatttacacactatcaacaaaaggttcattaattttaattgaaggttatttatcatcaggtagatatcaaaaagatgatggaacaaatgtctttactttagatgttgttgtagattcttttagatctttagaaacaaaagaacaattagaacaaagaaaaaagaaaaatgtttctgatacagcaaaaccttctttgaaaaacacttcagaaacagttaatgaacccacttttatcaatgcaaatacttcaaaagctgaaacaatttctgacaatctagcaccaactaatgaatttgaagatgaaactgaggaagatgatgacgatatattcattgattgaaattttagtcctatggaaaaataaaaaggaattattatgaaca

SEQ ID NO: 525113 - DNA, 1011 bp, Homo sapiens
aactcacaagagcattagttcgcctatcgcgcccagtccgttacatgggaggctaggtgacattagtgactgaccttacctagaagcagatcaccgtcgtactgcaatcattgttcggacactctcgtccagcagtggaagaagaaccgccaggcgtgatacagagccgtactgtcgtagattttccgagtatggcagtgcatagtggatattcattgatcacttgaactcagagcctgcgagaactaagtcgtacccactaattgtcaacattaactactccggcacggaaatagaacgcactttgtgactatcagtacggtataggtgctgacgctagtgagtattcaagttgtgcattcctagggttggatcctgtgatgcacgatcgcatgatatttacaggtagagaactaagacgtacgacagctacgacgcgatagtttcataactccggctatccataactgcatcggctaatcccgcactcgggcgtcgaacgtatttagctgagttcgccacactcgcacgggaagcaattatggaaactggatctgagctgcaagatgcatctggaagccctagggatatcatctgtcttttcaccgtaggtgggctgacttggcgatggtattagcaaactcagtcagtaggacatcgtactacagcgacacgtactacgtggtagggtcacttgccactatgtcctattcagtaggagctgtatttgccattcataggagggcttcattcacttgatttcccctattctcaggctacaaccctagaaccaaacctaagccaaaatcccatttcactatcatattcatcgcgcgtaaatctaaacgtttcttcccaaaaacagtttcttcgggcctattccggaaatgcccagagtaaataactaacgggatatgggccacaataagttaccccagtaatcgttaaactaattccttaatacccaataaaaatttgtagagcgcaaaagtacgaccgtaactcccatac

SEQ ID NO: 525114 - DNA, 400 bp, Homo sapiens
gtcgacggggatataggtagttgtatacctttaaagaaacagaagtatacagtttgcctatttggtcaagacgaatactccacataaatttataccataactaaaataatcctgaaagaaacacttggttcacattatgaacctttaagggtctaaaaaaatggaccaagaagaagaaaccaagaaataccagagaaagagggaggaaggaatggggagaaaaacacccagggagacaggcagagaagataagggggattgccgaggcagagacttaagtgctagaggttcctttcaattctggtgaacagttaccaagccatctatgtgcccagcagggtgtgtgaatatgacacaatttccgccttcaaaaaaaacttatgttctggccaggggtgca

SEQ ID NO: 525115 - DNA, 147 bp, Homo sapiens
tagtcccgatctgcgagatttcttaggttgtaaaagtgtacatggtgcaaattcccagagagcactacaatattcaaaagaaaaaaaaaacctgctaaaaatactaaatgtctgtgctgtgaccaaactaccatgaccaaattacca

SEQ ID NO: 525116 - DNA, 143 bp, Homo sapiens
agaagcaaagcaccccatctctgggaggcattataatggacggtcttcagagttcggggaccacgtctagcagattctcagcaatgctgatggccacaattcaagagcaggggcccggcctcctgggttctttgctgaaatta

SEQ ID NO: 525117 - DNA, 396 bp, Homo sapiens
  misc_feature (50)..(50): n is a, c, g, or t
  misc_feature (388)..(388): n is a, c, g, or t
gaaacgatactgatacatttttatattaatactaaaatacatagtttgcnttagggttcatactttgtggtgtacattctgcgggttttgacgaaggtatggtggcatatattcattgttactgtatcatgtagaatagttttagtgccctaaaaatcccctttgcgtcacctctttcattttcccctctccctgaacaccaggcaatcactaatctttttctgtgtccacatttttgccttttccagaatgtcatgtagttagaatcatctagtgtgcggtcttttcagagtggcttctttcacttagtaatatccttttaagattcctcaagtctttccatggcttgatagctaatttcctttttattactgaatgatattccccntgtatgac

SEQ ID NO: 525118 - DNA, 184 bp, Homo sapiens
tcatgatagaatcgagctggtaccgccaacatggtgaagcctcccgagtgggtgggactgcaggcgcccgccaccaagcccggctagtttttgtatttttagtggagacggggggcttcaccatgttggccaggatggtctcgatctcctgacctcacgatccactttcttggcccttatcgag

SEQ ID NO: 525119 - DNA, 140 bp, Homo sapiens
acggcttacgcggctgactgagggtatgcttgtttcaccttctgtggacaaggagctgcacaggaagccgtgaaattgtgtgacagctatcacattcgccctggtacacaccttggagtgtgcatttctgtggcaaacaa

SEQ ID NO: 525120 - DNA, 409 bp, Homo sapiens
  misc_feature (94)..(94): n is a, c, g, or t
agcatttgctctatgcttgttcaagtgctaatcccaggcttttttttttagttaaaaaaatttttttgtaagccccctcccccctgacatgganatattttttgtaagagacagggtctcagctgggcgcagtggctcatgcctgtaatcccagcactttgggaggctgaggtgggcagatcacgaggtcaggagatcaagaccagcctggccaatatggtgaaaccccatctctgctgaaaatacaaaaattagctgggcatggtggtacatgcctgtattaccagctacttgggaggctgaggcgggagaatcacttgagcccgggaggtggaggttgcagtgagccgatatcgtgccactgcactccagcttgggcaagagtgagacttcatctcagagaaaaaaa

SEQ ID NO: 525121 - DNA, 339 bp, Homo sapiens
cgtcgaccagaccctggtcaactaagtaggctacgagagcctcggttgccgaccagtaatcggttcctgctggcatggccatgaaacggtcgggggagagcatcgacataagtaacgacgagttggccccggtgagctgaaggtcgacgtgaccacgcaggtttaaccttgacatccggctgatgagttcggcgggatcaaagacctggccgagctgaatgactggaacgtcgccgaaggcaagggccgtgatgtcgacatcgggggtggcgacgacgagatccgttctggccagcgtcgactcgtctgcctcgtcgccggtcagcatgaggtacttgg

SEQ ID NO: 525122 - DNA, 522 bp, Homo sapiens
cccatctattgctgcaattgttggtactgtaagattagcaatatcgttaatcactgctcttattttggagacaaaaggaccacacctattggaactcattttggctctttccttaaggtcagcaccagcacagaatatccctgggacttcactcctgattattatggtccgtactttcttatcagatttcaaagcatccacagcttttgatagcattttgataagatttttactgagtgaatttttgccataagctctgtttattccaagcaccacaattcctcggttctcctcctccaggtgccgcacctgcagctcgtcctcagtattcatctcagagtctgtagcccttttcggggcgggtacccccgcacgcaggtgacccagtcctgggtcccagttacgccgggcgccgctcgcccggtcctgcacagacgaagccagggtcaagccctacaaacccacgggacagtagcccacgctactgcatagcggcactaccaggccgggcgaccgccacag

SEQ ID NO: 525123 - DNA, 230 bp, Homo sapiens
gagcggtccagaatagctcctagtgctgtgtattggagaggagaagacagagacttgactttgaggcctacctgtaccaccagtgcggacttgaccccaggtttgtgttcctggacagcgtcgtttttcctgtttcgaaatcagtattacaattatgtcactgtttgaggccccagggagggattcatcaaattgatatgcaatggaggctgttaaacaagggttcagcc

SEQ ID NO: 525124 - DNA, 324 bp, Homo sapiens
ttaatagaaatcccaagcaaagtgctaaatgtgatgaggagtgctcagaggaaaggctttaaaagcagatactggagagtagctactgctgcaggatagggtaggcttcatgggaggaagtgccatatgaaattgaccttagaggatgtctaggattaaactaactgaaccagggcaggcgcttgtaaagattaaatgcaacataagcaaattcctggggtccatagtgggtgtttttaaaaaggcagttaataataataacgctctagtatccaaataactatgacagttgttagtacttccctttttatttcttttcctggc

SEQ ID NO: 525125 - DNA, 142 bp, Homo sapiens
ttcgtcttgcgatctgagcgcgccgtcgtctcctgttctatgtgctgccctggtgtgctggcgatcacgctcgtgctggccgtgttcgtggccagcctggcttcgctgcccttgcggggcatgctgtccgaagccatggcga

SEQ ID NO: 525126 - DNA, 258 bp, Homo sapiens
accggatagagcggctcatggatgtttctctacattctaggatggagactaagaaattagttttgactttgtggcatacctagatagaaaaagttaatgagggccacaataaaaacataacgcaaacaaacagaaacaaaaaccagcaacaacttatgaaaccttctgacatccagaggaaccctcatccccttctcggaggagaggaactcaaggtgctcacagtttctccgggattgggtcctcttcctcttcctg

SEQ ID NO: 525127 - DNA, 246 bp, Homo sapiens
acccacagccaatttctcaatgcccgagagccgatccggtgggcagcctgcaccacgatggccgtcacggcgggcttgatcccataaaagagaccggctaccacggcgtacttcaccgatatgcgatgcacatccacgacagcacgatcagaatgaacagtgaaggcagcacaaaaagcaccccggcgataacgcctccccaagttcgatgcatcagccagccaatgtaagttgccaactgctgcg

SEQ ID NO: 525128 - DNA, 636 bp, Homo sapiens
  misc_feature (87)..(87): n is a, c, g, or t
  misc_feature (169)..(169): n is a, c, g, or t
  misc_feature (389)..(389): n is a, c, g, or t
  misc_feature (444)..(444): n is a, c, g, or t
  misc_feature (517)..(517): n is a, c, g, or t
  misc_feature (530)..(530): n is a, c, g, or t
  misc_feature (617)..(617): n is a, c, g, or t
tcctccccgccctggtgctgctccaggtcacacactcgtcctgagccggcttcagctctccgcacagaagtctcccggagccatggnctagtactcttatgtgaagtctaccaagcttgtgctcaagggaaccaaggcgaagagctgggtcctgcagctccagcggganctcctcagttcttttcggatgcactccacccccgcgaatccggtggaagccgtggtgcggagagcaggcttcgtggcctcccaggtttcgcggcctcccaggtttcgccctgaccctgtctgggctggacggaggctggaccgcggttcctggcgcctgtgcagagaggggcagcctcccgcgcggacgaccctgttaacaggatagatgggcgggtgancgtggccccgtacccacgagtttgggtccgctgaggcatctctcccggcctctgnctgggtgggtctgcgtttgtctgatcttgtagttcatgataataacttcctttactagggattattctttctncattgtctcttcntggaaaaattattgattattttttctaagctagtatgtagagtgaaccaggatgaatcaacagtggttaagtgtataaagctttganaggatatgggctggaactg

SEQ ID NO: 525129 - DNA, 260 bp, Homo sapiens
  misc_feature (20)..(20): n is a, c, g, or t
  misc_feature (138)..(138): n is a, c, g, or t
  misc_feature (166)..(166): n is a, c, g, or t
aagccgcaagcgggacccgnccgcccccgtgccccacctcgggggacgtcagagggccccaacccgcccggatctgcgggcgtccagtctcacggcccgggcgacggtccccagcggtgaccccgcgccaggacccgncctccctggccccaggccgctgtgggcncggggctggcctccgtccctcaggtctccgggaaactgaacccgggcgcgcgcagataagagcgctgacggcgctgccgctcccgggcgacgta

SEQ ID NO: 525130 - DNA, 335 bp, Homo sapiens
actgcggtggtcctaactgtcattgagaccacttgtcatgtgttaactgacacaatgctttgatttgattgtttcacagtacaatataagtaaaactatcaccagagtaactgtaatccatacagaattcttttacctgtaaatgcctttcccaatggaggggcaacagattgagtgattgtagagtctggtcaggaagactcatgtcttctagaggaatggatgcctctatcaccctttgtgcccaagctgctgctgtcagagaatgacacagcacctgcacagtcgctgtccacttcctgccactgctgtcggttgtgtgactggagcaaagt

SEQ ID NO: 525131 - DNA, 300 bp, Homo sapiens
cctacgcacacgagaacatgcctctcgcaaaggatctccttcatccctctcagaggaggagaggaggaacacacgagaacgtctggtgcagagccccaatttcctaattcatggatgtgaaatgcccaggatgttataaatcaccacggtctttagccatgcacaaacggtagttttgtgtgttggctgctccactgtccttgccagcctacaggaggaaagcaggcttacagaggatgttcctcagaggagcagcataaagcactttagtcagatgagtggaaccattaataaccattt

SEQ ID NO: 525132 - DNA, 325 bp, Homo sapiens
ccactgatgagggttggtgcagccccggagcatattgcagcggacatcccagaagtgggtgtttcccttgtcagtgggacgaaagcttggctccaaacgcatccgggctcagggaaaaacatggcctgctattgcagaataccagcgtgcattgcgagagaacgtcgctatgggaacctgtatctaccagggaagactctgggtattgtggtgctgagcttgcagaaaaagaaatatgagctcaaaatgcgctgtgagagctacagggaatcgctattactcctgtcccttctgctcaatttccttccctcatcagggggggggt

SEQ ID NO: 525133 - DNA, 884 bp, Homo sapiens
  misc_feature (38)..(38): n is a, c, g, or t
  misc_feature (64)..(65): n is a, c, g, or t
  misc_feature (70)..(74): n is a, c, g, or t
  misc_feature (149)..(150): n is a, c, g, or t
  misc_feature (154)..(154): n is a, c, g, or t
  misc_feature (159)..(159): n is a, c, g, or t
  misc_feature (161)..(161): n is a, c, g, or t
  misc_feature (168)..(168): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (185)..(185): n is a, c, g, or t
  misc_feature (203)..(203): n is a, c, g, or t
  misc_feature (207)..(207): n is a, c, g, or t
  misc_feature (222)..(222): n is a, c, g, or t
  misc_feature (226)..(226): n is a, c, g, or t
  misc_feature (267)..(270): n is a, c, g, or t
  misc_feature (275)..(275): n is a, c, g, or t
  misc_feature (284)..(284): n is a, c, g, or t
  misc_feature (286)..(287): n is a, c, g, or t
  misc_feature (289)..(289): n is a, c, g, or t
  misc_feature (303)..(303): n is a, c, g, or t
  misc_feature (322)..(322): n is a, c, g, or t
  misc_feature (340)..(340): n is a, c, g, or t
  misc_feature (355)..(355): n is a, c, g, or t
  misc_feature (361)..(361): n is a, c, g, or t
  misc_feature (372)..(372): n is a, c, g, or t
  misc_feature (377)..(377): n is a, c, g, or t
  misc_feature (382)..(382): n is a, c, g, or t
  misc_feature (384)..(384): n is a, c, g, or t
  misc_feature (421)..(421): n is a, c, g, or t
  misc_feature (425)..(425): n is a, c, g, or t
  misc_feature (435)..(435): n is a, c, g, or t
  misc_feature (470)..(470): n is a, c, g, or t
  misc_feature (486)..(486): n is a, c, g, or t
  misc_feature (503)..(503): n is a, c, g, or t
  misc_feature (539)..(539): n is a, c, g, or t
  misc_feature (544)..(544): n is a, c, g, or t
  misc_feature (558)..(558): n is a, c, g, or t
  misc_feature (633)..(633): n is a, c, g, or t
  misc_feature (646)..(646): n is a, c, g, or t
  misc_feature (679)..(679): n is a, c, g, or t
  misc_feature (692)..(692): n is a, c, g, or t
  misc_feature (700)..(700): n is a, c, g, or t
  misc_feature (714)..(714): n is a, c, g, or t
  misc_feature (716)..(716): n is a, c, g, or t
  misc_feature (729)..(729): n is a, c, g, or t
  misc_feature (736)..(736): n is a, c, g, or t
  misc_feature (741)..(741): n is a, c, g, or t
  misc_feature (753)..(753): n is a, c, g, or t
  misc_feature (760)..(760): n is a, c, g, or t
  misc_feature (766)..(766): n is a, c, g, or t
  misc_feature (771)..(771): n is a, c, g, or t
  misc_feature (775)..(775): n is a, c, g, or t
  misc_feature (782)..(782): n is a, c, g, or t
aaaaaaaaaaaaaaaaaataaaaaaaaaaaaaaaattnaaaaaaaaaaaaaaaaaaaaaaaaannaaaannnnnttttttggaaacaaaaaatagaaaaaaaaataaataacaaaaaaaaaaaaaaattttcaaacacccaaaccccannatcnaatcnanacccagnanacccttangnatgcngccctctaccaggaagcnagangcctaggagcttgcnatcnatatttatttgaaaaggtcaaaaggagcatctatgaaattnnnnagggntgcaggttntnntngcgcctcaacagcnagggaaatgtaggcaacangagcaggcacagcgcggncaccactgtccacangctcanacaagctaggnccgcnggttncnggagagctagcaggttacattcaggcagatggccctnttcncacccaaacncatagaaccccaaacaaggcatcaccaggaaaganacgggaaagccaaatnaaagtttaaccaggganagagaacccttggccccactgatgtccaaagccacnagcanctgcttccaaaatncctatgctattaaagtgggaattacatcatttaaaaagcctgattattccaggcttctaatctttcatataaaantgcctttgttttnctgctttgttcaattgagaggcccaggaaattngggagggtccctnattagggnaggaggccacctcngnagcccaggcccancagtacnaaagnaaatgttagggntcagaanaaggcntcaancaanagggttnatggcctccagtcaagaaactgtggctcatgccagcagagctctctcctcctccagcaggcgccatgcaagggcaggctaaaagacctccagtgcatcaaca

SEQ ID NO: 525134 - DNA, 702 bp, Homo sapiens
tgctatacgtaaaggatatatagctctgattcagcagttgtaaaaagtgctgaacataggggccaggtcactggtcagttcatagtatggaatgggagaagtgaaagttcagatatagaactttccatacttccaagtttactgcaagtattatgctatgcagagagatagctattctaatataagactgatgtgtgattttactcgacttgtactgtacatctattaaagccttagattattacattacgggtaggaacccataccaatgtcaattctcaatcgtgttaagaaagtaatggtgacttcacatgtattagtagttagttacattatacgaatattactgtactttacttgttaaaatgtagtaaaatcatatcctacatttattagatattttcattaatctattaacaattgaataccattttcagtttatagacttgtacacattagattgaacccaatgaattaatcaaaatacaaaaaaaagtagttatttccttcatcacatactcagtattgaattacatgtagtgtcaatgaatattcgtatagttaactaaatgattatatatatatgataaaatatacacagtgtaagaatgtcagtccattgtagttctagtctagtatacattaaaagaaaaaaaatctaaaaatggatatctataaaatatataaatcattgtaggaaaa

SEQ ID NO: 525135 - DNA, 3903 bp, Homo sapiens
gtcctacgactatctggaggtgcgcgacgggcacagtgagagcagcaccctcatcgggcgctactgtggctatgagaacctgatgcataagagcacgtcagccactctgctcaagttcgtctctgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 525136 - DNA, 3117 bp, Homo sapiens
ggagatctccccttctttgtgaatcactcagcccttcaccctggggtgaggctgtaaggtagctggtggtctccagaggtaacaggacccaggcccatgcagtgaagggcaggagtggagttgagcaggggagacagggaggtcagagtctggctggagcaggcccatggatcctcactcccggcctgcctgctgggccggacaggggataggcaggaaggcaggatgcccacggccgagtccatgctgccttccttctcccctccttcgcccagggtcctgcatcctcaagccccctctgtggctgccctgcacccctgcctgacccccggatgccatgcacctgcccctgcactggctccctgcttggcactgccagccaccctgctctgcttacagtggcccgttgacctcctgcccccaacccccgcttgctgagaccctccccatgccaggccaatttcttccttccctgtgcccacctgggactcctaagaggtgctcaccagagggttgagaggatgtaacacccactcggggcaggctctgccccgggaaaccattacctgcttactctcgtctcttcctgcccttctgttgctccagtcttggagggggcaggggaccgacactcacatctatcaggcctggagttactgctctgcccccatgccctggtcgacactgtgcccgccccaccctcagccctgcacggagacacacacgcccacacgcacacacatgtgcacacacattgccccatcgcacaagaaacctgcagaggacccccactgggggcatcgaggctcagccctcagggcccggggcatctgactctggccccccaggaggggagctatttggacttttgggacacccaccgaggagaccctaagccaagaaggagaagaaagagcctgaagaccttcagtctgacccctgccaccttccggggcatttgggcactgtaggaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 525137 - DNA, 4316 bp, Homo sapiens
  misc_feature (4153)..(4153): n is a, c, g, or t
  misc_feature (4156)..(4156): n is a, c, g, or t
  misc_feature (4162)..(4163): n is a, c, g, or t
  misc_feature (4174)..(4174): n is a, c, g, or t
  misc_feature (4176)..(4176): n is a, c, g, or t
  misc_feature (4219)..(4219): n is a, c, g, or t
  misc_feature (4311)..(4311): n is a, c, g, or t
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctctttaggggggccctnctnggttgnnaaggaggggantntcagcagggaccccccattcgccattccctgtgttcttcttanaaaggttgttattttgtgttatttcacccgggggggcatttatttttttcaattgttaaatgttttccatttttcccccacccccttgcttnccagg

SEQ ID NO: 525138 - DNA, 472 bp, Homo sapiens
  misc_feature (33)..(33): n is a, c, g, or t
  misc_feature (39)..(39): n is a, c, g, or t
  misc_feature (66)..(66): n is a, c, g, or t
  misc_feature (73)..(73): n is a, c, g, or t
  misc_feature (145)..(145): n is a, c, g, or t
  misc_feature (459)..(459): n is a, c, g, or t
cccctttaagggaatcaaacctggaacttgcanggcccnaaaaaaaagggagaaactggccctcanaccctgnccctacaaagcccctgtaacagggctcccctaccctgtgatgagtaaaggaatgtcacctttcctaacaggncccaggagcccccaagttatccttgggaccctcaagaagagaggaatttacccaactcataggtattggagggtacaaacccattgctgggcttgactttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaantctagttttatta

SEQ ID NO: 525139 - DNA, 3103 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcaaaaaaaaaaaaaaaaaaaaaaaaagaaaaaaaaaaaaaaaaaaaaaaaaaacaaaaaaacaaacaaacgaaaaaaaagaaaagatagaaaaaaaaaagaggagaaaaccaagaagagaagacacaggcagaaaaccaagggcgcgcgcgaaacgaaacagccgaggagagacgagaaaacaagagcggaacacgcagagaaaagagaaaaaacggagaagcaaagagacgagcagggaggaaagacaacaggacgaaaagaggaggcgcgaagaaaaagagcagcacggagaagaaaaaaacaagacaaaaaagaaaaagaagagaaaggaaaagagaacgaggaaggaaagcaaagaaaaacagaaaccaacagagaaaaaaagaagcagcgaggaagaa

SEQ ID NO: 525140 - DNA, 1523 bp, Homo sapiens
cgggcagctagattttccccagacgcagtaacctcatgagaaagaaacgatgccggcctgccatccagttcataagtgggacaagagatggaagaaaggagggggggcaggagggaagggccttccccacaggaggcatcggagcttggggtccctctctatccccttccgtcactcgcttccctgcagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaaaaaaaaaa

SEQ ID NO: 525141 - DNA, 297 bp, Homo sapiens
  misc_feature (103)..(103): n is a, c, g, or t
  misc_feature (244)..(244): n is a, c, g, or t
ggaggcacatgtgcagctttgtttcatgggtaaattgcatgtttctggggctaatgtggtttcttttacagaaaaaagtatcagaaataatcggttaactttnctcacatggtcttaactcttcttcaggaaatatctaacttgtaagtgcaatccttcttgtatagctgccagaccagacccagatagaccataataaaataaaatacacagtcagtttttaatgcaagccagaatgactctnctgtatctttagcctttccagggggatacagtgaactcagatatccctgctta

SEQ ID NO: 525142 - DNA, 191 bp, Homo sapiens
attatatgtgattcacaccatttgaaaagagagcgacatgaaaaggatgggagccagaatctggaaggcatagacgcagagacagaagcccagaccaggaccgagaccgaaaaaggcgggaaggaagggcaccaaggattaagacagagggccgggtaatccacattgtgatcgaagaaccagcatggaaa

SEQ ID NO: 525143 - DNA, 221 bp, Homo sapiens
tctagcacgcggcacgtgtaacagcctttgtaaggactcccttgatgagagggccaccttgccctctcggctcaggtgcctaaccattccccgtactctcggatcgcgaaactggcggaaggtgtctcagccacttggtagaagaggcgcagcagcacagggttccccatctggtcacatgataacccatttaggaaggccatcatggcttcactgtgttg

SEQ ID NO: 525144 - DNA, 2546 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctgtgggagatggagaggtagatcccgtagccggcgggcggcgacgtcccgaccagagcgtgtgtggcccgatggggtcatcccctttgtcattgggggaaacttcactggtagccagagggcagtcttctctcaggcccagtggccggtcagccacaccagggcaccgcagccaataaaccgaaagtgttacagccaaaaaaaaaa

SEQ ID NO: 525145 - DNA, 2256 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccacatccgtactggcccgtgggccagtgttaaaattctaattgcttggccaggcacggtggctcatgccagtaatcctagaactttgggaggctgtggaggtggatcacgaggtcaggagatcgagacatcctggctaacatggtgaaaccctgtctctagtaaaaatacaaaaaaaattaggcaggcgtggtggtgggtgcttgtagtcccagctac

SEQ ID NO: 525146 - DNA, 1319 bp, Homo sapiens
  misc_feature (1045)..(1045): n is a, c, g, or t
  misc_feature (1097)..(1097): n is a, c, g, or t
tctcggcaatagaaggttgttattattaatctcgccctcattttgccataggagggtcttttattttcggggatgaattatatatctcccccccttccggggggggcgttgtgtgtgtgttcggccgacaacaatgattactgccccgcgacggtcgtggtcgcgcccccctcgcgggaatgatttgtaatgaagaaggtgtccccacgagcttctctatcaggtaggtaggtttgtcggcgcttgtatgtgtttcttatgtggagtgggtgtatccctgcctccgttttgtcttttgtctgtcccgttccctctatcactacgtgcagccgctaggtcgactaactgcgccgccttcgatggtggtcgatgatgtgtcgctgtgtgccttcgtcctccgctcggtctgggggggcgcctatggtgggggaagcaacaccaaccgaagtgctgcggtggggtgatcacgcaaaagggggtggatatgtggggagacccccccgtgacgggcgttatagtctctcttgcccaccagaagtccttcgttatatggagtgctccccacatggctccacgcacacttttggggggtcccaacacaacaacaacggggtgttatatttgtcttgtagacaacacccgcggggtctgtagacctctgttttctctctctcccacagagggggggagatctctccctctttgtgtggcgttgtctttgtgagaggcacacaccagagaaattggtgtcacacagggcgcccacactggtttgtatattgtgggagattctctctcacgccgagagtagggcactacttgacacacgcggctggtgtgacgacacgcgcgtataagattggtgtgcggcgagacactctcacatgcacacacgcgcactctcgttggggcgtgttcacagcactcactcatagactcgcgctatatctcgggccgtcggttgtgggctcgggccacacacggggacctcgcacgcgcactctcacagaattctcgcggagatgtatatagagagaggagaganagagtcacttgttatagagatgagaactgagaagcacaagagaagttatatncacgtgatgccccgcacgccacaggcacagagaaccacaccccacgggcacaccttccctcggactcggttctgcttagatggccacgagcttctcgtttgctggcgtaacaccggagcacacacctcggtgcgagagtgtcggcacaggtgaaccacttggcacacacacgctatgaaatttatggcacgagcctttaccaaatataaaaaaaaactggca

SEQ ID NO: 525147 - DNA, 686 bp, Homo sapiens
gaaacaaaattttgctttggtacccaggctggagtgcaaggatgcaatctcggctcactggaacctttgcctcccaggttaaagggatcctcctgcctaagcctcccaagggggtggactacaggcacatgccaccacgcctagctaattttttggatttttaggaaaaagggggcttcactgttaggcatgaggggctccatttcctgacctaatgatttgcccacctcggcctcccaaagggctgagattacaggcgtgagccacggggcccagtctgttgaatttatttataagcacaacatgtttttagatgttactttaaaggaaaagggattcttatttcattttccaaatgctctttgctcattttccgaaattcacaagaccccttatattgggagcctacattttggaacactaccaaacctcactgatagttttgggaagattttggagatttctagcccttgtaacaaaccccagctttttctgggaaaaaggccgggctaaattttttttttcaaaacttaattaaattttcttactttattggcatgggtaagagccttaaaataaaggcggaataaaaagaggacaaccaggggttccccctttttctctgggttaaaaagaaaaagaatctcacctttggccacttaaattaaaggtacccggggggtttt

SEQ ID NO: 525148 - DNA, 1256 bp, Homo sapiens
gaaaaagaaggaaagggagagggagacggctggagcccgaggacgagcgcggagccgcgggccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagtggccggtcagccacaccagggcaccgcagccaataaaccgaaagtgttacagccaaaaaaaaaa

SEQ ID NO: 525149 - DNA, 351 bp, Homo sapiens
  misc_feature (3)..(3): n is a, c, g, or t
  misc_feature (18)..(18): n is a, c, g, or t
tgntggccagctttaaangagtaagaaagtgtaaggctctgtcccccagggtctctgcccaggaaaggatggggacccctgtggaagctggtgagaggctccgctcaggggcctatgtgtttcctggcatttggtttttaatgtttgcttgtttgtttttcccttattttcctcactatataccctctgatttttacacttgacttttacagttgggtgatatgtgacaactttccgtttcttcagtctgcctgactactttgcttatccaattcatttggtatttattatgcaaatactttcagaatacacagctccaagcctgggacagtgcttgggtgagagctggag

SEQ ID NO: 525150 - DNA, 434 bp, Homo sapiens
ctctgaggcaagaataaaagggacgagttcccgtgcccccttttaaccgtctggatcagcttctacgacttggtcaaactatctttctttctgtctgccatgccaggaaatccagtgacagcaagacccagagctcaggcacatttgcgagggcaggtccatcgcgccactcctctacttctagtgggctccagatgccgagcagcagccaccatgatgcggctgcgtacctcgttgcctgtaggcagctttcttctcggcctcacccaccgcaaccatgggcttgatggctgcgcggaaggaggatcacgcacagggtgctgttgccaggggccctggtgttgctggcactgctctcaaaggaagagtgaccgttgtgaatggtttcctgtaacatttgtctctcgcgtcccttgccttagttcagagccagg

SEQ ID NO: 525151 - DNA, 414 bp, Homo sapiens
ggaagaccggggcggtcaaggcatgacaaagtcggctattgacgtccgaatgcctatactttgaatacgcgatctttgcccgcctcctattgacagctataaggggctgggatatctacaaagcaggatttaacaacccaagcgatagaggaaatcgacgatgagtattaaacctggccctaagagaatgaacgaggatggcaccccggacaagaggcagagagtcacgcctgaaaagcaaaaggatcatcaaaactgaaacctcataagcataaacagggggagtaggatcaaaagcagctcccgagcctgaagtggcccgataatctggctgacttcagccttcttcaattttgaaagcggcccgttgatcaaaatcgacctgatcgcccactcaacctacgtacgccatct

SEQ ID NO: 525152 - DNA, 1362 bp, Homo sapiens
taaaacaatggatttaaatccagtgtcatttaatctttatatgtgacctgggttcttctcattctggacttaagggcgttttctgggggggctggtgataaaggttcttacatcaagatgtcctccagttactctccaaccatacatcccttcttccgcgtggcctcaaacacctctgtgggacaagagggtgcgaaaggtctccgtggtagtgcgagatagacactcttcgtggagagagatttataatctttacaagagataaccaagtgcccacacgtggcatttcccgctgtggccgtgagaggccataacatctcgtgaaaatctcagggcttctacatttataaaaccctttttatacaaacgaagggtctcttgtgagaccagaaatttcaaacagccgcgagaccaatcttcgtgcccccaacccaacaaaatgttctccatattcgccgcgggacaaacatatgctgcggcatcacgggtggtgttgagggcggaaaaatgtggcgtctgatgctcattgctgtggcaacacgcctcatctcgttttgttatactacaacgcgggagtgcggcatatataaatctccaccaatttcgggcggatcattctctctcgtataaactaaaaattttctcataatataagcgcataagcgatttccggggggtaatctcccacgaaaacagaccagcagagacaaccaagaggggcgtacccggtggggcacatttctccagatattcacctcttaattaacagattatcccaattgggggggcaacataattactaagaacatcgtaggttaaaacacgcaggcgacgtagaacactacgacgcacgtgctaccaccacacacattttttactgccccaatgttagggggggggactccccacaacccgcggaggagggcggcgcttattaacaagcctcctcctccttgttggacgcctgccccacaacgacgtatatatttacatcccccccccccttgcttattctctttaataaaagcatataaaaatagggggtctgttggcgccaaacacacacatgttagtgtaattgatacgaacacaccgacgcactgtctgtcccgaagttattatgtgtttcttccgaacacagctcactttgttctcccgcttggggggggcgccttgattatgttgtattaccgagctccaacagagcagtgatttacaacgctgcaccgatcctactgcagttaacgacccataacaaggaaatcaatggatgtgggtggtagggaccgccaacaatataaacgattactccaccacaagcagtgtgcttttctccgccccgccgcaacaccatgcttgtgt

SEQ ID NO: 525153 - DNA, 461 bp, Homo sapiens
  misc_feature (3)..(3): n is a, c, g, or t
  misc_feature (5)..(5): n is a, c, g, or t
  misc_feature (315)..(315): n is a, c, g, or t
ttnanttactgctgaacgagagcttttggtgcgacagctcagaaattgttgaccagctggaggtggtgataagaaatataactctcttgcgtacagacgcttgacacactagtactaaaacaatgtcgtgactaggcagccgccctagtcgtgctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatngtgcttggggtagggattactctccccagcatccaaacaaaggactgtattgggtggcgccattgaatacagatgggagactgttggagtattatagactgtacaacacactggatgatttgctattgtatataaatgctcgagag

SEQ ID NO: 525154 - DNA, 455 bp, Homo sapiens
  misc_feature (84)..(84): n is a, c, g, or t
  misc_feature (87)..(87): n is a, c, g, or t
ggggggtgtctttttaggttcagggggggccaggagggtgggctccctttctataactactaccacagggggggcatccggggnttnaacagggttttttccggtttcctgtttttccccaattaggggggggaaagggggttgggccccaggggcttttcccctcccttggtttttgggaggggcccccctttgtggccggttgggatccttgcaaagccctttttcccccccagaggggtttttcttccggggggccccccttgacccccccccaggggcccccccccccaggggttttttccttcctttgaaattttttaggggacccgggttggggggtttctgggccccttacccaagccctttgggggccccccttttttttttttttttttttcagggtttgggggggggggggggatatttaaattttttttgaattccatccttta

SEQ ID NO: 525155 - DNA, 687 bp, Homo sapiens
  misc_feature (300)..(300): n is a, c, g, or t
ccactgcactccagactgagctggagtcttgctctgtcgcccagtctggagtgcagtggcgcaatctcggctcactgcaagctccacttcccaagttcaagcgattctcctgctcaaaaaaaaaaaaaaaaaaagttaatcttatttggctgagcggctcgccagcagacggagattagttagtccttatttggaagggactcaactcccgttgggtctccagccaagtttagtggcggtgacaaacgacaggcaacggagtttgcaagataactatactggaccctgtgagaatgtcancttcacggttaccaaagggtaccaaaacagtgccccttaacaaacgggctactcaggaatggcattgctttcagggtggaaagggggaccaaggagcaaagttgagttgtggcttgccgtgccatttggccaagagtccatccttattattgcagctgctccttattcctttctgaagaagcacttaacccgtggtggatccctttcaagagtaacgggtaggggttataacagggaagtctgcagaatggtggactctgataaaaattcttgggagcaggatatgtgtgtgtaaagtctgactaagttaccaggcactaaatacaatcgacttttaagaacacgggccataccacagctggcttaaaatcctattagcagagagac

SEQ ID NO: 525156 - DNA, 838 bp, Homo sapiens
cttcttgggggggtcccctgtcagctctgcgtctttgtcgtgtctatatgttttggtcgccacctgttcatgggcggcgcccccgtggtcccctccttgtgtgtgtcgcgcccggtatccctttgggtattctccgcccgggagggcttccgtggtatccctccccctaccggctctgggtgacacggccgcacttccgcatggtttacccgcgctgtccttacacctgggcactcccgcgggctttaatgcttgttatgtttcctcacgcaacttgtggcaacccccacgcatttggtcctccgctcaaccaaggggcgcccaatgtaaggtcttcatacaagaatgaatgtccccccacgctgctggtacgaggacggttcaccactgatatatggcaaattcacggtgggtcccctcaagaatgtcgtcatgggtggtggcatggatccatgcgcccccggtagacaactcgggcgtaatggttctccgtactaggcccgtgttacaacggagtcatctttccttcgctccctcaacacacgccggggcccccccattcctcccttctggtaagggggcgatgcttccaagagaatgctgcacgaccgcctcgggggccccattcgcacgcgcccccactctttgtgagccacttgatactccctctgaagtcttgtcacacgcaggtcattatggtctggccgcggccgtgctgtgatcccctgccacggaccccccttggtatacaggtgcttttctcacactccctcttccccgtgccctgcctgtgacatattatctatcccccgattcccggggaaaatgtccacccgga

SEQ ID NO: 525157 - DNA, 659 bp, Homo sapiens
gcttcctccatcctcctccagctccggctttggggggatcactgtcctctctcgagcagctagaatgagaccggaacaggatggtcctgcgtccgagcaaagttcctgcggcacgtgatatggacagccggccaaggccggactcagtgctatgaagatgtgctgcgtcgtcacagacgcaccatggagtacaggtggcttctgtgctgtcaacacctaagtttgatggccctgatctgtgaggccagctgggggaggggccttcctggtgcatgcccactgggcaagactggcatcggtgtggatcgaagacatgcgcccacgggtactgtggcacacacaagccccacatgatgactagaacatcgcactggtgaccccgcaacaagggacaatcgttacacttggccagatggagctcacgaagagaaatgaacagttcaatgggtgtggggagaatccccaagactgggggagacctgagagcatggccccttagcgtgaacgccccgagtccaacaaacctaggaaagggccaagaccaaaagcgggtgaagacaaatgatgggcctggacgagaacaaaacggccagaacagagaggctcagtgcaaggtagtagaccaacgggatcgatggtgagagacgggagacaatgag

SEQ ID NO: 525158 - DNA, 206 bp, Homo sapiens
aggtgtgagcagaaatatgctatggggagaggtgtagggaatgagagagaagtaaacctcgatggatagagtcctgagtccgtaaaaagaaacaggaatgtgggaggtagggaccaatagggagagagtcagtcttaatagtaacaaacagcactaaccagctagcgaggtgcttagccactgcacaagtctgttctggctgagac

SEQ ID NO: 525159 - DNA, 457 bp, Homo sapiens
  misc_feature (6)..(6): n is a, c, g, or t
  misc_feature (43)..(43): n is a, c, g, or t
  misc_feature (64)..(64): n is a, c, g, or t
  misc_feature (66)..(66): n is a, c, g, or t
  misc_feature (91)..(91): n is a, c, g, or t
  misc_feature (129)..(129): n is a, c, g, or t
  misc_feature (237)..(237): n is a, c, g, or t
  misc_feature (267)..(267): n is a, c, g, or t
  misc_feature (281)..(281): n is a, c, g, or t
  misc_feature (318)..(318): n is a, c, g, or t
  misc_feature (390)..(390): n is a, c, g, or t
  misc_feature (417)..(417): n is a, c, g, or t
  misc_feature (455)..(455): n is a, c, g, or t
tcattnttgggtgataaaggaaaagtttgtggagtttgttaangctcatgtgtcccaggggcananaaggatgtgttggctcttaatctanctgctgcagcttcgtgtaacctctttgcatataaggancccttacatttgaataggacctttgcttttaaaagtgccctgactggctaggtgcagtggctcatgcctgtaaccccagcactttgggaggccgaggcaggtggatcncctgaggtcaggaattcgagaccagcctgnccaatttgatgatnccccatctttactaaaaatccaaaaattatccggacncggtggcgggcacctgtaatcccagctactcaggaggctaaggcaggagaatcgcttgaacccaggaggcanaggttgcagtgagccgagatcgtcccnctgcactccagcctggggcaatagagctagactctgtntc

SEQ ID NO: 525160 - DNA, 133 bp, Homo sapiens
cacccctggaactatttggtacaatatttggtgcaaagacaggcatgaggagtgctattccatgcttgccttttgcaattacctgcatccccagcactggtcctgggcacttccccacccgcagccaggctgt

SEQ ID NO: 525161 - DNA, 469 bp, Homo sapiens
taacctggcactctttaaaaaagagtcgtctttcttctttcttctcctcggttctctcttcactaataggtaattgcgactccatactatgggacacccccctcagctgcatcctccaaactagaaagagttaatttcccaaaccttaaactacttggcttgggattggattcagaggaagggagctcagaagcccaacatgcctgcaaaagggtaaagtatttttgccagtcaggcttgtcgcctccccttccctgtgcaaactggtaaaaggccttggaattttttgagctgtccttacccctccccttatttggtttggacacatgttttctaataacctggtttgtctgttcttgtcttcaggccatcagactccaaacagttatgcaactggagcctcctgaggatgaccccttctgcctgggacccttagatcagcctctagagaagctttgactgctgtttc

SEQ ID NO: 525162 - DNA, 133 bp, Homo sapiens
tatatggtagtcatcacctgaggtctggagtacaagactagcctggccaacatggtgaacccgtctctactaaaaatacaaaaattgtggctgggcacggtgtgctcactgcctgtaatcccacacactttgg

SEQ ID NO: 525163 - DNA, 659 bp, Homo sapiens
tacagacagaggtacaattcctcttcttaacaacatacccatggacaacctcctactcctcattgtacccattcataatcgcaatggcattcctcaagcttaccgaacgaaaaattctaggctatatacaacatacgcaaaggccccaacgttgtaggccccatacgggcatactacaacccatatcgctgacgccataaaacatcttcaccaaggagccccgtaaaaaccgacacatctaccatcaccctctacatcacacgcccacgaccatatagtcatctcaccgatcagcatcatatctactagtgaaccacaccacgtcacccagtaccacaaaaccaccagggatacaacccatcacaccgtagagaacgatacctattatattcatagaacaacatcatagaccactaaacacgatttacatcaaatacctactgcatcacgaggtgcagcacttcacaacatcaatcaataacagcacagaaaccggaggacacatggagaaagacagactaaactaagaaaacacttaataaataatgaaggtccaaccactagcaacaaccattcacgtaacataatcacaaaaataaactcacaacacgtgggactaccatatacaaccagcaccaacacctaaagcaaaaacaaaa

SEQ ID NO: 525164 - DNA, 187 bp, Homo sapiens
gactgtggggaccttggacctagggggagcccacaagaagccagagagactggcccagcctcctaaggatctggaagcccgaactggggccggacctctcgcacgtggagagcggctgaggagagtagatgagagctcgaccccaggagccaataacgtgcaggttaatgccctagtgcatagcatg

SEQ ID NO: 525165 - DNA, 328 bp, Homo sapiens
  misc_feature (19)..(19): n is a, c, g, or t
  misc_feature (161)..(161): n is a, c, g, or t
  misc_feature (317)..(317): n is a, c, g, or t
aattacccacttttccagncggtcatatgataggtcttgccaaatgaagaaaccgccactgcccctcacgcagctgcggatgcgccagcacactgcatggccctgttgtgaaaagttgatgtgctcgtagacttcatcgctaatgacaaaaatctcgtgcncgcgatcgcctgccacaaagcggcgaaatcagcctgctgccagacagttgcactggggttatgcggagtgttgaggatcaccagtctggtgcgctcgcttaataatgcggcaaattcctgccagtcaacgcgaaaatgcggtggttgcagtgccanaacgcttcact

SEQ ID NO: 525166 - DNA, 1913 bp, Homo sapiens
tcgcagtctcggtcgtacctcccctagttgcaaccttagctgttggcagggtgaagagatggcttccccgtctagacagcccccgccaggggggtcaggactgcttcaagggagccgggctcgttcatatggaagcctggtgcaatcggcctgctccccagtgagggaaagacgcctggagcatcagttggagcccggagacaccctggctggactagcactcaaatatggggtgacgatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggaccttacccagggcttgggctgaatctagagttgagtccattacactacaaaaggcggcaatttatatcgcgagcgtgccatttacatatactttctttttatatccttgttgcctttcctatcctttttacctttccctggccttagaacagggaagcagagactccccctcagcttcttcctcatctccaactatgtgacataatttatttggtgctaatattgaagtaatatttatttgctatattttatttcttcccactcttagctgaaaaatggaatttctatagccctggggtgaggagaacccgggaacagtgagccagtgactgctggttctccactttccccaccttgttagccaaacatgttattgaggatgaggcaatcggtgatatagcccaccacagagaatggatgactgttggccttttctccaatctcaaagtgacagatttgggctgattcttttttttttttttttggtaccccattcctgttgaatgggctcagtcttgacaaaccaattccctgtaactttttcacaattcttgactctgagaaaaagcagcactgtagggacctgaactctccattctaccagttcacccttctgacctgttctgctcagcctgtggtgaggggaacagatggaagaaggctttccttggggtttgaagaggaagccagttgtgggagtctctttgttacaccccctcccctccagaccctctctctctatgccttcctcctcactgcatatttatttgcgatttgtagcactgatctatggtacagttgttttgtttcttaaacagaagtaggtaagggaacctcagtaataatggaaatctgcctcagtctcctgtttggaaatgatgagaggtgagataagtaatgtttatatacctcctttcttctgtgatgattataaggtatacgaagctggacagattaaacattgagccctgtgc

SEQ ID NO: 525167 - DNA, 98 bp, Homo sapiens
gcacgcaagcagcacattgtcaaacccggtttaacgacggcatactatacggttctacggtagcgaaggctgggtttgcgaattccttacctagtttc

SEQ ID NO: 525168 - DNA, 204 bp, Homo sapiens
tctcacaacatcaaatcagtatacataccatctgataggtgtatcaccgagacattgagaccaaggataatgtggtgaactcattatctatagcatctagtagtttatggctcgatgtcacgtacacataggctattattatactcagtcatgttctacgtggcctagctttggaagccactgttcgtggaggtagcactgggt

SEQ ID NO: 525169 - DNA, 790 bp, Homo sapiens
tgcgtcaggctgagcgccgagactcgtgcgggaaggcgtctggcctcggttgacgggctcggcgcggggtccctggtccttcttcttcgcggtgcagctcgggcattcggccttgtacccagcccccacatgtttcagcaagagctcccagcaacgatctagacagaggtaaaggttggttggctggcaaacggttactagggacaccaaagagtcacggttgattggcccttaaccagcttgacaaacatttcccacagcattggacgaacagacccatcactgaccacagcttgcacgcgaaccttccacaggcacgcaacgccagaaacttcctttgcccattcgaacaacccagcttgcgtggtggttgcttcccccatttcaccaagggggcctattaccgtgtgaacaacattccagtcacctcactggatggggctcacgtccagaatcacagtttggtggcaaacactctaaagcatttactttaacctggaacggtcaatcaaagttccccactggagcattggtggccagcgtgcgtttttccaccacgcagtcgcgctccatttgcgactcctttgtggggtcaaccgaattcttacacttggggacagtagtttacttccccatggatcttgtgcacaccaatctcttctttggaaacgcactttcgtgtggcacgcgcaggttccaacacacacggtccagagtggctacacagtccttatactgcgtgtagacacacgaccttgggaacacccaccccgcttggccattaccttgg

SEQ ID NO: 525170 - DNA, 567 bp, Homo sapiens
ataccgtccaatccagtagtcccactcctgggtgtgtatccagagggaaataaatcattctcttgaagtcatacctgcgctcgcatgtttactgcaacacagttcacaacagcaaagacacggaatcaacctaagtgcccatcaacagacagttggataagaagatgtggtgcatatatacacaatggaatactgtccagccataaaaaagaatgaaactgtcctttgcagcaacatggatgcaaacagaggccatcatcctaagcgaaacaactcggacacagaaagacaaacaccgcacattctcacccgtaagcgggagctaactcacacgtccacacagatgtgtggaatgagagacactggaaacttggaagggtacagggtgaggggagggtagatgctcagtgggtgtgattacattattcccataacggctgcactgaaagcccagactttgccaccacgaagtatgtccatgcaacaaaactgctcctgtaccccataagtttatagcgaaaaagttggatatgttaaaaaaaattaaagcttgccattaaatctaaa

SEQ ID NO: 525171 - DNA, 420 bp, Homo sapiens
  misc_feature (13)..(13): n is a, c, g, or t
  misc_feature (20)..(20): n is a, c, g, or t
  misc_feature (39)..(39): n is a, c, g, or t
  misc_feature (171)..(171): n is a, c, g, or t
  misc_feature (419)..(420): n is a, c, g, or t
gtaaaagctgtgntcaacancccacagtgtaagctgtgnaaaggtttggatgtttgtccccctcccaaatctcatgttgaaaatgtgatcccccagcattggaggtggggcctgaatgggaggtgattgggtgatgggggaaagttgccctcatgaatgacttggtgcccnccctggaagtgatgagtgagttctctctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaaaataaagctcttttctttatcaann

SEQ ID NO: 525172 - DNA, 376 bp, Homo sapiens
aggatccccaacgctcatataagcggtagccagatgcagtggcttatacctgtaattccatcactttggaaggccgaggcgggtggggcacccaaggtcaggagcttgagaccagcctggcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactgtctcaaaaacaaaacaaaacatatgaatgtaaaacatttagtgaagtgactggtagctagtgaggggtcattaag

SEQ ID NO: 525173 - DNA, 484 bp, Homo sapiens
tggaagacaggtggaaggaatggaggattggaaagcaggacagcccaacttcaagaaggccccgggagggacatctttaatggagacccctgaaaagacatccgtggaagtattaacaaacgacaagtaacgttcccccaggaagaagcttagcccccaggaaaaacaaagacccagttggaccccagagatgccctgagttggagatgaactttggccaactttcctcatcacccatacttaaaatcctgtccaaggaggagcttattcaccattttctatacatgtgacatatgtagcagcataaccgacaactgggactcgctgccttgactccacctctacatacaatgactcagctaaccagactaataaaagccatgtttgcaccattgctcagggaggcattgctttggggaattattcccagtgtcctccttacttatcgcaagtaataaaaatcccctgggaaatcctcaaaaaa

SEQ ID NO: 525174 - DNA, 194 bp, Homo sapiens
ctggtccgccatcctcttttcttcatggtgctgggtgctagggcgtgatctccttctgcattcggtcggctcctgccaggatacattgtggtgccccctgataggacattgttagcattgaggtccttcctgatgtctatatcacacttcttgatgctgttgtaggtggtttcatggatgccagcagactccat

SEQ ID NO: 525175 - DNA, 566 bp, Homo sapiens
gacatcatcatatgccaaacaatgatgccccattcacatcttcctcatacctcttccatgtcctagagctcagaggagctatagcagctccacggaatgcccagttaatctgccctttccctgcactatgcattctgaatggctgctcatctgcctcctatccgtggtggtcctcgatccaaacatgtatctgtccgttctagctgatattatatcgttgcaccctggtaactggttagggaccaggccaatccacttcatcgcgacttactataatggttggaactaaaacgttcaccaaggtggcttctccttggctgagagatggtaatggccgtggctggggatttgctcctggcgttcccataggctcctagtggagtggcacgaagagaaaccatcctctccctatcttacatccgtgaggtcaagatcccctcagaaggcaggagtgctagcccatctcccatggtgcccgtgcctctgtgctgtgtatgtgaaccacccatgtgagggaataaacctggcactaggacaccatcacaatcatggcaagccaacggggg

SEQ ID NO: 525176 - DNA, 626 bp, Homo sapiens
gccctgcagccgcgtagatgttgatgcctaagaagaacctggattgtccatttatgaagctcctttttttaggcccggacgtcatggtgcgctcgaagaacggatgtccacatggcctaagtccacccggacggctggtggacaagaatgtgcccaaccttcatgtcatgaaggccatgtcggtctctcaagtcccgaggctcacgtgaacgggcaacagttcgcctggagaccatttctactggtaccttaccaatgaccggttatccagtatctccgtgattaccttcatctgtccccggaggatagtgcctgccaccctacgccgtatccgtccacagactggcaggcctcgcggctaaaggtctggagggtgtagcgaactgtggagcactcacgagagaggggaacgctgagcagcagatacctacgagactggagtgcttgttgcctacctgtctgcccgagctaggaagaagccgtaaggctgtcgcgctgggtcagcaacgcgaattccacttcagaggcggatatggtcggggcacgtggtcagtcacctcagtacaatcggagaggattcttttgcattggataaacttacagtcaaatgacttattaatcaacgc

SEQ ID NO: 525177 - DNA, 1144 bp, Homo sapiens
gatgaaagtccaaaaccaggaaaattccaaagaactcgtgtccctcgagctgaatctggtgatagccttggttctgaagatcgtgatcttctttacagccattgatgcatatagatctcaaagcattcaaagaaacagaacgtcacatcaataaagcaggtgattgttcggaaggcacagcatgttacttcaaacactggcatgcaaacaaacataatgccttatcctatgtcaagttaatcatcaaacagcaaaatgccaggaactccaataacgcaaatcaaatatgcaaccagaccagtgcatctatcaaagctagccaggctctataaacatgctagtgttgcatgcaagaacatggaaacagggtcccatagcaagcaagcatagacagccagaaagacttcttctcaattgccaactgggcaagagcaacacttttgcattgcatgcaattgcaatcacaatatgacagcaacgcaagggcacctaaagcagcgcaagaatcaaggctcagtaccccaaaaagtagaatttaatagcacaatcccaaaggatcagattactatagtcagaacatccgctatgcctctaaacagcagattgagtctgcagtacggttcagaaagcagatgcagacaaattactattacttaattatacataaaagcaaagagcctgaaaaatatggtagcacacaaccatacacaatacattcaaaaatctctttaccgaagaatagactcctgaccattcacctacataacatatacatactgcaaaatgtttccaaatgacttttgaaaataacatataacaaaattaccacgattgagagaaaaaagaaaaatacactcaaagacaagaaaaaagaacaagaccacatgcagaacagaggacatatctacaaaggagaacaagaaatattaaagcagaagaaaggaaaatgaaagcataaaaataaggacgaaactaagaaggagataaagaacagagtgagaaagaaataaatgatccaatattatgctaaaaaaataatatgagtgagaaagcaaaaaaagagtgtagaaaagaccaataatacgatacgacgagaaaatatacagaaagaaagatgaagatagagatagtcatatatagaata

SEQ ID NO: 525178 - DNA, 362 bp, Homo sapiens
aaaagacacacaggaccacgttgattcaccgccacctccagtggacaatgcacgaccagtttttccctgctaccaaggtcaggatgtcactgtttcagggtatacctgttgtgtgcactccatggtgttactggatgcactgttcagggtacgacgtgttgtgttagcgcagggtgttactggacgtaactggagtcaggttcttgcagtgtcagcccccctttccgattcactgggacggtgtgtggacgtcacccggaggggtacattggtccgcgaagtcagtccgtaagtacgcgctgttggcgtgtcaaaggtcggagtgtgtgtataaggtttatagatttatatcaatctgccta

SEQ ID NO: 525179 - DNA, 204 bp, Homo sapiens
cggcctgaataaaacttctaaagtcttcagatgtttcatgttgatgacctacccctttccttgaggctctcctctgtcataaatgcacttccaagaactctatttatctcctactccccgagccaccattctcatgattctcatcaagtgaaatgtatttacacaaatgatcagctccttggttttcagacctgctcttaccgt

SEQ ID NO: 525180 - DNA, 351 bp, Homo sapiens
tcgcgccgaattcggcccgagagcaaagcccctgcccaggggcgctggggtaaatccctcctcctttacaaagggaggaggggagagaaatttggccgggccctccatccagcctagaccaacaaccaggaagaccgactgtgccccagcttctattgaagaggaggctgtgctcaccactggacaggacctgagtgttcaacatcactaaaaaaactggactggagcccctgctcccctatgcacactctgaactgctcggttgctctttctggctctctggagaactcatggagccgctggctgaggacgccccacccccaagcagaaataagaatgaagtgcctgacc

SEQ ID NO: 525181 - DNA, 1787 bp, Homo sapiens
  misc_feature (889)..(889): n is a, c, g, or t
tcgctgtttctaagacctgttttctccgctgctttatgtctgctcttatggcgcgcgcttgtgtgattccgccagctgacagagtgatgtgcatcgttttgggggctgttgtgatgtattatctggtgagacggatgacttttttttgtgggtgccacaacgagtggaccatttgggggaaccaacacgcagtgggtggagcacacccatggtgtgggccttttatatagaacgccgggggtttttaagcacccctttgttgtctcccaccacagcgcttgctgtggccgccaagaccgcgccaacccgccgcggtggagttcgcatcctacaaccctggccgcgcttgtgaccctgcgccgcccctcatggttcctcgggtcgttttttttttttttgggtccgacagaaatgttgtgaaaaaccatctttgttgttggtgaggaaaaaaaatgcgccgccccaaggttgttgggaagtgcattttaaaaaagagtgttgttgcctccaagaggggatgccccccccccccttgttttaatagggcgcccacccccccctcccgggggtttaagggaagataaaagagggttgtattcatcaacgcgggtgtaatataagatgatactcctcatgatggtagccccctcccccgagcctttgtaatctcgcgtgaaaagtagggagagggaaggaaaaaaaagcgcccgcgcttcgggccccccctcgtggctcccccctccggaaagggaagagaagagatatggattaggagaaataggggagcgcccacggccgcgcctctggcgtctccttgagggccccccacaacaggggcccaccacagggagcccccccctctttcgcgcgtgtcacaacacccgtggcnccccaccacagaaggtggacccccctctttgtttgttttgggataagaatattttttaacgccgccccacagttgtactcccccccccatatggaggggcacacacacactctctctctctgtgtgcgccacagctgcgcccatagatattttctctggggggcgccacatcttttggatataaggagtcgccgcggctgtgggggccccccctgttggggaaacactcacaagagagtattttctgccgcgtttctccccctgtgagagagatactttctctcttctctcagagcgccttcctacatagaggagcgctcgcgacacatctgtctacactctacacctgtgagaatagtgtgtctcacacgcgcgacactctggtgaggcacacagcgctgagagagagagagagaaattgcccctcttgcgcccacagcgggtcacatcacctctcttgttggagacaccacaccacacagatagcacagctccccacatctgttctcggagagattctcgcggtgtctcttccgagaggccacagcgagagacttctcctctttcccgctcgagaggctccacagcagattgggccacgcgtggagctatacgagagttcacaaacacacactcggcgcgagataactgtgagttcctcggccacagccgagaggagagagacccacagagacgcctggtgtttcgaggagagtaactcttgttcctcgggagagggggcctctccacagccacaagtggcgccaaagcctctcacatcacgggcccagagtttttacacatgacacttttttgccctcaccctatagctgcccgcaccccgccccttacagggagagaatgggggtccattaaagggaactggaacccttgtgaa

SEQ ID NO: 525182 - DNA, 172 bp, Homo sapiens
cctgaaaagagcataagcttctccagtgcttcctcaaaggtattttctcacaaacagttccaagctttttcaaactagttcctaacgtcacgccgtctcttcactcctcaaaacgtatgaccaacttgcatgtgctctggaggagtgctgaacactgttcaacaattcacca

SEQ ID NO: 525183 - DNA, 1188 bp, Homo sapiens
  misc_feature (1188)..(1188): n is a, c, g, or t
gaaggctctatcagcatgaggatgaggatgaggagggtagctcaggtgctgcatacttgttcttgaaaggaaaggagatcagaagctccttctgtgcggaagagtctgcgaagtttcctctagaaagagagtggatgagtgaagatgacggcacgtcagaaagattccggaaggagtgtaatgaatgagctgggacacaggttccacattcttccgtattccgactcagaaggaggaagtaagggataacaagagcgcgctggccttcataggatttcttaagaaaggtcgagcccaccagaggatgaggacaagaagggcaggcgtagaagaaatcgggagtgacaagagctaagaacgaagtcgagcgagcaggaaactaccaaggcgcctggtatgaggaggaggaggagaatgaagggggggcagtggtgaataggggatccaggggcggagatgccggttaggttaatggagaaggccaagagaatgtgtgtgccaggggaactgatatcagacatggtgttgttatcaagaaacgtagaatgagaatggtacaggcagagaggcgaagaagggaactgatcggtgactgccctagatggagctggtgcaagtgctggttcagatgggtagcggtagaagaacctgggagacgggcgtcattgtcaagatcaagttcaatatcgatcgcctctctctatgagtataacccgaacgtggtaacgtacatgaggccagagatgtgggggaagtgcctggactgatccatgatgctgatggatatccgggaaggaaagtccaacatttgtgtaggagagaatattcttggaagagagtgagaaccggggcaggctgacaggcaagggggtccgaggatgttcttaatctggtggaagaatgggtaaaaattgccaaaaagagcaagagacgagacgcaaaccaagggtagggaagccgaagaaagggcacagttttgcccacatccaaggggggagggcccggggaaaaggcaaccaagagcaagcagataacaagggaagtgggggaaaaaaagaggaaaaacaaagggagaccagagggaaaatggtaaagcggaaagaaagaacagagagaagagagactagaaagaaggaagaaacaggatagacgaaagacgaacgaagcgggggacaataagaagacgcn

SEQ ID NO: 525184 - DNA, 170 bp, Homo sapiens
aaccccgctggcaggccactgcgtccaccttggacagcaatcttaccccattcccaggatgaccctcgcagacctcccagtggggcccctgtgtacacctatcaattcttcaatgcccattccccaactcagcagccatggtacaagtatacaactgggtcacatcgcat

SEQ ID NO: 525185 - DNA, 246 bp, Homo sapiens
agctggtgggctgggagattattagacgggaatccccttgtccccaagagagcctaaggttggttcaagttctacacgttcgatagatagtctacgggagaggaggaggagtagggccgcctcggggctgggcatccggcccctggggccaccccttgtcagccgggtgggtaggaaccgtagactcgctcatctcgcctgggttggtccgattttggtaatcgtaaaaataaacgctcactccga

SEQ ID NO: 525186 - DNA, 89 bp, Homo sapiens
  misc_feature (11)..(11): n is a, c, g, or t
  misc_feature (45)..(45): n is a, c, g, or t
gatccgtcagncgactctaaagctaattgtttgtattggcatggnttttgccaggcatccaaaattcagattaaacaaccaatgcaatc

SEQ ID NO: 525187 - DNA, 355 bp, Homo sapiens
cttcagctgtcaggctcaggtatcctccctcctcagtctcctgagtagctcgtgcctacagaaacatgccaccacgcccggtctaatttttgtatttctggtagagattgggtgttgtctgtgttgcccaggttggtctcgaactcctgggctcaagcaagtctgcccaccgtggtctcccaaagtgctgggattacaggcatgagctgccataccttaccagaccaagagagtttaaaactactggaggtcatatagaattcaagagaattgacgactagatcacgaattatatcttatcaacattggatgccagaaaaggacagaataatgtcttatagaacctccttgtccc

SEQ ID NO: 525188 - DNA, 327 bp, Homo sapiens
ctggcaaccccaggcccagcctcaggcctgcccccctttcctcctttctggagtggtgggtacaaaaagtttggggccaccccgggtccttttttcccaagttttgtttttttcccttgtttttccccccccccccccaattaagggggcccccaggcctggtgctgccttggagggcttggggaaagagtgttttgaggaaggaggagggttaaaacttagggttggtgcccgaatgggctggagtgaaggggtgtttaaagtgtgggctggctgttttgctggaaaactgggggccggtttatggttattaactgctccattgcc

SEQ ID NO: 525189 - DNA, 139 bp, Homo sapiens
tactattatcccctatgggtttctgtcatactgagacaggctgtttttattacctggtttttcatagggaagaagaaaattaaggctaaagtttgtaatgatcaatggctcataattcctttaatctttcatacaagga

SEQ ID NO: 525190 - DNA, 149 bp, Homo sapiens
ataacatactgtcctcggtggaggcccagtacatccaggcccaagccaggtagcccccgtgatcccccagaacaccctgaagaagagagagcggaagcagagccctaagaggactaggacatccagactaccctaacagtaccggcaac

SEQ ID NO: 525191 - DNA, 464 bp, Homo sapiens
gcgtgtacttgctctttgtccttggcaggttacctaaactttctctcccagcgtggatttccttgcatataaagtggaactcctaatcgctgccacttgagcggttatagagaggttgcctcttagaggtttactgatctttaagtcctcattttcccacctcctcagggtcagtgctttccatgttagtaactcctgcaaatatgaggggagcgcacagctttgccacttgtgcattggtgattgtgccacggttttataactggggtttaaaaagtgatacatgctcaattaagacaatttttaggaaatacagaaaacaaagctgaaattatctatagtcttacaacttaaagacaactcttaactctttgcatatttccatgcagacctttattatttttctccatttttataattatcttgcaaatgggaattttttatcttactttcttgtaagataa

SEQ ID NO: 525192 - DNA, 1532 bp, Homo sapiens
  misc_feature (311)..(311): n is a, c, g, or t
gaacgaacagaagtagtgatctggtgctaaatagatgcctactacacttcggttgatgactacgagtgacttagcctggcatgtgggggctagcgaatagtagcccaaagaaccaagagaactaggacttgagatgtctcgaacggccatactttcgagtagactctaataggcctgtcaacatgtgcatgcatagtgatccagcagtgcgcacgatggaaggcccagtcacgtactgtgacagtgctcgtgacgacggatgagtcaaatgttccgcttctggggtctaggatacatagtcatcgggtccnttaggacatgaatttgagatgcaaaaatgtccttcaccttcatcgtagattgtgcttatgaacaccatgtacccttagcgtagagcactaaacaaggactgatatgtcgcagcataggagcagagctcccatcgtggagctcatagcagattcacctcatccgatcgacactctgcggaagtgcccataagggctagctgagtgaggaatgagaagcgaaagcgcaatggatagataagttctgcccctcgacgtagattataactttgagctagaaaatgcgcttcgaacagatcattatcgcaacgatcgcacttgccggttgggacccttgtttagccactcgaaattcaatgggctctacctttgtaggagtcgcttctaggcgaaacaagtaggcaagaaggccctttttcagggtcaataactcgtcctctgttggaggtagcacggaagccccttggtcgagtggcctctgacaagttgaacccttggagacgaacacccggattgtgcccttcactgtcggcgtaggggcccactcctaaaaattgcctccggttcgcaaatcgggcttgaaaaagtctaaggtccagggcgagttaaacaaggtgggacccataggtgggggccaatacgctggcgccctggcgtggcgtcaccgacgcctaagctaaggccccataggatagcgcgaaactacaggcgtatggaaacccatcttgaggacgcgtacacgcccatgatttcacagtgccccgtggggcggtgaaaattccaccgccggaagtaataggcacataaattgtatttgggcgcagatacgtaatgagccatccaagtattccccacaggcactatctcaacgccccatttatcacagcccccattttcatcactcagtagggaagcccccaacagcagggtcagggcccgcatttttcttcatgttacccccaggggctgaaacacgccacagctttgcgtatacccccattaatgcatatctacgcccggagggagtcccccgttttggctgagactttggcgggacactcgagagcgaaacatactccaccatttgctcgaagcctatattctcatccgttcggatagacgcacaaacaacgtcttcacacatgcacctcgtccctgtctgcaaacaccctttttcatagggctcactgtccacgatacagcgactgctcctcaactttgtga

SEQ ID NO: 525193 - DNA, 805 bp, Homo sapiens
agcgggtctcgccgtggagacccggcagttgggggatgccgacgcccgggccttgaggatgttgcggaagctcaccatcgagcagatcaacgactggttcaccatcggcaagacggtgaccaatgtggagctgctgggcgcgccgcccgacattcccggaaggggcaggcaggtatggaggtgcagaagccaggacgatggaccccggcgctaggtcccgcggaaccaggctccggctctggaccaagctccggaccgagcggacgctgcgtacgaaaggtcacgtcagccaaaggagctcagaagtacgagtatattaacaaatacagacagcatcgaagcacaagaagcttgatgtgtgtcgcaagtgtccaaccaaccagctgggccaggtccaaggccatctctggctaaattacgcagtgtgaccgtgcatcccagggacaccttataaatatcctgaatttgcctataacgtcgatacaaggaagaggtagagtcttctgatacagaaagtaattccgctggtagattatccgtggggaccacgggaagcggctaaaaagcactcagatcccgcagaatatctgggaccactacgtacagagcatccgactactgcagacaagaggaacacccagacccggacagacaggcggcaagcagcatcggacaggcggatcagaaaaagagcgtgcctggacccctgggcaggagcgactgagacaccaggcagggctcaagaaacaagcaacagaggaaccaagcgaaacatcctaacacagaagtcctggtgcgaaaacag

SEQ ID NO: 525194 - DNA, 117 bp, Homo sapiens
cccccccgcccccccccgggggtttttctttttttgggggtgggttaagggccccccccggtttggggttttttttgggggcaaaaaaaacggcccaataaaacccagcctttggga

SEQ ID NO: 525195 - DNA, 80 bp, Homo sapiens
tcaagcatctaacgatgtacggggacatgatcacgattatgccctgcacttcagcctgagtgagaccctgtctcaaaaaa

SEQ ID NO: 525196 - DNA, 205 bp, Homo sapiens
ggccccggggccccccctttgggccccccccccttaaggttggggcccggtcccccccagacccccttttttcggggggcctttttttggcccgggggggggaaaaaaggatgggggggcccgcccctgggttttccccttggggcccccccccccgccccgtttcccccccccccccgccccctttaaggggttttttttggga

SEQ ID NO: 525197 - DNA, 773 bp, Homo sapiens
tggttccgtccaagtgcatcttcccattacacttaccatgttacaatcttgtctcctctattataaatgcttaggggtttaagttaaatgtcctttgaagttatactttgaggagggttgacgggcggttgttgtatacgcgctttcaggggccccttgtttcaacttaagcacttcttacctcttcagttatacttgcttaaatctccacctttcgaccctttaagttttcataagggctattcgtagttttacgtggggtataacaaaatgtttaacgcccattttctgttgccacctctcatgtggggcttacccccctgttgactctttaacggttcttttatacgtgtgggatatacttatgcgcgcttatacttttatgatacgccttatcaatcccaggggtttagtgcttagacaaaaagtgcgcggggtattaattaggcttagaccgcaaagaggtctggtgtgaacggtttgaactccgggggttttaaatcggattttcacagaaaacgagggcctcccttctttagaaggggaattaatgaaaaggcaacccgcccgagggctccctttagaagtttatataacctggtgggctccgtaagttgtctctagcgcagaccctgttttgtctgtattatacatctgtcagagtgtttaagggctaaagcttagttggggtaatctaatccccaggtatgggtgttcttaacctatttgtgtggtcccgattttttaagggcattttcgtagtctaactgggc

SEQ ID NO: 525198 - DNA, 279 bp, Homo sapiens
caggttgaatcctgttccctgaaaaagagtattcggatcctaacccccaggacctgtggctgtgaccttatttggaaatagagtattttcagatgtgactgagttaagatgagggcatactggagtagagcgtgccctaatccaacaactgtgtcctgataagaggaaatgagcaccgggcacagtggctcacgcctgtaatcctagcactttgggaggctgaggcaggcagattacttgagcccagcagtttgagtgggcaacagatcatgactccct

SEQ ID NO: 525199 - DNA, 432 bp, Homo sapiens
tgtaattagacctccactgtgtacttagctggaagaacatgttaattctgcaatatgttgcgtggttaaacattgcgacagttcttacctcgtgtctgtaaataaagttttgtgaatctgttttgtattgtgacaaattcatgagataacattgatattttgatttgtaatatttctaatgggtagatttgattgaaaagtgaagatgagatgtatttttatatgttcaggggaattttaaagtcaaatcttgtgtagatgatttggaaaatcagtgtggtttattttacggatttaacccactggttgttattctgtaacaggttggataaatggtaaatttggaatgtgttgttattttacctagatgtagaattccacatgtagtaaaatgtacaaaatgttttgttaataaaatggaataatgtttat

SEQ ID NO: 525200 - DNA, 175 bp, Homo sapiens
  misc_feature (175)..(175): n is a, c, g, or t
caaacccactccaccttaccaccagacaaccttagccaaaccatttaccgaattaaagtattaggcgttagaacttgaaacctggcgcattagatattagtaccgcaggggaaaggaatgaaaaatttattacccaggcattattttggcagggactaacccctattacctcctn

SEQ ID NO: 525201 - DNA, 985 bp, Homo sapiens
  misc_feature (705)..(705): n is a, c, g, or t
ggggtgcttagcatatgaggagggggagatactaataatgcatttctaagttgaatagtatttgtgagaaagggcactgagtctctcactctttgctgtgttctagagcattgcatctctgtgcaaccactcactttcattgctttattcatttaccagtgttctatttgtggtttgttcgaaatgggtctctggtctctggattcaccgcaggggtgtccggtgccgcgcggcgggtgacttctgcggactgcctttgctaacactcatggctgttccgagggtcggcagaggggactgctccagtgcccgttgaaacctcggccattagcttgagggtattacggggcatccctgcgcaccactagagcttatgggctaagtattgcgtccattctaataggtaaaacgtggggttctccccacttttgcggttcctggctgggcctccagatgtccgttactgtattagtcagttactggcatcttactttgtctccacgtacgatggccgaggactgacagtgcctagttatcgccggcgattccgggcttaccccatatttggtttcacgggtcctccgggcatgcgggattggaccctctctatatttcagggagactggtaaaaccttcttgaggggccggcaggggaattaacccttttcttctcttgggggagggagcccacgccattaaagggtnatgggggcatgacactcttggcaatccggtcaaaatttggttaccatttcccagggttacgctattggttgttccctgggaaaacatctggctctactggcccccagccagttggtgttcgtgaggtgcattattaccaacggtattggtacttcccagagtctgaactgtgtcaactgccttcccgcgggtgttaaatccctgaacgccaccccagcggacacgtcactcatgctaacaaatagtcacgtgtgagccaggaaactggttcccggctact

SEQ ID NO: 525202 - DNA, 718 bp, Homo sapiens
ggagtggcaatttcatatggttcaataaaataaaattgagaccgggcacagtggcttatgcctgtaatcccaacactttgggaggctgaggcaggaggatcacttgagctcaggagttcaagaccagactgggcaacatggcaaaaccctgtctctacagaaatgcaaaaatgggccaggcgtgatggcgcatgcctgtggttctagctacttgggaggctgaggtgggaggatgcttgggcccaggaggcggaggttgcgatgagctgagatcgtgccactgcaatccagtctgggcaacagaatgagaccctgcctcaacaaaaaaaaaaaaaaattacggtggaatggactttatatatttctccttctttccctttttaattcttaccaatataaggtccatttgggatttaaggggccattccatggggctttgggaagttggaaaactggttaaagaagccttattcaaaagccaattgatgcccttaaaagggttcaacctataggagcttatgttgaaggggatttaaagaattaaggatccttagaacccaaaggacagagaaaggagctttaataggcccgtgaggggaagttctaattatacggggggggaggttgagaacggaggttacaggggctggagaggctgtatatattgtggcgggagtccagaccaagaccggatttttattaggcaagtatctcagac

SEQ ID NO: 525203 - DNA, 194 bp, Homo sapiens
agaggaaagcctttacaaattactctcagttctttaggggcagaaggcttgtaagaagaggtcagacagaagaaaggaatatatgaacgcaatgagatgtcgacatggtaacaggtctaaaaatgagggcaaaacactaaggctctagcagtgactggttcactaaaaagagagagtcctggccccagaggtgt

SEQ ID NO: 525204 - DNA, 161 bp, Homo sapiens
tacggtaccgtgatgcatgtagaactgtctcctactttgaaaactgaatgtcagagctgagtgaatcaaagtgtctagacatatttgcatagaggcaagtattctattctaataactgcttactcacactaccaccttttccttatactgtatatgattat

SEQ ID NO: 525205 - DNA, 394 bp, Homo sapiens
  misc_feature (17)..(17): n is a, c, g, or t
  misc_feature (108)..(108): n is a, c, g, or t
  misc_feature (187)..(187): n is a, c, g, or t
  misc_feature (211)..(211): n is a, c, g, or t
  misc_feature (393)..(393): n is a, c, g, or t
cagagtgcggcactcantgccatgtaatcccagcacttagggaggccgaggagggcagatcacgaggtcaggagatcgaaaccatcctggctaacacggtgaaacccngtctctactaaaaaatacaaaaaattagcctgggcgcagaggcacgggcctgtagtcccagctactcaggaggcggagnaggagaatggcgtcaacccgggangcggaggttgcagtgagccaggattgtgcgacttgactccagcctgggtgacaagggtgaaacgccatctcaaaaaataaaaattgaaaaataaaaaaaagaacctggatctcaatttaattttttcatattctttgcaatgaaatggacttgaggaagctaagattcatagctagaaatang

SEQ ID NO: 525206 - DNA, 474 bp, Homo sapiens
  misc_feature (422)..(422): n is a, c, g, or t
cacgaggtacgaagccttcttcaccgagctcaaggtggcgatgttcgcggccttcttcgtcgccttcccgatcatcgccaaccaggtgtgggccttcatcgcgccgggcttgtacaggcaggagaagcgcgccttcctgccgttcctgatcgcgaccccggtgctgttcacgctcggcgcggcgctcgcctactatatcgtcatgccgatcgcgttccgtttcctgctcggctatcaggtgtcgagcggcgacctgcagatcgacgcgctgccgtcgatcgccgaatatctctcaacggtcatgcagttcatcttcgccttcggagtcgccttcctgctgccgatcctgctgatgattctcgagcgcgccggcatcctgtcgctgcagcagctgatggccggacgtcgctatgccatcgtcnccgctttcgtcatcgccgcggtctttgaccccgcccgatgtcatttcgcagc

SEQ ID NO: 525207 - DNA, 616 bp, Homo sapiens
atgccaataacctcctactgcatctacgtcattgccgtgggcattttaaaaactgatgttgctccaggttggatcagtctctcattgcaacaatctggcatgttctttctcatctctctggtgttgttggtgtagggtgaatacattctaaacatggcaagcctgtcgaacgaggggccgctttatcatgttgcgcaagagtttcacccagtgcgcggatgacccgttgtgaaaagttgaatgttgaagagtgggcatcagagtcggcggataaggaaattccgaccagtgaccgtgcctgatgtcggggcttaacaaaggcgaaatatgccacgatgcggtagtcatcggggggtgggttctacggcgctgctatcggtatttatctggccagacaacggggattcaagcgtattttactaattgagcgcgaatcggcgttattgatgcgtgcgtcttataataaccaggcacgcgtccataacggctaccattaacccgcgcagttttaccacttgctatcgcagtcgagtaaacttgccgaaattgttcgggattggcgccgccataaagcagattcaccaagctcatgctatgccgggcaatccaagtacgg

SEQ ID NO: 525208 - DNA, 264 bp, Homo sapiens
ccatccaaccagtcactaagtctctctccaagctgttccttcttgataacttcacattatttttgcctatcaaatacctttagaaagagtagtagcagctgagcacggtggttaacacttgtaatctcagcgcttagggaggccgaggcaggcaggagtttgcgaccagtttggccaacacggtgaaaccctgtctctactagaaatacaaaaaattagctgggcgtggaggcaggagaatcgcttgaatctgggaggcagaga

SEQ ID NO: 525209 - DNA, 1493 bp, Homo sapiens
  misc_feature (460)..(460): n is a, c, g, or t
  misc_feature (602)..(602): n is a, c, g, or t
  misc_feature (1163)..(1163): n is a, c, g, or t
tggaaagggagtcttgatctggtcactgagggcgggaaggagtgcaggggtggcgatctcggcctcacgggtaattctctcgcggccctcccgaggtgttcaaggcgattcctccagccctcagcttctcccgagtataagcgtgggattatacggggcggtgactccaccagtgcccagacctgcgggtctctcttttcgtggtcagagggcaagtgagtgagaggcgtagagggaggggtgcacaagagagaggagccccctgggagccccagaggccgagtggggtgggcgtggtggcacccaacacaccaccagagcttctccgtgccctcacacgtggaggccaccagaggggggaaaaaacccgcgtgatatattcacagtatattatagcacaaccccccaacgagccacgagtgtaaatatagtctcagagtgtctccgcgtggcgctcttntctcacatatgtgcgccccacgcgaggaaacaccctgcgtggggtctcacccctcaagagaaagaagcgcgctgcggggtgtgggccacacaccgcatgtgggcacacaaacaccccgtgagagcagccacatgctgcgaanctgcgtggggtgctcgcgtggggggagaggaaacacatgtgtgtgcgagacgttcacacaagaccgcgcgcggggtgggtgcacccccgcggcgggggaggcgcgccatctaattagaggcgccaagcacgcgtgaggtgggcactaataaaaggtgtagctgcggggcgaggaaaaagaggccacaatatttacagaggcgctctcaaccacattataagcgctgtgtgttaaaaacggagggctctctctccacagagagggcaatctcctccaaataatagaagggggggccgccgagagagaaaagactactccgcgagagaaaagagcgctcccctacactctccccactacgcggcgaggtggtgtggggggagcaccatgtggttgttgtcgccccaaagggcgggggggggggggagctaataagacgcgcgcagatatactatttaaacagcgggtgggcgaacaaaaccaaccgcagggagtattattcccccgacggccccccgcggtgggcaccgttggacgccattactcctcaacagggtgtcaacngatggtgttgttggaagatgcccccccggtgtcttttgtggtgggcgcccccctgcgcggcgccacatggtcatgggcccgcctgtgtggtcccgctattccccactcgttattggcccccccttccttatcatttagtcacaccgatgtgtggctgctttctttgtagagccccatttctcacaccagatggggggggaggccatcaatatacttagcagtcccctctggggggggaggactaattatacccccccaaaagtgccctttgtgaggcaatgaagggcgtgccgccactttgtgcttgatcccgatctcgtgagcattcgg

SEQ ID NO: 525210 - DNA, 424 bp, Homo sapiens
  misc_feature (1)..(1): n is a, c, g, or t
ncagcacacatatggagccatcctctgcaactctgtagcacacttcataggggtcagcccagagtgtgagttcacttgggaacagcttgaacagctcctgactgctcagtccaatccgctgtgctgcctgtccaatcacaggatccatcttatggttgatgcgaacacaacgataacccgtgtccctcgcatggcttctctggcaaccagtaatgtttataatgttcagccactcagctcctgcagactctgcctgaaggtctgcagctgtcgctcgctcgtgagctccttggtgcggagaaacttggagatgaaggtctcgacgtcgcgcgatctcgcctatcatggtggcggcccgtgtgtagaagggatgcatggggcctgcgttcggtctcggcccggcgcgaccggcactcggccgcgc

SEQ ID NO: 525211 - DNA, 147 bp, Homo sapiens
  misc_feature (1)..(1): n is a, c, g, or t
  misc_feature (67)..(67): n is a, c, g, or t
  misc_feature (125)..(125): n is a, c, g, or t
ncgtgggcccaggagccagctcaggtgctcccccaccatgggcaggctgtgtaaaaagccaccggcntcagcagctgctgggcctctcctgggactacccagtgtggctcttacgtgttttcttngctaaaataaaccctagttctt

SEQ ID NO: 525212 - DNA, 840 bp, Homo sapiens
  misc_feature (462)..(462): n is a, c, g, or t
  misc_feature (567)..(567): n is a, c, g, or t
  misc_feature (571)..(571): n is a, c, g, or t
  misc_feature (577)..(577): n is a, c, g, or t
  misc_feature (580)..(580): n is a, c, g, or t
  misc_feature (608)..(608): n is a, c, g, or t
  misc_feature (628)..(628): n is a, c, g, or t
  misc_feature (641)..(641): n is a, c, g, or t
  misc_feature (677)..(677): n is a, c, g, or t
  misc_feature (691)..(691): n is a, c, g, or t
  misc_feature (704)..(705): n is a, c, g, or t
  misc_feature (719)..(720): n is a, c, g, or t
  misc_feature (757)..(757): n is a, c, g, or t
  misc_feature (838)..(838): n is a, c, g, or t
agtaaggcatcgtcgaccaggcctccggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcncataaagattttaagaaagcagtaggagcatgcagaattttttaccatccagaaacaacaccgctaatgatactgtctgccagtgaagcaactgtgaagagagtnaacntcttangtnacatgcatttgcgaagtattcgtacgangttgatgcttatgtcagacntgaagaggcactnagcatttagaatgcacaaaacaacttgcagcagctnttcatgaggaattngtgtgagagaagnnttaatgggcctggnnataggaacacatggtagtaacatccagcaagctaggnaggttcctggagttaccgccattgagctagatgaagatactggaacattcagactctacggagagagtgctgatgctgtanaa

SEQ ID NO: 525213 - DNA, 704 bp, Homo sapiens
gcagctgcttggtgactgtttctgtggtgttgaatccccacggtataaaggtaatctacaacgaggtgaacaataaatcctggatggacagacccgtgcaccttcatattacgtgtttgaaatcctggatggacagacccgtccaccttcatgtcacgtgtttgaaattctggatggacagacccatgcaccttcatgttacgtgtttaaaattctggatggacagacccgtgcaccttcctgtcacatgtttgaaatcctggatggacagacctgtgcaccttcacgtcacgtgtttgaaattctggatggacagagccatgcaccttcatgttacgtgtttgttgtggagaggagtgggttgtgccatgtttctcttgtgggattgagtgtggctatttagctcatctgttgccacctttaattgttggcattgacactaaaggtcatcagattagcgggaaccagcttgtggggttgtagcggctcctggactggtctcaggtgacatcctgattggctgaaataagtcctgcaggtctctgctagaactgactcacagttgcctgagtccagaacttgtgggtcacaggtgacgccaggactgcatcatcctggtgctcggactcctagtgacagcatcctgagcaggcggtagcccagacaccaccctgcctgatatgcccactgttggtggagacatc

SEQ ID NO: 525214 - DNA, 275 bp, Homo sapiens
  misc_feature (1)..(1): n is a, c, g, or t
  misc_feature (32)..(32): n is a, c, g, or t
naagactctgtctctacaaaaagtttaagaantgagccagacatggtggtgtatgcctgtagtcccagccactcagaaggctgaggcaggaggatcgcttgagaccaagagtttgagcctgcgttgagctgtgaatgcaccacggcactcaagcctgggcaatgtagcaagatcctgtctctacaagaaattttttaaaaatgagccaagtgtggtggtgcatgcctgtaagttccagctactcaggacactgacgtaggagggtttgcttgaag

SEQ ID NO: 525215 - DNA, 164 bp, Homo sapiens
tgtcacaggactgtagtccgcgacggaaaaatgtttacaggttcggtgccagccagcgttccacgtcttctttggccacgccgcggcgcggcagccatgtcgctgacctggtcatccccgattttacctgacgctgaagtatttggacgccggatgagcaaagt

SEQ ID NO: 525216 - DNA, 383 bp, Homo sapiens
  misc_feature (36)..(36): n is a, c, g, or t
gcgtcgaccaactcctcaaaaagaaaaccagcctgnagcgtggtgcggtggctcacgcctgtaatcccagcactttggaaggccgaggcaggtggatcacttgaggtcagtagttgggagacgagcctggccaacatggtgaaacccatttctgctgaaaatgcaaaaattagccaggcatggtggcacatgcccgtaatcccagctacttgggaggttgaggcaggagaattgcttgaatctgggaggcggagattgcagtgagctgagaccatgccatcacactccagcctgggtggcagagcgagactgtctcaagaaaaagagagagagagagagagagagagactgtctcaagaaaaagagagagagagagaaaaaaa

SEQ ID NO: 525217 - DNA, 338 bp, Homo sapiens
taaccgtgattggtggcgactttttagctgaaattattaaaactatcacggcacggtcaacgtctaacccatcaactcggtaccaggataccgggcctgtcatttcccaggtggtgcataccttatcagccgttttgctcgtgttgtgagtgctctcatttataaccaaggagactaagaagtttatggtcgcgtagtgtattgggggtcattgggattttcttagtggcgttgtctctgtctactgacgggatcatttcccaaccatacatcgctgctgttttctgggcctctttgggggccactacgcaatactttccacaaaccttattgcgagc

SEQ ID NO: 525218 - DNA, 181 bp, Homo sapiens
  misc_feature (155)..(155): n is a, c, g, or t
tatagttgccggggattacccgtgtccctttttgaggatcccctggctgagtagtccttctctgaagcaccgactgttgcgaccgttcaaaactgtccacacttccaagccgggctctcattctgttagctccccttgagaagatattttccagngcagctagttacaggatctcgttagc

SEQ ID NO: 525219 - DNA, 119 bp, Homo sapiens
tccaaagtgcgggaataacaggtgtgagccactgtacctggctgtgatctcatttttaaagcagaaaactcaggctcagaggcttagattagggcaagtagtgtctggccagattgaat

SEQ ID NO: 525220 - DNA, 245 bp, Homo sapiens
ttgaacaagtcgcaggataggccttctgcgagtcgcagagcaaggtcgcccatgctggattcagtcccaggtccctcacatgcctcatcagtagtacgtgcagccgtgcgtgcatgcttctgtccgtggccaaaggcccgagagccctcgtggcaaatcactggtgtaagtctaaaagtccaaaagctgaagaacttggagtctgatgttcaagggcaggaagcatccagcacaggagaaagatg

SEQ ID NO: 525221 - DNA, 354 bp, Homo sapiens
  misc_feature (38)..(38): n is a, c, g, or t
gggaaggaaaaaggttggaagaacccaccagcccaagnttgtccggggggggaaccttggcaagcaagtgcaaccccaaccccaaaagggttgggaaagccgggccgaccaacaaaaggaaaagttggcgttaattgcctttcaagccggcagggttttccggccttttcttccgttctcagaggtcagtccccccgccggggacgtcccgcgccactccgcgcctttggccctggctcaaggtcttgtgatgtgattagcaaagccagcgccttgtcctcagacactcagccctgcccggcaggccccggcgctcaagccctgtttactgagcctgggcggggagggggcgga

SEQ ID NO: 525222 - DNA, 141 bp, Homo sapiens
cgttcttatgtgaatggacttagtgactgcttgtaacaatacaacacaggtaagtgatgctggtaaattatttatttatttatttattttttgagacagagtctgctctgtcgccaggctggagtgcagtggcatgatctc

SEQ ID NO: 525223 - DNA, 1217 bp, Homo sapiens
tgagacagagccgtgggttgacggggcgagacccgtgcctcaaaaaaaaaaaaaaaaaattgagggaggggcttgacccagggttggcttgaccctgtgttaactcccagctatacttgtgggaggattgaggcgggagaggttttgctttgaagccccgagggattctcaaccaccgaccttgtgggcaccattgaggtgaagccctttgttcttcaaaaaaacacggtagaaagggacaaccgggaacccaggggaaacagacatttggaaagtgtggaacaacgaaagggagggaaaaaaaaccgagggcaagaaattgcggagggggttcaagagaggacaaaaaatgtgatatgtgttgacctctcgaggaaatatcccaacgagcttgtttgggtcccggcgcggggcaagatctctgtgggcctattctcttagtctccacctctgggggaggctcccccggggtgttccccccaaaaatttgcgccctttattacaaagaggggggtcttatattgagaacgccccccagagatagtgcttaatagcccccctttcattatagcacaaacgtttggggccccgctatagcctttcccctttaccaaggtttctcccagcccacataatagtggtggcagtttcccaaacatttagtgggggggcaccgtgcacagtgggtgggcgtctccccaaaacattaaggcggggcacacactctcagagggtctctgtgcggggcacaacaggatcttacggaggtgggttcgatccctactctaatatacctatcactcaccatcgcacagtgaccatttttcacctatatattccggagagcgttccactcacaagcggatatgcgaccctactggggactactggggcaatatttcaccccaagggtggacataactcgtggaagacgaaatgtttttgacaggggcccacagaaggcgggctgaccccaacgtggtgcgtccctggcggcgtcactatgtatgtgtatcacaacgaccatgaggaagaacgagccctattataaggaagaaaaccgtctgtcgccccgtgacagtatgtgttatgaggcgccctttggtgcggggctttatttttatgtgcccccccccaggagaattccaccataataataacccccaagggattccactattactctcaggaggaacgactatcgccctatttgtgaa

SEQ ID NO: 525224 - DNA, 406 bp, Homo sapiens
tctcttctagaagaggcaagaagaagcgggggtgggggtgcaggccgaattgcctggaggttagggggaccctcagcgcgtgagtcagggctctgtgagaccccatggttcttcgctcactgtgggctgagacgcaagctgagtcgtccacaggaagataccctcttactctgaacaaccactctttcaaagaggacactgaggttcagagaggctccccaaagcaatggccagccaccatgggcaggacgtggactccggcccaggaagcctggctccagaatcatgctccaggcctttaagctgtaatttgtgtcctccagggttcacaatatttaagatttaatgtggaaaaatggtgctattctgtctcaccccatgccccaaaatgaacttaaaggcaaaa

SEQ ID NO: 525225 - DNA, 315 bp, Homo sapiens
tgaggtggtactagctcggatggtgcatgggtagacccgtagggcagcagggagaggtgtctcgcccggagtaaggtgcaccgtgatgttgttagctctccactgtgtgcattcaggggccatgtgtgaatggttagtcgctgcacaaacagaagacttgctgacaagtagagagcaggaggggaggtcgggggtaacgctgcgtcactcccagggtgagctggtttatagtctactgcagccagtaggcgagggcctctccaccccacccccatccccggcccccaaagctcaatgtggagtcttctaggggac

SEQ ID NO: 525226 - DNA, 273 bp, Homo sapiens
gactctagtaggatccccctcattctaaccagcgggcggtccccccgccgggtccgaccctcggggtccgcggttccgcgcggtgccatcgactcgagccggcgcctactcatgacacgtatttattaacaggtgcggaccaggggaatccgactgtttagtgcaaacaaagactatcgcgaaggcccgcgtagggtgtagaggcgatgtgatatctggccagagcactggaagtcaaagtgcaaaaattcaatgaagcgcgagtaagggtga

SEQ ID NO: 525227 - DNA, 728 bp, Homo sapiens
gctgggccgggttttgacacaatctttgtggggcgcccccccggtggccgcggtgttctcgcctcgcgcgggtgggttgtcccccccctcgtttcttatggcgggttgtgccctcccccccgcggggttggggctcacacgaggggccccatgcaggcgtgtttcatagggccctctctggggtgtctgtatacccgcgggggggcgtttgcagcgcagtgccaatccgcggagtgtgtcctgggcccccaccggggagaccccctggggtggggcgccgccgtgcggccccggcggcgggggagccctgtacaattgatggtccctctcctccccccccccccgagggatgggttttttccccctcgttctctggcgccgagtgcccccttcgtaggggaggtggctgtggggaaaatatattggccgccccccatagtatgtttttgcgggggggtgtgctacaccccctgtgtggggggcgtgactctcgtgtctccctgtgcaccccctcactgtgtctcggccacaggttttctggaggacgacaacactacactcgtctttcacagaagagggcgcccggggcgctaggtgtgtcgaccaggcgcccttcctcctcctccccccacacccgcccgaggggggggggtttttttccccccccccccccccttttccccaacaccccttccccttttttttttccccgggggggggttttttca

SEQ ID NO: 525228 - DNA, 1211 bp, Homo sapiens
  misc_feature (1)..(1): n is a, c, g, or t
nattgtttttcttggcgtggccaccacggggggggcgcatttttctcaccgccgtcctaattattcctaggaaccgccctttggtgtgtttatataatttttctctggcggcactaatttctgctgtcccgctgaatatgtccagtaggagggggcgcgcccttcaatatgtatgtgggccccgccacaaaattgttgtggagccgccctccttattgtggggtttgtttgtatcccgccacagaagtagccacaccacacccagcgcgttgtgtggcgcggttgttagggctccccctctcgagggtggatcccgccggcggttacactaatatttgtgggcgcaggacgtacagcgtggtggtggggccgcccacggtttctctacccgtgattgcgcccatagttgactacattgttggaacagagttatatttgtcccgctgggccacacacaccacgactggggttgtgattgtgagagagagggttaaaaaccacacatggggcgcaaccttttcatatagtgtagaaccggggtgtgtctcacaacacctgctgtgtgtggtttcgaggcgcaacaccacgcaagatacaatgtggggttcaaacaccctgctctggggaaaatagttggtgcccaacgcaacccactctatgtgtgagacatctgtggggaacggagagaaatattttcccacggaagaagatgttttcaaatacatcatttttgtaggaggcgtgttgtctccccacacagagaaaaccacgggggacaatcccccgccctcaagataaggccccggtgcgcccagatatataccttcctctggttggagccacccccctcctggcgccactgtcgccgccgtcacaaaaccctttgttgggcgccctctgcaaccaccctggatgctttgccactttttcctcacaacgcgaagtctgggctttggggggggctttacctcggcttttcgtgtgccccccagagggttctttcacggcgtgaggatctttttctcggagaggcctcggagacctaggctccgctgtttcctccctctccttcttcttccccaaccttgatcaccccgaagttctcccaaaaatttttttttttttttctccttttttttttttttttgttttttagaaaaaaattttggggaaaaaaatgaaaaatttttattaaaaaagaaaaatggtta

SEQ ID NO: 525229 - DNA, 315 bp, Homo sapiens
  misc_feature (21)..(21): n is a, c, g, or t
  misc_feature (72)..(72): n is a, c, g, or t
  misc_feature (124)..(124): n is a, c, g, or t
  misc_feature (219)..(219): n is a, c, g, or t
ttttagcctttctgcttcccngggaggctgagaacagggagccttctggggaccgctgggctcgggagctcnggttgctgggctcctggatggtgactgtgaggcccgagactgggcatcgttngcggggctgtcctgcggcgggcgggagtcgtggaggccttttcagcccctcttctctcctaggctcctacaaccccctgaccctcggcctgttcncgctggtctacttcttcctggcctgctcggcctacgggctcacggtgtctgccggggtcttcctcccgtccctgcttttcggggctggctggggcc

SEQ ID NO: 525230 - DNA, 581 bp, Homo sapiens
taccgagatgcatacacaagcaaatataacccagtatctctgcggccattactaagctaaggcagcaggacctggagcctcctgctttggagtggttcttcaatactgctgctgcttacgcgccgggaaactgggaaggctggtgagcgagaaggcaaggtaaggtctctgatttacgggggcatgccagttaatcctcctgaatgaggaagaaatgaaaggaagaggagcttgagagtcccttggctttgtcttctgagatgaggcttttaaaatgaaccaggagtctggctggccagttttgcaaacttcttgttcagaagaaccccttagaggcagctgaacatatagggcacattttcaaaagctgggaaagacagacccctttcacctatccctagagaaagatggtatggagcaaggcaggaggagttaaaaccagcttcctggcccagagaggtggcttacacctgtaatcccaacactttgggaagccagggcatgaggattgtttgagcccaggagtttgtaacttgtgaccatcctgggcaacatagtgagaccctgtctctacgaaaaaa

SEQ ID NO: 525231 - DNA, 147 bp, Homo sapiens
gaacaaaagcacataactaaaaggaagacaggaaggaaagaaggcaggaagagaaggctgcaaaacaaattagaaaacaagtaacaaaacgacaggagtccctacattatcaactaatcaacatagaactgtaaataggactacaac

SEQ ID NO: 525232 - DNA, 526 bp, Homo sapiens
  misc_feature (62)..(62): n is a, c, g, or t
ccctttttgtgatggtgatgctaatcccttcctggtttggtaagttttccttctaacaagtnagccccctctgctggaaaatctgctgcaagttttgctgggtggtcccacttgaagaccctgtcttgtctggtattaccccgtggagtctgcagaacagcaaagattgctacctgttcccttccctctgggagctttgtcccagaggggcacccgccagatgccagctggagctctcttgtatgaggtgcctgttgacttctgctgggaaatgtctcccagtcaggtggcatgggggtcggtgacccacttgaggagtcagtctttcccttagcaaagctcaagcgctttgctgggatatctcttcagagcaggcaggcaggaacatttaagtctgctcaaacttcacccacagcctacccttcccccaggtgttctgtcccagggagatgggagttttatctataagcccctgactggggctgctgcctttctctcagagatgccctgcccaagaggaggaatc

SEQ ID NO: 525233 - DNA, 516 bp, Homo sapiens
tttcattctgctgctgcaggttggagaacagcgatgcgatctcagcttactgcaatctctgcctcgcaggtataaagtgattctcctgccttggcttcctgagtagctgggactacaggcacgtgccaccatgcccagctaatattggtatttttagtagagatggggtttcacctatgctggccaagatggtcttgatctcttgacctcgtgatccacccgcctcggcctcccaaagtgctggggttacaggcatgagacaccatgccctgcctaggaatttgcatttctaacacattcccaggtgatactgctgctgctgctcctgctgctgctgctgctgctcttcctgctgctgctgctgctcctgttgttatttggcccaagagcactgctaatagcgtggcttcattgatcagttcccagccctgtcccttggttcaactgacttgtggccatcctggtcacgtgttcttctctggtccattcattcatggccagtgtttcgagttcatc

SEQ ID NO: 525234 - DNA, 339 bp, Homo sapiens
ctacctggagaggcaggcgcaaaggcgtgtcagttggacgagtaaggtaggtaggatagcagtccatgagcctacaagacagcgtaggtatccactaggtcataagccatacctatatcgggtagactattccataccctatagaaccaaggtcatagtatagcacttaggctacccagcatagtatagtacaccatataccaaaccaagaaatataggcacaaaatagctaaactagtagtaccgggagtatagtaaagcccaatatttactataaatagtaaagtagctagactatacctataaacaatattcctacataatactactatactaggc

SEQ ID NO: 525235 - DNA, 714 bp, Homo sapiens
ggcaaatgtacctcacctgacgctcctgctctcttttccacgtgcgaaagccccggactctttcagttgtgaacgccgcggactccgtgtagccgactcaaaccaggactcgccatgaggccgaggaattcagtccccgctgggggtggctttgtgacgggccgaaggcgcgcgcttttgtgtgaccgctcgcgtgggttgtggctggccggactggcgcgctttggcggggggccagcccgtcgaagggcgggacggctcccacaggtcgtgcttacgactgaggagtgtggccggcgggcgccgcgcggtgtccgagcgccctggagccgtggctggctgcttcccctttcctgttggaccattctgctagctctgtgaagatccgatttacccgcaggaggcacaacagctcgcgctaggcacattgtggtgctgttgacccagcctttggggtctaggtttgatcgggccatacgtggtgcgagggaaaccgaacgattgccacctcgccctgcaggcaaggaaccctgggcccccgtggggcgagaatcacgccagggtgggaggaggagcggacgacgtcctcggatcttcgcccaacgcgagtaatcaccagccacttgaggtaccctgaagccctggaaacccctttttctgtacgatacgctacgtagaaggtaactcctgggtgtggtgtggaagcattattct

SEQ ID NO: 525236 - DNA, 242 bp, Homo sapiens
cgtggcgtcttggtgttgtccacgctggttcgcaggtgacgagatggcctttgtgaaaagtggctgattgctagtacagagtactatttggaagcgctggaagaagaactggtttgatctgaggtcggatggtcacctgatctattatgatgaccagactcaggagaatatccaggataaggtccacatgccaatggactgcatcaacattcgtacggggcaggaatgtcgggatactcagt

SEQ ID NO: 525237 - DNA, 421 bp, Homo sapiens
aatgggctaatccatcttggtgaccgtgagcttttggctcagccttcttcacggaagttttgtgtctccttttcccatgggagctgccctcacttcctgttcttagtggagtccatcatctggtcaattttgtattggaagtcactgggcaaatggcgtgtttggacgagtgcagatccagcagttgcagtagcacccagtgagactggaacacctagtctgcagtgtagagggatgaagatctctcattttctttggtctcctcccagccgttaaataagctcctcaatctcatagagagaaacctggggaataattaccacaggagtacagaaaccttgaaaagaggctttgatgcaggacctgatagtgtttggcacaacagaagtgtacgagggttagcacatactggcgtcgacgc

SEQ ID NO: 525238 - DNA, 116 bp, Homo sapiens
cttgcggtctcatacacagaataggataggggatcagcatctggtggccggctcctcaagggcatggatgtggaccacattacttctgcttggtcttctgctggtgctggtgctgg

SEQ ID NO: 525239 - DNA, 135 bp, Homo sapiens
  misc_feature (67)..(67): n is a, c, g, or t
gatctatctctgtgtccaagtctcctctttttataaggaaaccagtcataatggacccacctgaatnacctcattttaacttgattacctctgtaaaaaatgtatttccaaataaagtgaccttatgaggtattg

SEQ ID NO: 525240 - DNA, 401 bp, Homo sapiens
gatgtacctctcggagaattcatcatagaagtcgaacggcatagccattccagcatataagtgtgcgctcagtgtactaccatgtcttgacagcaaaaaccctggcgacaaaagccaaaattgacaaatgggatctgattaaactaaagagcttctgcacagcaaaagaaactaccatcagagtgaacaggcaacctacagaatggaagaaaatttttgcaatctatccatcttacaaagagctaatatccagaatttaaaggaacttaaacaaatttacaaaaaaaaaaaatcaaacaaccccatcaaaaagtgggcgaaggatatgaacacacacttctcaaaaaaaataagatatttatgctcccatttctttacaggtgagtgaccaaggtttggga

SEQ ID NO: 525241 - DNA, 121 bp, Homo sapiens
  misc_feature (25)..(25): n is a, c, g, or t
caaaaacacttattcccactctcgntcttttccactgtgtgaagtttatatttaaggcctgcagacagctgattcagcttcgaacagatcagttccctgaaatcagccaacatctgtcttg

SEQ ID NO: 525242 - DNA, 341 bp, Homo sapiens
gtcgacttttttttttttgagacagagtctcgctttgttgcctaggctggagtgcaatgatgggatgtcggctcactgcaacctccagctcccgggttcaagcaattctcctcctatttcaacctcccaggtagctgggattacaggcgcccaccaccacacttggctaatttttgtatttgtagtagaagtggggtttcaccatgttggtcaggctggtctcgaactcctgacctcaggtgatccacccgccttggcctcccaaagtgctgggattacaggtgtgagccactgtgcccagcccaaactgtacacttttaaatggtgagttgtatgatatg

SEQ ID NO: 525243 - DNA, 497 bp, Homo sapiens
  misc_feature (497)..(497): n is a, c, g, or t
aaacggctttttgtattgcatgtggataatactctcattacgcactcaacctcgtgttggagggtttaacatggggtcttttgctcttacaatgaaaagtagcttctcaggtgcatcgtccaataggacacttattatatcactatgatcagataaggtccttataaacagggaatgctttttgcaacggccttttaaacgtaacccgtcaggtaggctacccccaggaggaggggatgaccttatccaatagggaggctggagtaggggatgatgtctataagggctctgtttatggaatacctccgggccatgccagtgtcccaaagaatgccaccttcatagccattccgagcagaggctctagagttgtgccagcttgggcctaactctatgagtatggtcacgatgacactggtttatgcaccaagccggaccgtcctggacagttcaggtgactgcaaacttatgattgtcattgacccaggcactgaacn

SEQ ID NO: 525244 - DNA, 938 bp, Homo sapiens
aagcagtggtatcaacgcaagcgccactactgccgggctaattttttttgtatttatagtagagaccgggtttcaccgtgttggccaggctgatcttaaactcctgacctcaaatgatccaccaacctcagcctcccaaagtgttaggattacaggcgtgagccaccgctaaagatgcttttaactgtgtgtttatcatgccttgctgacattggtgcactcatatcttctatttaacatttgtccttatcttatctctacttatgtatcgatttaagggttcagcctgtcaatgggtcctaatcatagcaagtaatctgagctgatatgctgtaaacagacattatacttatgatgctgtgccgtgatatttagacagcctgcaaggcttgggtaatagatcagccaactctgtgctgaaatgcacggtatgatgcctgcttggggctcattatgctgccagagcgtgcctgcataagcccttgtgatcgtgtctggtgcttcaggcaggtcaccaggcagtttcctggttaaaacctgcattctgacaacaaacagaacaggctgaaactgcctggaacatcatttaacaaacctgaatttccacataaggatgagctttgcataaatgacggagtctgaactagcgtacgacaggggtctcgtgacaaggtactaactggtgacctgacaattcttacattgactccacgatattgacacaaaaatgcttgaacaggtctgtaggtggggacctgagggaaacgtggcctaagcccagttgcatggctacattaagcgtagcccacactgggggacgactacagtggcgaaacactgtgcccacaaccccgtaatcatggggaaaggtaagtcctgggtcacgttggcctacggagccgtccaagagcacacaaacacacgcgtctgggaacccc

SEQ ID NO: 525245 - DNA, 273 bp, Homo sapiens
cgtcatgcgatagatatacacaggactgaaatctaaggtgtcagcagggctgtgtaacttcttgagggactactaggaggcaagtccatttaacttgactttgctagtatctagaggctatcctgtcatactttggctcatggacctcttcaaccatgcgatatgtaaacctgcagtatcgcatcttcaaattctctttgactctgatctttttgcctccattttccatgtcaaaaggacacatgtactgggccaacagagggtaccgagctc

SEQ ID NO: 525246 - DNA, 249 bp, Homo sapiens
ttaaaccagtgtcagtgggtcatagggtccttttttaaaaaatttgagacagagtctcattgtgtcacccaggctggagtgcagtggcacaatcacggctcactgcagcctcgacctccctgggctcaggtgattctcccacctcagcctcctgaatagctgggaccacaggcatgcgccactacacctggctaatttttgtatttcttatagagatgaggtttctccatgttgtcccggatggtctaa

SEQ ID NO: 525247 - DNA, 179 bp, Homo sapiens
gcccaggctgcacacagctcatttttaacagttttctttctgcttcattcacacactcttcgccccagcgttcccatgtctttggcaatctgctgggctgtttagtcttgggtttctccttcttctctttcccctcttttgcaggcggcaggcccgactggtgctgggacgaagactgg

SEQ ID NO: 525248 - DNA, 106 bp, Homo sapiens
ggaggtgataataaggaaccatgtcagttcggatgacggcctgcatggccggctgcacctgctgcacctatggacagacacctacctagacagtgcgcctgaggtg

SEQ ID NO: 525249 - DNA, 369 bp, Homo sapiens
  misc_feature (138)..(138): n is a, c, g, or t
  misc_feature (211)..(211): n is a, c, g, or t
gcctccctaggagatgcccggtggctgacacccagaggaagcacagcctcccctctgaagcttcctctactgcagtctctgtgctcatcgcaaggatctctccatattgacttatatttgtttctggtcttatatttntctctatggacagacttctattttcagaagatagatatttaagtcacaatattctggactctggcttagttangaccaaccggtctcttgatcgtctgtggaaactgaatcaggaacaccccagagagctggctctggatgtaattcacagcttcatttaattattatcatcaaagttaatgaaggccataaactgtttcataacataccaatgggaagtgtgattggagg

SEQ ID NO: 525250 - DNA, 283 bp, Homo sapiens
tctccagtcgcaacgtctcctccaaacaaaaccatcaacttattttgtatttctataagcatacaaggactgttaaagatgtgacagtgtacattatatgacaatgcacatttagcctgcaagtcttttatagcgtcgtttcagcagactacgatgaataatgcagatttcagctccagcactttagtttcaatagaaatttcctgcctccctccaagatgcagggtgaggaggatgcttggggttgcgactggagtgagacgggtaccgagactcggaaatc

SEQ ID NO: 525251 - DNA, 429 bp, Homo sapiens
gtacgaccacgcgtcggcagaggggtcatacggggttgtctggattccgtcgtaacttaagggaaatttcacaatgtcggagccttgatgtctgcaatgaaggaggggatgtcttagtcttgcagaggaaccacaaggtgcacatcttgatcagatggacagacatctatacaggacaagtgtgggctctatatcataaatctcaagaggacctgggagaagcttctgtggaagctcgtgcaattgttgccattgaaaacctgtgatgtcagtgttatatactccaggaatactgtgcagagggctgtgcttgaaagtttgcttgctggcacttggagccactccaaattgctgggcgcttcacgtccttgtggaacctttcactaaaccaagatccaggcaagcttcctgggagccacgggttcttgt

SEQ ID NO: 525252 - DNA, 202 bp, Homo sapiens
ttttttttttcaaggtttttggcttctttgccatgggttcgaacttcctcctttagctcagggtagtttgatcgtctgaagccttcttctctcaactcgtcaaagtcattctccgtccagctttgttccgttgctggtgaggagctgcgtaatcattctgtttttaatttacaagtccatgaaacaggatccaaagtcgacg

SEQ ID NO: 525253 - DNA, 110 bp, Homo sapiens
ctacacgcacggggaacctacacacgggggaacctacacgcacaggggaacctacacgcacaggggaacctacacacaggggaacctacacacacaggggaacctgcaca

SEQ ID NO: 525254 - DNA, 1043 bp, Homo sapiens
agaggtgccgcccttagaatcagagaaagatgctgcattttattaatctaaagtcccaaactccttttcttatcttgatccatactaataaatatcctctccataagcattgccattggaaggcgtgtgaattgactgcaagagtgtgactttaacatgggggaaatcgtcgtatatcactaaaagcatgaattggaactgcaagtgagagagtcaaatttactttaaaagagaacattaatatggcttcaccaagaagcaaagttcaacttatttcataacttgcctacatttatcatggtcctgaatgtagcgtgtaagcttgtgtttcttgggcagtctttcttgaaattggaagaggtgacacatgggggtggggagtgggaggaagaggtgacttcctctggtgttattataaagcttaaatttgatatcattttaaaatgtcttggtcttctactggcttgaaaaatgacaattgtgaacatgatagttaagaggtaccacgtttttttaaccattgatgatgcaaaatttagaagaacaagttattggcatggttgtagcatatagttaaacctgagagtaattcatctgtgaatctggtttaattagctggtgagtaacttagaacagtggtgtaaacttgtaccatggaattcttgaatatggcttaatttagaaactggacaaatattccggtcatattcactcggggagggtacataatggacccaaggggaccggatgacccatggtgtctggtgagacacatatcttggcgggcacagtttgggagtgaaacactttgggaaagaaagttccgcgcaagtgggcgccaattaaatgtgtgcccacatatccgtgttatagaaataaagcaccgaatctcgtcggggggtcatcaaaaagtgaaccatatcaaagaggggcgatcattacagaaactctatgagaaatacaagatgattaagaaccccctgagaatgttcgcacccagtcaggccagcggcgtacacggacagcaaatacatacaaggcga

SEQ ID NO: 525255 - DNA, 83 bp, Homo sapiens
gccctgtacttctgtgccagcagggtttggacaggggagggtcagccccagcattttggtgatgggactcgactctccatcct

SEQ ID NO: 525256 - DNA, 598 bp, Homo sapiens
tctcaaaattcaaaaaccttcattatgaaggcagaagtggggggagggccattgacaggggaaaacaaatgattgatttggggggtgacagcgagcaagtttgggactacaaaccccaagtagatttcgatcactgtgggcccgtgaacaccccgttctgggccccctggggacagccccccgcactcgtggagtcgtggcaagggagctcacactctcttgggtcgtgcgggaacgcacccatcaaggtgaggggggcaccgtgggaaggcttggaaaagtgtggggcacttccttttgccgtcgtggtcacgacccagtccgtggagggaaaaggggcccttcacccttgggtcgtggagtttcccccggagggtggcgtgagggggatgaattttgtcccgtgtccatattatagtgggcgagaatacccgcgcaaaatcgcgtggtccgtcctcgcgagaatgtgggccaaacttccctgtaacacgccacaaggggctctcaaagagtgtgccaagtcacagagcggggggccacgaggggccgtggagaggcccctctgtggtgaaggtcccgacaattcgtggccccggga

SEQ ID NO: 525257 - DNA, 298 bp, Homo sapiens
tcgtgccgaattcggtacgagcgggacgagagacaatggaaaatctgggacttgctcaaaattgtactatctctattcatgattatgaagtttttcgatccgaagatctactggatgaaagacagataaaaggggtcattgagcttaggaagagcttactgtctgacttgagaacttatgaaccatatggatccctggttcaacaaatactaattctgctgctgggtccatatggagttgggaaggtcagctgtgttaatttactgaggtttattgtccaagggcatgcaacgcatca

SEQ ID NO: 525258 - DNA, 308 bp, Homo sapiens
  misc_feature (119)..(119): n is a, c, g, or t
  misc_feature (134)..(134): n is a, c, g, or t
  misc_feature (151)..(151): n is a, c, g, or t
  misc_feature (175)..(175): n is a, c, g, or t
  misc_feature (185)..(185): n is a, c, g, or t
  misc_feature (282)..(282): n is a, c, g, or t
  misc_feature (291)..(291): n is a, c, g, or t
gaaaaagccaaaattgtcatactgttgttaagcaacagtatgacaactatttacatagcattaaggttggtgcaaaaatgcaaaaataataaaaaagcaattatttttaaaccaacctnatatattgtattagntattaaagtcatctggncatgatttaaagtatatgatgccngcctggacanaaggcgaaaccctgtctctacaaaaaatgcaaaaattggctgggcatggtggtgtgtgcctgtagtcccagctactagagcgactgaggcaggaganttgcttgancctgggaggcggaggtt

SEQ ID NO: 525259 - DNA, 349 bp, Homo sapiens
  misc_feature (27)..(27): n is a, c, g, or t
aataccggattcccagctgatgtaganccttctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttggagctgctgtcaccgcagcccccaagaaatagatgccctttcttgaattgcattttttaaaacaagaaagtttccccaccagtgaatgaaagtcttgtgactagtgctgaagcttattaatgctaaggcaggccaaattatcaagctaataaatatcattcagcaac

SEQ ID NO: 525260 - DNA, 1590 bp, Homo sapiens
atccacgcgtccgggagagctggtggacagggttggcaattcaggaggcatgcaaagctggtcgtgaggagaaaattcatgcatgcaatgggaaagtcacacttttggaacatatttcagttcataaattttttcgtgacgctttcgtcagatgtgttctacatacttcaagttagcctatgattctaccagctaattcattacagtcaaaccacatcgtcaagtgtgtctccctgtatgggcagcagagagcgatctgggcaaaaactcattgtctcatacacatctaggctagtgtgagcaggtgagatccaagggctgcagcatgtaggccagcaacgatgcatctctggtaccgctcgtctctaccttcatcttcttgcacggacaatatagatcgctagcaatagacgcacacagccaagcatcggtctggaggcgtaaattgcgcccaaaggacctgggctctagcacgagcacaaggggcatttcccacacgtgtgccgatgctagaactcgccatggttcttgaattcacccaagaggacaccaccttcccatgtaccaccactacccatacgacaagagaacatatgacgacgcaacatttacacgaatacccgaaggtttcacacactgctccacacactcgtagactcaccgctgagcgtaaactgggcacgctatacgcgtacaaacccagaaccaacaccccgaaggccagccacaggtacccgcgcaacgtactccccgaacgccacacaatccccgatggggcgcccacggaccagcggcccacgccaccaggacggcacaacaacaacgtagggaatatccccaagcaagcctaggactatgagaatctccccaaccacatcatacccctccaaatgagccaccaaacacaggacacggcgacaccctccacatgggcctacacagacaaccgatctcccttggcccacaggccagcagaacaggaacacgtgccatggccgaccgacacccgatatgaccaagacatggatccacacaattgcacgaccacgcaccggggactgacacacaagactatctcataaaacgacacaccagccacgcacaatcatcatacacgaccacaaaagaggacccgcacccccggcaagcaccgcagcccaagaccgcggcaccacactgcaagagcccgtagacaacgcaccccccggcagcacctaacgccgcacccacagccgagcgcaaccaacatcaggaccacagaaatacccgacttgagaccgggaccccagcaacacacagaccacacaagagaccacaccaggcgaacagagaaaacactccacgatccgagaaggacacaaaccacaccccacacgaacgactcaacgagaccacaggacatgcaccgaacgaagacgaagagacgccacaccacgacacctagcagacaataagcccacacaacagacacaccacgagacccacaatcaaaacagagcacaacggaccaccgaagaaggagcagacacacacaaagataacagaagaaacaaacaacgcagacaacaaccaacacaaagcaaacaaaaa

SEQ ID NO: 525261 - DNA, 374 bp, Homo sapiens
  misc_feature (61)..(61): n is a, c, g, or t
  misc_feature (64)..(64): n is a, c, g, or t
  misc_feature (291)..(291): n is a, c, g, or t
actcctggactcaagcgatccgccacctcggcctcccaaagtgctaggattacaggcgtgnacncacaccggccttctatttttcttaccagcatgaattaaatcctttttgtctttttcttttttttgagacagagtcttgctctgttgcccaggctagagtgcagtggcaccatcttggctcactgcaacatcggactcccagggttcaaacgattctcctgcctcagtctcccgagtagggtggggactacagggcatgtgccacaacacctgggctaattttttgtnattttttagtaggagacgggggttttcaccatgtttggtcaggctgggtctttgaactcctggaccttgtggatcttgccccg

SEQ ID NO: 525262 - DNA, 335 bp, Homo sapiens
gagacatcgcttttcgctctgtgggaatgcctgacgcaccgtcgcgaagctcacagaagacagggcgacccggatgaccaactacttccttaggatgatccacctatcggatgacaatacgaagtgttatattgtgggagcagacaatgtgggctgcaagcacacgcagcagatgcccatgtaccttcgcgggaagggtgcgcggctgaagggcaacaacaccatgaagcgcaagggcatccgagggcacctggttgtggtcaccaatgaggacctcactgagatcagcgacatgtgggtggccaatggcgccagctgctgaccgtgctggtgcc

SEQ ID NO: 525263 - DNA, 155 bp, Homo sapiens
tactgcatctatctataatgcgtgcatcgcaaagaccattgaaaatttagaaggggctctagatgggaaggctcctcaagatgcctggcttgggtaactgaagctaaggtgaaccggggatacattggatctcctttgggaattgaggcccgcag

SEQ ID NO: 525264 - DNA, 459 bp, Homo sapiens
tgctgttgttcattgacatgtcatgactgcgggagcagtgcatgccctccagcgggcagcatgcttgctgcagcaggcggcgcggctgggctgccggcagtttgtcacagccacagatgttgtccgagggcaaccccaagttgaacttggcttttcttagccaccctctttaacagcataccctgccctgcacaacccagagaaccaggacattgactggggggctcttgaaggtgagacgagagaagagcgtacatataggaactggatgaactccctgggtgtaaaccctcaagtcaatcattagtacagtgacttatcagatgccctggtcatctaccagctctatgaaaagatcaaagtacctgttgactgcaacaaagtaaacaaacccgccataccccaaagtgggaagcattatgacgaagctagagaattgacactacgcgatagcattgg

SEQ ID NO: 525265 - DNA, 160 bp, Homo sapiens
tgccaatgatttccctcatgagaataattctgagtcacatcgctggggtgccatgttgggcttcagcaaggtgcttccaggtagatgtggtggtcactcagagccttgtagacagcagacatgaacttctcggtcacatactggcagcgcttcaagtcat

SEQ ID NO: 525266 - DNA, 302 bp, Homo sapiens
aagacggatcatgatataacagacacaggaaactacgatactctgactacacaacatagtaggaactaaagactatcttttccaggtacaggttgcagattccgccagacagcacagcaagctctacagatgagtggctcttaggcatttggtgctgtggcagatttgcaaacaagactttcccagcagactgaagcttcagactttaactgcagctgcctctgtacagccacttgcaccacaatgtatccaactctctaacatgtttaaccctcaaacagcagaagaagttggatgggata

SEQ ID NO: 525267 - DNA, 198 bp, Homo sapiens
tcctcaacgcttatacttctcaagcttatacttcctcaagctttatacttactcaacgctttatacttcctcaagagctatatacttctcaagcgctttatacttcctcaacgctttatactttctcaacgctttatacttctcatttcatttcccggtatgaagtataaagcgttgaggaagtataaagcgtttgag

SEQ ID NO: 525268 - DNA, 1234 bp, Homo sapiens
tacagctaaaaaaaatttttaattggaaggggggagtctcgggattctggttggcagttacaacgggatctcagggaacgcccgctatctaccaccagtattcacctggtactggcgttggaactgggctctctctacgaggctcgatcatatatcctcctctggaagctctgtgaaccggtctcgaaggatgtggccctgcgggctaacagggtccgaggagggatgtatctgagtgcagttccccgaagtcccagttggcactgtacaattgtacgaggtgagcctcgggtacatctagtggacctctgtccacagctcttggcggggtctgtggtccaagctctacagactctcccacggcgccggcgctctagacgcagaccgctctacgcgaccgaccagatagcacagttatcacggcacaaggctctacaggggcacaccacgaggggcctaagagatactccgggggcaccatgccgggagaacaggctacccaagggatggccccgagagaagcaccgggggcgagcgcccagacacaagagcgagggcctaggggtaaggaaaccccacagaaagccttggtgtggcacaacaagagcgtctatacataacccccagccacgagcaacaggctaagcatgagccaccacgggaaactacaactaacacatcacctgagggggggaggcagccacaaggggagtaggagcaagagcagccagtgtgaaggcgaaacaaaagaacctcttacggggggataatacccccacaaaggactcatgcccgggggcctcctctcacgggccctcctggggggaccttggagggatccaccccctcatacaaacatacatcccaagaagtaggccttacacacaacgagagaagggccactcataacggacacaaaagaaggatctaaccccgagggaaaacgcggtgcgggacacctacccccgtgggagatgagggaagggatccacgtggatcaccacccgataagggtcgcgggagacaagggcggcccccaggactattggcagcggatataccacacgaagtatacgctaccccgagcactcacctttaaactaggacccagtattgaaacaaagctaccacacaccttacgtgagggggcccgcttctgaaaaacaagcacagggacccaaggggggaggggacacttatcaccacacgagggcgaatggagtccacttcgtca

SEQ ID NO: 525269 - DNA, 139 bp, Homo sapiens
agtgctcaaaattcaaggcctgaacgtttaatttttttcccattaattccttaaatccggttacttatttaggattaacataatgaaaacaggccatggttttgcagcctgtattctatataggaggcattgtgtagga

SEQ ID NO: 525270 - DNA, 1379 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 525271 - DNA, 981 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
  misc_feature (926)..(926): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgtcctcagccttggggggngggggtgttttcttttcttgtttttttctcttccctgtttgccttttatatttgg

SEQ ID NO: 525272 - DNA, 144 bp, Homo sapiens
aaaatatgaattaaaaaacagagacatacaggatatggtgactcacacctataatcccagcactttgggggcttaggcaagaggatcagttgagtccaggaattcaagaccagcctgggaaatatagcaagactcccttctcca

SEQ ID NO: 525273 - DNA, 1510 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttggacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 525274 - DNA, 160 bp, Homo sapiens
ttagagttgtgagttgtgtagcgagttgtttagagatgtttagagttgtgtcacggaatatgaccgccagcactaaaataagagtacgagcacgcaaaggccaccccgattatagcgcatcgttactgcctgactggctaacctgtcaaccttctatcaa

SEQ ID NO: 525275 - DNA, 1604 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttggacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 525276 - DNA, 1650 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttggacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtgggtgagtgctgtgctggagcctcacagcaggaacatgcaggggcaccagaggaagctgaatagggcacagagggctgggtcactgggagatcccagggctactggcattgggccctcgctgatcatcatttttcctgccagacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 525277 - DNA, 280 bp, Homo sapiens
tcctatcactgctacggtccctgtagaagtctccaggaagatccctaatatttatgagaccgtggcggagaatacgctgcaggtaatccgcaaaaagcaccgggaggagtgagatgtggattttgcttttgcacctacgggggcatctgagtccagctccccccaagatgagctgctgcccccctgagagagctctgcacgtcaccattgtaccaggccccagcctccaggccccctactccgcccagtctctctccccgctctggatcctgcactctaa

SEQ ID NO: 525278 - DNA, 732 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggccgcgtagcaggtaccgagctcgat

SEQ ID NO: 525279 - DNA, 788 bp, Homo sapiens
gtcacgattcttgaagggaaagaggccttgaagaagctttgttctgaatggaaaagaggtgaggtgaggggaaaaccacgggaggcccatcctcatatgagagattgaaatttgtcgcgaaaagaaggtttctttcccttcggaaggtccctcgcaaggagggaaaaaattgtggggaaatcgaccacccccctcaagcccgctttatttacaaaggccccctgggaaatgagggaaagagtttcgtcccccaaataatcacggaaagttttttctaaggagcccaaaagccccatacgcccccacaaaaagtttttttttcacgccaccgctccacgagattaactccccaatgggggaggcttgagggttgaaagaaagagatattttttgcccacaaagcgctgagacggtacccacataagtgttacaaacccacccctcggagaagagagatcgtaagatcgtacccacgagcaccctctccccaaaaagggagaagaaagcggagaggcacccaaagggaagatggaaccacgggaccacttccaaatataagctcccccgggcgcttaccatccaaaagaacggaggcgagcacgtacgaccacagcccaccggccgacaaaaagcttggtgtgcgctagctaatgagaacacaccacgtgaaaataggacaggaccaaaagaagacccatgactcagagggaccagaaaccccaacgccaaaattcaagaccaaagcaagtaatgtttaaaaggtttttatttaattataccaaaaccca

SEQ ID NO: 525280 - DNA, 896 bp, Homo sapiens
  misc_feature (896)..(896): n is a, c, g, or t
ggcaggaccccgtcgcccggatccccgtgagtctgcccgccatcccacgtgaccgcgcccgcccccctcgagttccaccgtgagccctgcttcgcctatggcccttcttcgggggccctctttcctagctgctgcttggcatggctgcactttgccaggaggttcccagggctgcaaagattccggggttcacctccaaatggccgcttggacgcctgggtggacagccacggagggggcttggcggctttttctggggagccaaagcaagcctgggaacgaactttatacgaaccaattttcccgggcaccccttgccggtgtgcgccaaacacacgaaacaggccacacgcttttctttagcttaaccaaagtaatctttctggcaggttgacacagcgttcaaccagaaagcttggcaaactgtgaagcctttcccttcgcgggagacttcgaaaattttctcccgaggcccaaccaggccaggggacacggtctggatttggctcttccacgaattttcaaggcccaaatgttggactcttcccctttgtgagggaggactatagccgacattatcccggagggaagacacacaaggtgcgtggcccatcataaacgtgtgggtatccacttctacatacattgaaacgtggcggccggcggagccataaccagtttcaaacacgcgccccctactacagagcacatgtagacaggcgactgatgcttggtccacccactctccaccggcgacgcatgtgaggactctatggacgaagcgcactatctaccgccaggagaggcaatcccacacgactcgcgaaccccggcgtatatcgaccagatggttggctcccccgacaaggttgcattactatccagtttggcacgan

SEQ ID NO: 525281 - DNA, 107 bp, Homo sapiens
ggatgacaatggtcctctgcatcttcatcttggtcaccacgccatagaggatccgacctcgaatggacacatgtgcggagattgtgcatttcttgtcaatgtaggtg

SEQ ID NO: 525282 - DNA, 776 bp, Homo sapiens
cacgcgtcgcccacgcgttcgctctttctttctttctctctctttctctctctctttctttctctctcttgctctttccctgccttcttccctccctcccttcctcccttccttcctttcttttttcctttttttgttttttttttggacagaaactcactctgtggcccaggggggagtgcaggggctacggaatctcatctcactacaacgctccgccatccaggggtctcgagcaattctcgtgcctcagctttttcaagtagctgcaaattacaggtgagcgccaccaattgcccgggctgatgatggtatttgtgggtggaggtggggtttcaccaattgttggccaggagtggtctcaaactcctgttggcctcaagtgatgccatccgctaatgggccccccgaatgtgctggggtttcgcaggtgtgagccaccaggcccagccccgggaaattcattctctaaatcttcctaatattatatccgaatagtattctaaccttgttttcggaaaattatcacatgatattcgagaacattggatatcatcttgcatcttaatcggctcataggtcaccttaaaggaacaataatagtatttcgcagtaaacgtggtcagacaacctctgaaggatcacatccctttaaaacaccctaaagaagtctatatagcacccaaataagcggatgccacggaaaaggttttaacctcgactccaggtgaaaggaccccaaaaagtggtgcagagagccagagacgaaagacgag

SEQ ID NO: 525283 - DNA, 347 bp, Homo sapiens
acccctagcgactcttgcaagcaacatgccgcacagcttgcgacacggcgcccagtccggcgttggccaggttgaccttattgccgttctctttggcgtacttgatgaagcccgccatgccgtcggcgggcaggtccttgcggcccagcagcgtcatgggcacgtccgccacctggccgacatacgcaaagtccgtcagcggattgaacgacagcttgcggtacagcgccggcgccgtggccatgccgttgtggtggatcaaggaaggtatagccgtcaggcgccgcgcccgcaacgtgctgggatgccaacgtgccgcccgcgccggtgcggtttccaatggggta

SEQ ID NO: 525284 - DNA, 1285 bp, Homo sapiens
  misc_feature (438)..(438): n is a, c, g, or t
  misc_feature (651)..(651): n is a, c, g, or t
  misc_feature (660)..(660): n is a, c, g, or t
  misc_feature (995)..(995): n is a, c, g, or t
catggtggctcacacctataatcccagcactttgggaggccgaggtgggtggatcatgaagtcaggagttcaagaccagcctgaccaatatggtgaaaccccgtctctactaaaaatacaaaaatcagctgggcatggtggcacgcgtctgtagtcccagctattcgggaggctgaggcaggagaatcgccagaacatgggaggcggaggttgcagtgagccgagatcacgccactgcactccagcctcggcgatgcagtaagattacatcataaaaaagaatgaggtcacattttaaatagagtataaacaaaaaacttttggaggctgaggtgggagattgcttgagcccaggagttaagagaccagactggccaacaacgtaagcaggaccttatctccaccaaaattaaaaataaaataacgcccaggtaactntgttgtacttttagtacagacggggttttgccatgttgcccaaactgctctcaaatgcctggtttcaagtatctccccatctcagcctccaaaatttgggattagaggcgtgagcccctgcaaccagcctagacacatgtgtttcaagatcaacaactttgctagtggcatgcactttcttttgggaagccaatctctttgaaaatcaggttncttatctgnacaatgagtatcattgataggtattggctcacacgtataggaatgaagcataaatgaaacaaggtacacaaaaacacttggaaaggaggtaacttgcacttaaccaagtgcccgttgtgctactggtatcaataactggtattggaacatcccaaccaaaaatggcccaaggcaccaaaccggtgctatacaatcctaaggtttttggaggtaaaagggttaccctttcagggaatttaaattacacaaggccctggtccacttccaacaggcaatccattttaattacgggctactgaagcactgtcaaaataaaggcccttgaaccctacggntttccaagaacggatccctcactacaagtttcccgcgtgtttggactacaattaaatcttggaattctttgaagaaacatgtgtggccatatcacggtaaaggggaacacacgcccacaggaggtggtcccaatttttggtggctcctcaccggggcccttaataccctcgcattgccgggtgggaaccaaatgtcacctttttgaatactctacggggccctatatgatgatctgggttctgctctatatctcacctccaaatacgcttgttatcttcttctgaggcct

SEQ ID NO: 525285 - DNA, 1208 bp, Homo sapiens
gactagcaggaggcagaggcatcatggagggtccccggggatggctggtgctctgtgtgctaggccatattgctggcctctatggtgaccgaggacttgtgccgagcaccagacgggacgaaaggggaggcatggaagacctggtcgagacgtgggtgcggacaggcctcgaaggggcgagccaaggggatcctggggtgccccttgtgcatccggacagtgcatccgaaggcgcttaaaggagacctagtggggatacctgggccctcatggaaaccgccctggctaatggtggtgcatactcgcatgggtcctaaggtggtaccccgtctgtgaggcccagtggcatctcctgggatattatggatggctaccaaagggtgcagcgccaggtagaacattcagagggaaccagtcccgagtgctcatggcgattcttcgcgacccaaacttcagcgcagggagaccgcgcgcccaacatggcgcgggggcacccgtggatgggctcaagtcgtttcggatacctgggactccatcaacccaatacctaggggaattgagaccctgttacacattgaattccgaccgtaccgggacccgaaatctcggcttcatggccaagcttgttaaccccagggacctacctaaccgtaccattatcaaacccctttctccacgggttgacctaggtacacccaaagatgggggtcatacactttcttggacccatgggtacccaagtcgggtatcattccgtcaccttcgacacaggcggggcacaacgggcttcccaggaacggcaccatcacaccgttgggtggccaatatccataggctcgacacaacgtcaaccgccgaatcacacaaccgggcgcaggccctccttattccgcagacgggataggcgactaggatcaccgactatcgcgccaattttcgcatcggcgcgtataccgaccgcattaggcacaacgccaaatgaggggcggttgtaccacacaagaggctaccgcagaggacgcttacgcaacgaccagctaggaacagcgcccggaaacacaagaacgggctgttccaccacatattgtgtcccaaggggggacctctctttgatgtggcctggatctaggcgcggttcttgcacagtactcggcctatccacgtacgcatatcttatccaccaagttgatggccattgaacccccaag

SEQ ID NO: 525286 - DNA, 436 bp, Homo sapiens
ttgcggggtcggtctagaggatccctcggatctgatggtgataacacttgactaagacggaaattcttaggacatttcggtgttcagtcatttggtgtgaccgatgaatatgtgcaaaccaactctctagccagtaggcctttacaagactataactcactggccgtcgtggtacacctgtaatcccaacactttgagaggccgaggcgggcggatcacgtaaggtcgggagttcaagaccagcctgaccaacatggacaaagcccgtctctactaaaaatacaaaattagccggggtggtggcgcatgcctgtaatcccagctactcaggaggctgaggcaggagaatcgcttgaaaccgggaggtggagattgcggtgagctgagatcgcgccattgcactacagccggggtaaaaagagcagaactccatctc

SEQ ID NO: 525287 - DNA, 129 bp, Homo sapiens
gccttgggatgcttccgtcccgtctattatcccgctgtcggaaccatgctggggccccgagaattgtcccgtcgacaccgatgtcgccaatgcgctgggagttgtcgtcggacaaggtgcgcgtgtcgg

SEQ ID NO: 525288 - DNA, 246 bp, Homo sapiens
ttaagaggaaatccccatcatgtgacgtgattcccttaagtgtacaggggctggtgacctgtccttcatgataggaaactcaccttacaacaaagtggggagaaaactggctgcctgtggtagacacctgcacgcataggattgaagacagtacaggctgctgtacagagaagcgcctctcacatctgaactgcatattgagcgggcaagtcgtttgtaagttcaataaaaccctgtgatgatgca

SEQ ID NO: 525289 - DNA, 867 bp, Homo sapiens
aggatccatctgggttcaggtccaccggctgttacctccatgccccattacagttgatctccaacttaggagtagaacatgcccgacttgtggagctacttgaggttgcatacggatctgcgcacatgctatgcagcaagcggcatatggtgatcaatgagaggcaagctactgggcagggtgtatccagtaccatcacgaagttccctcctcaggcctaggatcaagacagccagcatttccatcgcagaccccttcttcagggagcgcccagaggtggatcgccgccatggcagggaccctgcctgtcttgctgctgctgtcattagggggagaccggttacattcactgtggcaacagcaggaggcaaaaataagactcagcttcagaaagaaaaagtagagagcaagagttgagagaaatggctatggagcacaatgaatgcaagaacaaagcacaagacgtgaagctccctggaggaactcagatggagaagtatccagtatgcatctcggggagggagacattcagcctataatgaatggaaaaaggccctcttcaagcctgggcctcaccattggccaaacccaacagcaaaccagaggagcaacgggagccacagtcggcactgtactcaggaatcatgcccagacggacagattctgtggggcccagaagagggtggagaaagctgaagggtggagagtgaatctagggcatataaggcatccacatagagcccagcacagagacggccttgcagctaatcaggcaagaatgaggagcttccttacactggcctgctgtgggtcatgagtaaataacatgattgccttcatacagcgctagagattcatttgtttatt

SEQ ID NO: 525290 - DNA, 1457 bp, Homo sapiens
  misc_feature (2)..(2): n is a, c, g, or t
  misc_feature (115)..(115): n is a, c, g, or t
  misc_feature (117)..(117): n is a, c, g, or t
  misc_feature (119)..(120): n is a, c, g, or t
  misc_feature (122)..(122): n is a, c, g, or t
  misc_feature (138)..(138): n is a, c, g, or t
  misc_feature (156)..(156): n is a, c, g, or t
  misc_feature (219)..(219): n is a, c, g, or t
  misc_feature (244)..(244): n is a, c, g, or t
  misc_feature (310)..(310): n is a, c, g, or t
  misc_feature (356)..(356): n is a, c, g, or t
  misc_feature (364)..(364): n is a, c, g, or t
  misc_feature (386)..(386): n is a, c, g, or t
  misc_feature (519)..(519): n is a, c, g, or t
  misc_feature (528)..(528): n is a, c, g, or t
  misc_feature (532)..(532): n is a, c, g, or t
  misc_feature (540)..(540): n is a, c, g, or t
  misc_feature (548)..(548): n is a, c, g, or t
  misc_feature (563)..(563): n is a, c, g, or t
  misc_feature (1161)..(1161): n is a, c, g, or t
  misc_feature (1286)..(1287): n is a, c, g, or t
  misc_feature (1302)..(1302): n is a, c, g, or t
  misc_feature (1309)..(1309): n is a, c, g, or t
  misc_feature (1313)..(1313): n is a, c, g, or t
tntttgggaagatgatggactacctgcagggctctgggagaccccacagacagatgttcgctggatgtcagagactggcatcattgacgtcttcctgctgctggggccctccatntntnntnttttccggcaatatgntagtctcacaggaacccnagcgttgcccccactcttctccctcggctaccaccagagccgttggaactaccgggacgaggntgatgtgctggaagtggatcagggntttgatgatcacaacctgccctgtgatgtcatctggctagacattgaacatgctgatggcaagcgntatttcacctgggaccccagtcgcttccctcagccccgcaccatgnttgagcgnttggcttctaagaggcggaagntggtggccatcgtagacccccacatcaaggtggactccggctaccgagttcacgaggagctgcggaacctggggctgtatgttaaaacccgggatggctctgactatgagggctggtgctggccaggctcagntggttaccntganttcactantcccacgntgagggcctggtganataacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggnaaggcattcctgtcatgaggccctgtgggtgcagtaccctcaggatgtgactaccttcaatatagatgatcagtacttgcttgggatgcgttgctggttcacctgtatcagaatctggagccagnngtccaggtcaactgnctgccangggngggtgggttcgaactttcaggctaccaaaagattatggtcccaaaaccgtacgggcggaaatcaaaaaggatccgggttcacgcgggcgcaacgcgccaagaagagacgggctccaagtaagagggccaccacccttgtggaac

SEQ ID NO: 525291 - DNA, 144 bp, Homo sapiens
ttctggacacggtgcgtgcggagctgtacgtgtgggcgctctgccgagaccaggacgagcttaacccctacgcggcctcgccggctcctggacatctcggcctccagtaccgagcacattctctgagtgtggtgccggagccag

SEQ ID NO: 525292 - DNA, 589 bp, Homo sapiens
  misc_feature (418)..(419): n is a, c, g, or t
  misc_feature (434)..(434): n is a, c, g, or t
  misc_feature (441)..(441): n is a, c, g, or t
  misc_feature (445)..(445): n is a, c, g, or t
cgcctcccgggttcaagtgattctcctgcctcagcctcccgagtagctgggattacagttgtgcaccaccatgcccagctaattttttgcgttttagtagagacggggtttcaccatgttgcccaggctggtttcaaactcctgagcttagacaatccacccgcctcggcctcccaaagtgctaggattacaggtgtgaatcaccacacccggcctatgctgttcttttcttattgccagttcctggaggagcatttctgacttgtgccaaaattgaaaagttttcctttattgtctttcttccttcctaggcccctgtgggtgcagtaccctcaggatgtgactaccttcaatatagatgatcagtacttgcttgggatgcgttgctggttcacctgtatcagaatctggagccagnngtccaggtcaactgnctgccangggngggtgggttcgaactttcaggctaccaaaagattatggtcccaaaaccgtacgggcggaaatcaaaaaggatccgggttcacgcgggcgcaacgcgccaagaagagacgggctccaagtaagagggccaccacccttgtggaac

SEQ ID NO: 525293 - DNA, 834 bp, Homo sapiens
gctagttcccctccctccatggtggccattctcgccaatatcgtccccctgggccccttttttaaaggggtctccccgttaggagctcccctcagggtgttcgtgtcctaccagtcgaagtaattgtgtggccagttcatcacccttgacagaatgaatggcaaggacgtggagtcacctcgattgctaatggtccacgccacctaggggatgtgcagactccccccgtatttgtcgcgcggcgaacgaccgcttgggtaggaatcgcctagagcaactccgcgggctctcaccacggggcgaggtgtcgcacacacacataggggtggtgcccacaacacaccacaaccgccgcgtgaaacacagaagggcgtggtcatggtacgcaccccacggtgtgccccgctacaagcagacgcacgcgcgttggccccacccgcacggtcatgggcccgcacacgcacacagaggtggggggcacgcccttttgggtaacatacaaaggggggcccccgcgagacattctaccacacatgagcgccccactcttgtatgacaccgtggtgaccccctccgccacgccccacagaattcaccgggcctattcctccccggggagcaccaaaccgtggtcccaccaggatatcaggagataaatgttagcaaaaaaaaacacacactggggtgcatgtattccctccaaacactattgacttcgcacgcagccgctcctcctacatcaaacagtttctaccctcttctctctcgtactagaaaagtatggctctccaccatcacccgccacgacagcaggataatttttatataatatga

SEQ ID NO: 525294 - DNA, 191 bp, Homo sapiens
attcgtggtcggcaccctacttgctcctccttgccttccaccatgattgtgaggcctccccagccatgtggaactgtaagtccattaaacctctttcttttgtaaatttcccagtcttaagtatgtctttatcagcagtgtgaaaatggactaatacgccctgctcttctgcagaccctcctccaaagccc

SEQ ID NO: 525295 - DNA, 405 bp, Homo sapiens
ttcgattggcgggcacttaggtcaggagttcgagaccagcctggccaacatggtgaacacccaatctctactaagaaacacaaaaattatctggtcatggtggcgtgtgcctgtaatcccagctactctggaggctgagtcaggataatcacttgagccccggagccagaggtcgcagtgagccaagatcgtgccattacactccagtctgggtaacaagagcgagactccgtcgaaccaaaaaaaggaaaaaaaaatcctgcctgtaatccaagtaacatgtcaggctgacacaggaggatcacttgagcctgggaggttaaggctgcagtgagccatgattgctccaatgcactccaggctgtgacaaggcgagaccttaactcacaaaaaaaaaaacccaaa

SEQ ID NO: 525296 - DNA, 147 bp, Homo sapiens
cctgctttgtaggtctgcgggagaaggatgacatccatgagggcacgaatgcatgctgcagcaggcggagaggctggcgctgccggcagttatgtcacatgccacagatgttgtccgatgggaaccccttagttgaacattggtttt

SEQ ID NO: 525297 - DNA, 1236 bp, Homo sapiens
agcggggggtggtgccgtgtccccgggtggcgccggtccgatcctttcctggtcctgcgggtccacgatgtgtccgtcggggttgcagtggacaggtggccgtgtcccggttgctcatgactcagtgtgactacgcaggacctagaggctctcttgagacgccctgagatcctacgtgattgcctgcttccgtctcctcgcgtggctagctggaagcactccaacgcccgctgggggtcctgggatgttcctgataacgtagaggtgacggcggactagtctcgtcctctcgttctctctaacactagtccttgcggttgtagctctctcgagggaggagccagggcgagtacgacacgaacagggagggtcggaacttgcactaagctgaagagggctacgtgggctcttagcagagatgactttctccgataaaggcggttctgttatgcgtagaagaccttgctatgagtatagtgccagtggcgtatcaaacttgaacttgagtggtaaagcatagaagagctcatgattaccgttacgtctcagacatctgtactaggggcacctggaaagattggactggaaaggaggggctcaccaaacagagagtggaacgcaaactaagaaacggagcgtataaccgagagtctcctgtggaaataccctcgaagtaatgataacctcgcaacgactaattgacacttagtaagggaatggccaggaagagacatttgtcaattcgtgggtcaaccttcgtacctagtttgggtaaaccacctccttggggcgtcgtaaaattggactccgtgggtgggcactttgattttaatcacgtcacgtagtggctagtgtcccccagccatcttcgttacgttgtctaacacctcactgtgggcctaggctcgcacagggagttcgcgggtgttaacccaattggcgtggaggtaagttatttcataacggacgtaagaaaacggggaacgaaatggagctacttgcaagtcccacgaggagacttggaataaccgggtgtaaaccttttcctttgggcgtcggattgagattcatgtcgccatataaaattagacgaggcttgcctccctctacgattaagatccatagcgcacatttggtggaccctggtgggatgcgtaggtaccccacatacttgcggacgttgaacaattacaacacataagtttgtatacgttaaagaatttgggacaaacccgg

SEQ ID NO: 525298 - DNA, 654 bp, Homo sapiens
  misc_feature (6)..(6): n is a, c, g, or t
atgaanactcgatttccaaccacgccgaatacggcgaggtacgtgcccgcccctgaagtcatcaacgccgaatccgcccaagccatgcgcacggtctgcaggcgcatccaggacggcgaatacgcgaagatgttcatcagcgaaggtgctaccggctacccatcgatgaccgccaagcgtcgtaacaacgctgctcacggcatcgagatcatcggcgagcaactgcgctcgatgatgccgtggatcggcgcgaacaagatcgtcgacaaagccaagaactgagtcgacgctcaaccggctgcctggcccctcggggctgagcgccggtacaggctgcacccaaacgccccgacttgtcggggcgttttgttttgtcacataaagctttcatgtcagatgttgaacattccaggtaaaggacgtaatttacttacatgtaagatttttcggaggacagatgccccgtaaaaaaacagcggatgacaagcccctcacgggcgagaaagcgtcatcaccggccaagaccaagactaccgccgactacgttcgcgatatgcgcacgcggctgcgcgacgccgggctggtgaagcgggaattctggattcttcccgagaatgcgacggccctgcggggtatcgaaaaggcggtcgacgc

SEQ ID NO: 525299 - DNA, 356 bp, Homo sapiens
ctgcgtcaggcgaaagcagtgacgagaactacgtgaagatccacattgtaaatatttaaaaattagagccaggaccaggcacagtggctcacgccgtgtaatcccagcactttaagaggctgaggcgggtagatcacctgaggtcaggagctcaaggccagcctggccaatgtggtgaaacctgtctctactgaaaatacaaaaattagcaaggtgtggcggtgcacacctgtagtcccagctactcgggaggctgaggcaggagaatggcgtgaacccaggaggcagaggttgcagtaagtcgagatcacaccactgcactccagcctgatgacagagcaagactccatctaaaa

SEQ ID NO: 525300 - DNA, 403 bp, Homo sapiens
tccctggtcgatctgtgtgaaaacagaaagaagatagaacacatatcaaattgtatgtacgcagagctctcatcatggataactgtgcaggagctaatccctgaatatctgaccttcattcagaggggtggtagactcggaggatctccctctaaacatatcccgctgcacatgttgctacaaagcatatttttgaaagttatcaggaagaatttggtctaaacctgcttagaactctttactgaaccggcggaagatttatagaactacaagaaattctatgagctgttccctaaaaacataatgcttggaatacaccaagactctcattaatcggaagaagctctcagaagctgtctaggtctacccatctgccctctggtgatcagatggtatctctcaa

SEQ ID NO: 525301 - DNA, 219 bp, Homo sapiens
tggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattatgtcgacg

SEQ ID NO: 525302 - DNA, 108 bp, Homo sapiens
tgcacagaatcgtcacgaggggcgtgagttgatttcggcaagggccgcgctgtcgttgccggtactgaaggccatggtcgggtactcctgctgcgtgagaggccacgc

SEQ ID NO: 525303 - DNA, 132 bp, Homo sapiens
cctgctgtcatgagtattgatcagatcaggcgtttggtcgagtggacctggcactcatgataggagacaggtcatgcctttcaagtgcatgcagctgcgctgatcgcatccgtcaacatttccgcacagtgc

SEQ ID NO: 525304 - DNA, 483 bp, Homo sapiens
gggggaaggggccccaattcccaacccccttttcccggggggggggcggtttcttaaaaccagggggccccccggttttcccgctggaaaaggggccggggggccccccccaattaaggggggtgggcccccccatggggccccccgggttttcccttttatgtttccggttggtatttgggggggaattggggggggaaaccattttcccccgggaaccagttttgcccatgtttcccccaggctcaaatttcccccccccaaaagggaccaaaagggggggccccccccggggggggccccttttaaaaaaaggggtccccccggggcccgggatttgggcccgaaaaaaagaaaggggaatgttaaaacttttttttaaaccaaaagttccaggccctttttttttttttagcccgggttggttttttccaaaaaaaaaaggttttttagatggaaaaaaccaaaatccccggggggcca

SEQ ID NO: 525305 - DNA, 1235 bp, Homo sapiens
  misc_feature (1151)..(1151): n is a, c, g, or t
tgtgaaccgagaccctggagctggctgaagctcaagcgctccgctaggggcagagggtctgcggtggctgggaactgctgctccccgacgcacctggcctgccccagctgcagcgcgctccgcggggtgcttgatctgcctcttctccaatgaaactcaaccactagtgacaatgacgcagcctcctgagctactccttctccaagagaagaactgattgaccaaccccaattatttacatgcccaactgaagtgccctgatccccaggaacgatggccgccagtgcagcagacactcagttgcaggtttgttatcaccggttgtcttccattaaccctggctcgtcggtcggtgactcttgactcgttcgtttaaaccttgtacaatgaacaaaggctgctatcgtcacctatgaaccctacagaaggtgagcccaagtgccgatcgtccagatggagagtgactgtggccgaggggcacagcgagacaatgaggaatattctcatctaatgactcccaggccccaatggagcttcattcctgggctccatcgctaacacgttggactgcttcattattgggaacagtaatactctgaagccagggatgaagccttgattgatgtgggcaaatccagagctccagccgaggtcgcagtcccaaaatgcctgacgtcactgactccagggcacccagggacattggcgcaccgctgtctattgctgtctttcaaccagtgcgctcttacgtagacgctggtggtcgggacttggccatccatgactgtggctttgccctggggacctctgcgctctgtgaccagccactccttttctcgcctgcgttgactgggacgagaaaacgaacaatggagtcaacggccaacgggctgtctacacctgtcccctacctgggtacccacgttacaagcccccggtgtgagacaatcctggttccaatcaaagggggtttccccccgaccaggcgtcgggatacaccgcgcggctaaaaggcgcacgccagggtggtggcctgtagacactatggggcacttaccaccctgagcataaggtgtcataccccccataatttgaggtccctccgtatccagtgtctccccaagagccactatgacacgtctactactcantccagaattattgtgaccaagcagacaagcggcagtcttgctatcgcgacacgatgcacagtacgcgtaagttgccgcccgctt

SEQ ID NO: 525306 - DNA, 192 bp, Homo sapiens
  misc_feature (145)..(145): n is a, c, g, or t
agaccagcctggccaacgtggtgaaaccccatctctgctaaaaatacaaaaattagccagactattagcgggggcttgtaatcccagctactaggagatgagcagagaatcattgaacctgggagtggagatgcatgagctgagntcgcaccgctgctacactccagcccagtgacagattaagactgtctc

SEQ ID NO: 525307 - DNA, 289 bp, Homo sapiens
caggcacatcccccttatcatttcagagtggctgcacagcaaaagaaactatcaagcaaagtgaaccgaactacagaagggaagaaaatttttacaaactatgcagtctgataaggaagttaatgtccagcaatatatagaggaactccatacatctcagacaacaagtaaacaaccccaagttaaacaaaatatgacaacagtttctgtgtatacgtgaagacaagtatactagaagacaagtatacaggccaagtaagcacatgtgaaagattctcaggtcattagt

SEQ ID NO: 525308 - DNA, 733 bp, Homo sapiens
  misc_feature (73)..(73): n is a, c, g, or t
  misc_feature (109)..(109): n is a, c, g, or t
  misc_feature (152)..(153): n is a, c, g, or t
  misc_feature (165)..(165): n is a, c, g, or t
  misc_feature (171)..(171): n is a, c, g, or t
  misc_feature (242)..(242): n is a, c, g, or t
  misc_feature (255)..(255): n is a, c, g, or t
  misc_feature (262)..(262): n is a, c, g, or t
  misc_feature (315)..(315): n is a, c, g, or t
  misc_feature (330)..(330): n is a, c, g, or t
  misc_feature (343)..(343): n is a, c, g, or t
  misc_feature (348)..(348): n is a, c, g, or t
  misc_feature (395)..(395): n is a, c, g, or t
  misc_feature (405)..(405): n is a, c, g, or t
  misc_feature (410)..(411): n is a, c, g, or t
  misc_feature (418)..(418): n is a, c, g, or t
  misc_feature (429)..(429): n is a, c, g, or t
  misc_feature (439)..(439): n is a, c, g, or t
  misc_feature (533)..(533): n is a, c, g, or t
  misc_feature (541)..(541): n is a, c, g, or t
  misc_feature (549)..(549): n is a, c, g, or t
  misc_feature (630)..(630): n is a, c, g, or t
  misc_feature (669)..(669): n is a, c, g, or t
  misc_feature (731)..(731): n is a, c, g, or t
gagtggtggtgatgcaaagatggaagccatggtggtgggggctgttaggggtgggggcagttgtgtttccttnacccccactcctggtgtcctctcctgaaggacaganggtcacattccaaaatgggcgagtttcctaccgtgtcttttcnntgttggaggagntgtctntcttatcaggcagcccactaatattgacctcaaagcgatcctgcacatcattgaggatcttggcatcattntcatcggacacanatgtganagccatagcccttggttgccaaaccggcctgtccctggccacccgatgcaggnaggtgtcagaatccncaggtcatgtganaattnaaagcaatgttcacccgctcgaggttcatgccttggccaaatagggnggttgccacnagaanncgtcgtngaaaatctttnaactgctganaccgagaaagcctctcctcctggggcatcccacggtggatggcaattgtgctgggaagttctcgccccactagtagctgggccaaggcaatgcnccgctgcncaaacttnacaaagatcaccacctggttgaactcaaggacatccagaaggtcaaagagctttcggttcttctcgttgtccttcagtttnacgtagtactgctgccacccatgcagcgtcaacttcgtntcatcatccacgaagatctccattggatctagcatgaacttgcggcagaatagacggatctntt

SEQ ID NO: 525309 - DNA, 650 bp, Homo sapiens
cttccggctgagccccggaagggtgatgtggctgcggacatcgctcggcctcgctatgtctgccattttcaatttccagagtctatgggactgtaatcttgctgcttatatgtacctgtgcttatattcgatccttggcacccagcctccatggacagacaatccaaacgtggattgtggggtatagtttgggaatgtgtgccagaatgggtgaacggaagagtccttatgttgcagtatgctgtctagtaatggccgttcagctatcctcttcatacagtagctggggaaaatgccagaatgtagttgccatcagacttcgagtgtgaacaaggtagcgtgacgtgcagaaagactaaatggacaacggatgtttaagctctttgatctccgaacattgaatgagataaatttccagatgctgttctctattttagtgttattggaccaatgttctgtataaagcaattaagactgtagaccatttatctagtctgtaacaagtcaacctcagtactgtcactacagtattacatttctgcaaatgttattctgttgtatcagatacgaaattttcagcgaggtatctctaaggcacatagtagaagaccaccaatggttacttcactcaagttcctttcactggtgct

SEQ ID NO: 525310 - DNA, 269 bp, Homo sapiens
gtagaagacgcagaagggcggctactgcagcttgtacgaggattggcccccggataaaagcatcatcatgcacagaccctagtgcagacctgcccactcattcctccttcgtgagttccttgacataatcttccagatatgacataatagtgctgtttcttgcaatttagcacttggaacatttaaagaaaggtctattctgtcatatggggttattgggaactattctccctgtgcccaccctggcccttgcccttctgtcgtcttct

SEQ ID NO: 525311 - DNA, 367 bp, Homo sapiens
gctgatcctggaatctgccgctaattctcactcagattttgagattttctctgcggctgcaggagccaacagagtcctttgtgcggcctcaggactcggctttcagaggccctggagccagtggtgttggattcagccgtaattcttcattctttggctcaagggaaaaccttgattctgcacaggattgcaaaagccgaggcactccagctaggacacggcgtcattggagtgcgctgggaggagtgacaccctcctcctgggctggcgcggggaagagaagctcccgcgtgtgaaacagctccaccaccaagcgcctgcagacgagcggtgtgttccgcctggaacctgccgagggaacgtgtgg

SEQ ID NO: 525312 - DNA, 114 bp, Homo sapiens
  misc_feature (86)..(86): n is a, c, g, or t
  misc_feature (112)..(112): n is a, c, g, or t
agtgctcatgctcgctgcaggggtatgaggtcagggcgagcgtctcgcaggccgtagaaggaagatggcggtggagtcgcgcgttncccaggaggaaattaagaaggagccnga

SEQ ID NO: 525313 - DNA, 363 bp, Homo sapiens
cgcgggcggtagcctactttctgctcggcggtcagcaatgcaaacaaccggtataactaccgtcagcctgggagccgccgataatcagttgggactgcgtaggcgctccctcttccgtgccggcagcagcaacgcgcaccacaatgactcgcgtgcttacctggtcggaaatagcctttagtgatttgtacagggagccggttttgcccgctttgccaagtacgctgataacccgcgtaatcaaaaccggagtgtttaaggggaaagtggtagcgtcagcatcgtccgccaccgcaaccagaccgatgaccgttgagtcaacgtcgttgatcgcggtttgcgtcgacgcggccgccgaattta

SEQ ID NO: 525314 - DNA, 967 bp, Homo sapiens
gactctgaactggcatcctagcaccaatttgtcgaactggccagccctgggcctggctctccatgatgtctaaatatcgtgggtctggcaacggtccctgtggccgacgtcgagagacttgtgtagtctcgcaaagccaggtatgatgggtcagcttagcgtccagtcaagggtaccaaccgcctctaccttgccgccgaaagggcaccatgaaggcttgaagtagagtgctcttcctgggagactggtgtgggcttcacttgttaaaagaatggtgtctgtcgaaggcttgtccgtgcgtgtcatcgtcgctggtgtccaggaaatatgatccttcaattgcctgcagctgggttcatattgctccatgcgtgatgtgatccttgctcctagtccaggacaatataaagctgacggatatgcccccatggtaatttgatatctgtccgcccgttgtcacatggcatgcaggtctaggtgagcagaaaggccttgattgatcgcggactgggtatgaaagctggatgattggccaatcttcttggaacgcctggggatgctgccagttagtcgcaatgggtcctaggcatgcccatgatgcagttggagagctactcaagaccttattccaacctttgtgttcgctttgggtgttccgttgactagggcgaccggcccagttgtcgttgggttgttgtccacgcgccgtgccacgcacaggtggtgagtgtgtgggaggtcgccccaggtctggcgcggaacggcagaaggcaatggaatttatcccaatgaaatggcaccccaacttatcagtgtggggagacacgttccgaccggggatcgatggcacaactttcacaagtgggtccccgccccactttggggagcagttggccacgcccgcgggggctaccacccacacacgcccttctttgccaattgaacaaacgccgccgggggccatgcc

SEQ ID NO: 525315 - DNA, 110 bp, Homo sapiens
ggggggaaattttttttttcccgtttttccggggggttggcccggggggggggttaaaaaacttttttgtttttttacccgggggggggggggggttttttttaacccca

SEQ ID NO: 525316 - DNA, 346 bp, Homo sapiens
  misc_feature (56)..(56): n is a, c, g, or t
  misc_feature (94)..(94): n is a, c, g, or t
  misc_feature (96)..(96): n is a, c, g, or t
  misc_feature (112)..(112): n is a, c, g, or t
  misc_feature (118)..(118): n is a, c, g, or t
  misc_feature (176)..(176): n is a, c, g, or t
  misc_feature (180)..(180): n is a, c, g, or t
  misc_feature (203)..(203): n is a, c, g, or t
  misc_feature (288)..(288): n is a, c, g, or t
  misc_feature (315)..(315): n is a, c, g, or t
aaacaccagccccctagtgcccccagattggcccatcctttttataaggatcccanccagggctggttatgggagtttgagtgtgcccaaccantnaaaaaggatccagccntgagcntcccccaagtgctttatgcctcaggtgacaaaaggcaggaggttccattccgaggttncccnctcccccaaaagtttgagcccancctcaggaggggccaaaaaccagggggccatcaaaagcatcgggttttggcattggttccaaatgagcttttaaagcaaacaaancagttgtttgccattttttgccctcanacctgtgtaatatatgttcctggaaccctta

SEQ ID NO: 525317 - DNA, 448 bp, Homo sapiens
gtgggaggtatagctcccagaggcggtcctgccgcggcctagtgcgccgcggtgtgtggctgctatcgtatcagccagagccgtgtgctccggtgcccacgcaacctggtcgatgggcagacctggcagctctcctgttctgtgggctcagacccgcctgatctccctagtccccgggctcatcccaccttgtccccgagaggtcccacagagtttcgcgatctcctggatacccggcagggtgctgcgggtgcgtggcaatatctcatcgagggagatgtgagggttcctctagtgtgcagaaggcgtgcagcctggcccagtctgatgtgaccctctttttacacagctgctagtgccttccccttgggcatcctcagtgccagccaggagccccctcctgtggcctccgagcaccctcctgacacctgaggagaccctgcccaag

SEQ ID NO: 525318 - DNA, 568 bp, Homo sapiens
tccagcacggagaggaatgaacggcccactggagatggctccttactctacacggctgatgcttatggggctacgagagcgattcaaattcatttaccatctaagagtgggatcttaaaaatatgattcacggggagaagctctgctagcatacgtttcccaggaagctttccatggatcacctttaaacaggacgccgggcatactttcggcgatgctgctcgtccactcgctccaggtaccaagtacctgggaaaaggctgtttgtgtcaccaggtggggagaaattcaccttatggtagaattgctctctttggttcattatttctgtgaactcctcatgagacacacactttcaggaggctacgcgttttggcaggtctgatgtgctggacaccaacttgtccacgggagagcctggagcagcatcctcggatactcgaaatgaaaagaaacttgctgctaaaccagagccataagagaaggcaccaatcctggagccagccagttcttgggcatagtggtgggacagaagcgaggccaagcacccgtacagggatgaagtgta

SEQ ID NO: 525319 - DNA, 113 bp, Homo sapiens
gataaagttaaatgtcctttgaagtatacttaggagggtgaactcactggaatggggatcttgcatgtgtatcgttagtaagagctaatagagagcagcagggaaagacaggc

SEQ ID NO: 525320 - DNA, 143 bp, Homo sapiens
cttcaagacagcgcgggcggggtgcagtgactcacgcctatatcccagaactttgggaggcagaggctggcacgaatgcttgagtttgagaacagccatgggcaactatggtgaaactcctgtctctactaataattatgcca

SEQ ID NO: 525321 - DNA, 1002 bp, Homo sapiens
ctgtgacccaatcccttatttccacaccccaacctcttatctctgtgccccaatcccttatttccatgccccaaccccccttcccacttttctagggggcaagaacccccaatcccttatttccacaccctgacctcttatctctgtgccccaatcccttatttctgtgccccaaccctttctctgcttttctggagggcaagaaaccccaccccttctccgtgtctctactcttttctctgggcttgcctccttcactatgggcaagcttccaccttccattcctccttcttctcccttagcctgtattcttaagaacttaaaacctcttcaactctcacctgacctaaaatctaagtgtctcattttcttctgcaatgcctcttgaccccaatacaaactctacagtagttccaaatagccggaaaacggcactttcaatttttccatcctacaagatctaaataattcttgtcataaaatgggcaaatggtctgaggtgcctgacatccaggcattcttttacacatcagtcccttcctagtctctgtgcccagtgcaactcattctgaatcttccttctttccctctcgcctgtcccctcagtcacaacccaagcgtcactgagtctttctaatcttcttttctacagacccatctgacctctccctacttgcagggcaagctagggtcccaattcttcctcagctccgttccttcaccctgtaatcttttatcggctccctctcaactggtcggtacagttcgtctgtgatagcctcccacacttgccagcatttactcttaaacaggttggttggagccaaggatagtcaagttaatggccctttagtttatccaaatcagaagttggaggcctttcatcagatttaaagccaggcaggtcatttcgttggcagcactgaaagtacgcctgacctaaagtgaaggccctattcagaacgttttaccagggtcgattatattcacaaaacaggacac

SEQ ID NO: 525322 - DNA, 885 bp, Homo sapiens
ggtctggcagtcgtttccggatgctggtctgctgcgctgcagtgccgcgtgtgctgggctcctccgtcgccggcctccgcgctgtcggcccgctcgcctttccggcagctcctgcagccggcaccccgtgtgtgcacccggcccttcgtggctgctcaaggtgcgctgcaggattccgaagcggggtcgggcctcctgcggctcgggaccctggcctgtgttgtggctgcgtgtcgctgcaatccgactgggacaaagctttctgttgcattgacctgagctgatgcaattaacggacgtgcaaaagcacaagacttccagaagcataaaaccctccctaagatgtctggaggttgggagctgccactgaatcgcgacagacagcgacaattacgtgcggacaatctctgccgggccaccgccaactcacggtcactttcaccattgaccaccgcatcccaccaacaattatgatgcgttgaggaggaaccctcgccagcgggcaaaggctgactgaacaggagtccctgaacttgacatctaactacccaacttccgtggtatcgacggttatcaacacgcaatgatgactctgcaacgaaggccctatggggctcgaaccttgtcattataccacgacagactcgaccgcttcggaccacaccaccgatcgaatcgcctcgcgatctgacctttcctctcctctaatccgggaaacattagcccctacaggacccactttgcgatatccgacctggccgcgtaatccctacgtctatccaacaccaggcccgacagcaccgctttgcctgcgcgcctactgtgacccccctcaattgcttcgccttcccgaccgcagctgttgaccagaccttctgcgcacta

SEQ ID NO: 525323 - DNA, 170 bp, Homo sapiens
taagtgcagtgcatcatggctcatgcagctttgaactcccaggctcaagcgatcctcccatctgagcctcctgagtagctgggaaccacaggagcatgcaaccatggtgggctattttttttttctttttcttttctttttttttttttttttttttttttaaggcaaaa

SEQ ID NO: 525324 - DNA, 792 bp, Homo sapiens
gtgccagacggagcggccgtgacgctttcgcgctgcagacggctgccccgacccggggcgctgacccctggcccacgcagctccgtgccgggccggagagcgcaactcggcttccaggaccctgcctgctgcgatgctgtcccctgtgactgagcctgggcagcgcagcctccgcactggtactgccctgtgactgggctggcctggccagcagtgatgctgagcttcccctgcaccgtgccaggctgcctcctgcacagctggctgccgcccccgcagccccatgctgccagcccctggaggggcgcaggctgacgaggagtgagccggcgcggggcgcatgaatgccagcaaggggcgcgccgcgaaacgcgcccccaggagacaagcagagatctgcaagcaggaagaagaccgggaaggaaggtgagcacgcagcaacgacagaacgaacgccagacaaagagaagccgaagaagagcagccagggagccacggaaccgacagaacgaaaaaagaacaaaatatagcgaaaggaaatggaaacaagcaacgccaaacaagaacaccatccaccagacaccacacgacaacgaatcacagagcaccgcatcccgcgcaatgacaacactggcacaggaaaaaacagaacatcccaagacaagacggagcaaacacaagcggacaggagaccacgtggcaacaccagagaaaaaaacggcagaccaacagcaaatccaaacagagaaaaaaccaaaagcagagcgcaaagaaaacaagaatcaaacaaaa

SEQ ID NO: 525325 - DNA, 317 bp, Homo sapiens
ccccccccccccccccccccccctgggggttggggggggggggttttaaaaaaaccctttcggggggggggggcccccggggggggtttttttttcctttccccccccccccggggggggggcaccccccccccccctttggggcccggggggggttttttttttgggttttttccccccggggggggggcccccccttttttttttccccccaaaagggggtttttttttttttccccccccccccctgcctttttttttttttagggggggggttttttttccccctttttttaaaatttttttttcctggggga

SEQ ID NO: 525326 - DNA, 826 bp, Homo sapiens
ggttgtggctgcggcctttgaacaagtaagtgagccaccctcgtgagacccccgcgctggggacgggagtgccggcgagcctcgggacctctgaaagccttgaggagtgcgctggggacaccatggcctgagcctcatgacaggaggaatgactggcgatggactggctctgctggagcccccctgggccctgtgaatggcctgaaccctgcccacacctgctgcctctgtagctggccaagaacctggccctgcttaaagccctgctccttcgatgtgacctttgacgtgggcgacgagtacgagatcatcgagaccataggcaacggggcctatggagtggtgtcctccggccgccgacggctccaacgggcagacaggtgtggcatcaagaagataccctaatgctttcgatcgtggttgagcaatgccgaagcggagcctcagcggagctgaagatccatcaagcacttattaacgaaggagagaatactattatcgagcatctaaggagaatctctgagaggccaacgtgggcccattaaggcgcgaaatccaagatcacgagtaaaaagtgggtcccggggaccctgatgggaaccaggcggactcgtgaaccaagatcattcgcatactctcacaaggcccactcagcactgagagcactgtggcgctactttcctgtaccaacctgcttgcggcggccctgacattacatgccacatcgggatcaggtcatccaaccgtgaacctgaaggccctccaaaacacatatgggctgaatgagacctggtgcagctcaagattgggagcactaggggtatgg

SEQ ID NO: 525327 - DNA, 872 bp, Homo sapiens
gatccctgctacgaccgatgcccgcgcagcgcgtgtccccaaagtgagggccaatgcctcttcgccggttcccatgacgaatctggcgcctgaatgtctggactgagacttgtccatacaaatagtcgacacgacctcgggctggctgctgtgggaagcaaggtccctgagtagcattgctgagaatcgatgatggcgggtcccctgcatgcgtatgtccaggagcagctctcgtatctcctaaccaactgaacgtggcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaatgctggcacttccggtgtatgcctggaagggcgaaacggacgaggagtacctgtggtgcattgagcagaccctgtacattcaacggacgggccctcaaccaatgattctggacgacgggggccgacctcaccaccatcatccaacaccaaggtaccgcagttctgccaggcatccgaggcatctctgaggagaccacgactggggtccacaaacatctaaaagatgatggccaagggatcctcaagtggcatgcatcaaggtcatgatcagacccagaccagttgcaacctctatggtcgccggcgtcatcataatgggaccagcgggacccacagtcagaatgcgcaagaccaaggaccagaaagggcagggaaggctccaagcgagggtcgaacagacaaacaaaaagccccacagcgccagcgacaagacccaaaagaaagcaccgacccaaagaaacagcagacaaagaaa

SEQ ID NO: 525328 - DNA, 913 bp, Homo sapiens
gtggctctcacctataatcctagcaaatcgtagtacttgggaggccgaggcaggaggatgcctgagcccagggttcaagaccagcctcagcaacataaaatacaaaaaaatacaaaaattagctgggttgggtggtgtgcacctgtggtcccagctactcaggaggctgaagtgggaggatcactttgagcctgggaggtcaaggctgcagtgagctgtgatggcatcactgtactccagctttgggtgacagagcaagaccctgtctcaaaaaaagaaaaaggaaaggaaaaggaaaaggaaagaagaaattggtttttgggatatactaatgtgccagggcacgatgccaaggccctgtgatactttctctaacatttcacaggcatgggcggacagggagggtccacgcagatgtaagactactttggccaagggttcagccagaaaggtggaccgtggcgatttggccccacggttgggtggagcagtcctcacctatgggaggctcagacaatatctggtgtgtctagcccttttgctcagctcccaagcttcgtgggttcctttaccttaatttcacatgttgactgtgagctaaccgtcatctcggggcagcctaaggtggcacatcgtgagcgaggcgtccattgccccagttggtcttcgttccagattacctcaggaagaaagcgaggcctttgttgtccaagaatttaaaagcgaggtcaagggggcatgcgtgttatccaacattggggggctgagcaggaagtcgttgggcccggagttgggaccacgtcggatgttaatagaagcgctctaaaagtgcaaggtggggtgtgggccccctccacacaaggggggaggagacactccaagaggagggggagagcaatacgccgggaaaact

SEQ ID NO: 525329 - DNA, 140 bp, Homo sapiens
gtcctgtcttcagtcttgaagcagggcttcccaatgccccttttcctccttgccttccttcccccattatttccacaggcagcataatttgttttcctacttatagtcactgctctagacagaccaagagaggccacagt

SEQ ID NO: 525330 - DNA, 228 bp, Homo sapiens
  misc_feature (33)..(33): n is a, c, g, or t
  misc_feature (73)..(73): n is a, c, g, or t
  misc_feature (131)..(131): n is a, c, g, or t
  misc_feature (148)..(148): n is a, c, g, or t
  misc_feature (164)..(164): n is a, c, g, or t
  misc_feature (168)..(168): n is a, c, g, or t
  misc_feature (170)..(170): n is a, c, g, or t
  misc_feature (185)..(185): n is a, c, g, or t
  misc_feature (225)..(227): n is a, c, g, or t
gaagagctgccattggctgacagggctttttcnggctctgtctttggtcagggggcacaccccagcctgaagngtgatgccattggccagggagtggttttgtcatagccgttggctgtgaggtggggggnaaagttctgggattgangccctgtggccagggngttngncggggcagcgacttntgggcctccaggccctcttcccaccatagcaatgtgggcnnnt

SEQ ID NO: 525331 - DNA, 1563 bp, Homo sapiens
  misc_feature (706)..(706): n is a, c, g, or t
tctagtggtgggacacttttctgttcgtatattataagctaacaacatattttctcagagggtttttttcttaagtaatactactcatgcgacactggcgtatttactcagtcgtcgtttagtatgggcgacgtaatttttattgctttcatcaacgactttttttttaggggtgctattaggccccccaggacggttttttcgcttctataaagaggagatttgtccgccttttttttcgtattagtgttgttttcgtcggcgccacacctccccataactgttcgcctctgtcgtttgttattgaagaagccccccctcttgtggggtaataagttcgatatgttgctcttccacaataggggtgtttttaaataactacattgccacatttcttttggttaatggaagagaaccatctacaggggcacctatctgcctttgggtgccaaaaggaagtttgttcagcagaggggtgtttttgaagcgaaaaatgcctagtggtgccttataataattcccttcgcggtttttatataaaaagatgttggtggtagaaagaacaagagattgttttttcgtcgcctccccgagtagaatatttgtttaagaccccctccgggcgccccttcggtgttttgtgaaagaggcccccccaggggggtgtatatgggggcgcccacaaacttccacgaggtgtgcgctntccacagggtcttttataaaagggccgctctctccacattataccgtttttgtcctctttctagctcgcacccctttgtatatttacagatattagcttgagagaagattttataaattgtgggccaccccctcatctattatatgtgcgtagtacacatatatatcaaatcgtcgtctatagtgggtataaaaattttccttgaaggaccgtcgtagaccttctctctgtgcgccccaccaccgctctctctcttgtgtgttgtgctcgtgcttttcccccgtcgagaagtgtaggatgatattattctctccaccgcgagatagagagggttcttgcgcacatacacgcgcttatggttatagaccaccttgtagagcgcacacacatatatatatgtgggagaaagaatctataggagagagagtagagagtccacagcgcgctttgttctatactataaggagactataagagtggtctcgcaccacacacagagttggtgcgcctcttttgttatatattgtcacatataaagagaaagagagagattgtgagagcctgggtgcgcacacatggcgcttgttgcgcctcgtattagatctccaccgcgtatacattgtggagaggctcgaagggcacaggagaggggtgcttgtagagagactaagcctcacagggaaacacataagtgaggagaccccgttctcacattataaaaaaataaaaaaaaggcacatggtggcacacgcacctgtaagtcccacgctaactccacggaggactgagggctagaagatcctttgaacctaggagtttgagaccagcctgggcgaaatagtgaggccccatttcca

SEQ ID NO: 525332 - DNA, 135 bp, Homo sapiens
acccgttataacgcgcacagcctgccatggcctccctggggtttaaagtttgctgctggtagatgtagggcttgtggagtctccaagtataaggtgaaggtgaaatgtcgaatttgttatctagtcgcatcacct

SEQ ID NO: 525333 - DNA, 105 bp, Homo sapiens
cgactctagaggtatccccctctagcttatacttccaatatttgttttttgttttctttaatagaggcaggtcttgctacgttgcccaagctgcttgtgaactcc

SEQ ID NO: 525334 - DNA, 626 bp, Homo sapiens
tctccaagctcctttcccggctgttgctcgtgacccatgtatggcttcttttccattgatgtgtgatgaatcccactggcacatgtgtgcagtttctttcccaatggcctggtggcctctttggtgtgccatgtgcccaggcccaggccccaccctaaaccctagtgacagggtgctctgccagtgcccagggcctctgtctaaccccaggttagggtggtctcccagtgaccaggtcctatgtccaacccaaggtgcaggtggtctcctgggagcaggtcctgaccccagaggtggtaggtcccatggtgccctggatctggacctaacctgagagccggtgtactgttaacctctgggaatgtgtcctcccaatcctagtgccagttggcctgggcccaggaccaaagccacaatctgagatcagtgcttttaagggacaaaccctgcccccaggtcaggtgtgtatccagtgcccaggcctatggaacccaacccaagaccaatgtggcctgggcccaggccctaatctagatgccatgagcattgtggcctcttgggcacaggatctggtcttaacttaagaatggctggacctcattgcctcgatcttgcccccattctaa

SEQ ID NO: 525335 - DNA, 107 bp, Homo sapiens
agacggatccccagatctgtcgacaggttgatcgccgtgccacccattcctctcgtccagtgatccctgcttctgagagcacaggggggcaactgtccacaactctc

SEQ ID NO: 525336 - DNA, 548 bp, Homo sapiens
  misc_feature (117)..(117): n is a, c, g, or t
atggaggccagatgcttaagtggccgcctgtgcagctgggaggacagggtcatgctatgattggtggaagctacccccaaatgactgctctagaaggaggcgaccgactgatctctncagcactggcactgggcaatgccatttcaatgcactaccaagtgatacctgcagttcctagctcttcttaggaaacaacatttgtggccttctcttaaatactttgcaatccagccttgccagtgttcgaggttttcgataatcacagcttctgctctctaagttccagactattacagatgtttgcgcagttcctgttatttcttttcacagagactaatggctgctagccacttggagagagagaggctagctcaggtttagaatcgtctttgtaacatttgcagatactccttattcctgtctgtgtcatagagataattatttttttctaaaatacaaaccggtgtgcctaagttaacttactatagaaaaaaaaataatctaaacatctcttaaacctgaaatgcttagagacatagataccatgt

SEQ ID NO: 525337 - DNA, 260 bp, Homo sapiens
tcaacagaaagaagtgcagtgggactctcatgcaacctcatccccaataggacaattaggcaggcttagatgtcactgaggaggggaccagaatcgctctgaggacagtaggaaaaacctaggcaggtgtaagagcagggagtggggtacccacgagctgagggccacaggatcgacatgattctatatgtgattgtcatgggtgcagggagcaggcggagacaccgtctaggcttcctgggggccgtcctgggcctcgg

SEQ ID NO: 525338 - DNA, 251 bp, Homo sapiens
  misc_feature (6)..(6): n is a, c, g, or t
  misc_feature (20)..(20): n is a, c, g, or t
  misc_feature (144)..(144): n is a, c, g, or t
  misc_feature (190)..(190): n is a, c, g, or t
  misc_feature (216)..(216): n is a, c, g, or t
  misc_feature (234)..(234): n is a, c, g, or t
ttaaantttagatcaagttncacattggaagtagctctatatcatatggcctacgagcccctctggtctggagctgaccccaggtaccctcatctcccacccaccactcagccttcagccctttgccactgcacgtgggctttntggtgctctccagatgccccacctcgttctgctacagactttgcanttgatgggagctggcttggtgctctncttcagacttgtaagttncattcaaatgcaagttt

SEQ ID NO: 525339 - DNA, 131 bp, Homo sapiens
aatgactaaccatgtgagaacatgccttgacaagtcgtcggaaggtgagacgatggagtaccatacgagccagcaattccactcctaggtgtatacccgagagaaatgaaaacatatgtcacacaagagac

SEQ ID NO: 525340 - DNA, 302 bp, Homo sapiens
gcgtcgacgcttcagcctggctgaaggggaaggtgaattcgagatcgcctgcgaattcgatgatctgccggcggcactggtgcttgacgaaaatgcgcaaacatccctggctcatgaattcctgctcaacgcgcagggctcattggaaatcgtcaagacgttcaaagccactaccggtaagctggatcgaacagccatccgttgcctgcatccaacaagcgacaagctatcgaagctcctgagtctgaagatcactgacttgaagaagctaggggagcaagagggtatatcagaccgggtgg

SEQ ID NO: 525341 - DNA, 1105 bp, Homo sapiens
  misc_feature (539)..(539): n is a, c, g, or t
  misc_feature (541)..(541): n is a, c, g, or t
  misc_feature (552)..(552): n is a, c, g, or t
  misc_feature (1105)..(1105): n is a, c, g, or t
gcttaaacaattatttgagctatttgaattatttcagattacacacataaagtgtgacttcattaatacttaatatcacactatttaaaatttacaaaattagtgggtcacagaggctcgtgcttgtgatcttagcactttggaggccaataggggaggattgcttgaagccaggagttcaacagctgcctgggcaacaaagcaagaccttgtctctacaacacaaaaataaattaatgcatggcggcactccagtagctggaattacaggcgcctgccaccacgcccggctaatttttgtatttttggtagagacagggtttatacatgtttgccaggctggtcttgaactcctgacctcaagtgatccgcccacctccaccttccaaagtgctaggattacaggcttttatcattatttctaattgacacataataattgtacatatttatgggaaactgtgatattttgatacatgtatacagtgtatgaggtttcaatttttaaaataaacatgcaataccttaaaacaaaacananacacacacaanacaacaaaactgcgacgcacaacatgacagaggggcgcgacacaagacgcgtaccaaatgcgcccgcgcccaaaagcggtaccagacccaagctccctggccaccgcggaaaacacgcgagacacccaaaaagggagcgcgaataaaatctcggaaaagccgagttaccgtagagcagcccccaccgacagacccaccacatccgccccacccacccccacccccccagccacgacgccaacaccaaacccacacacaacacagccaaaacaaacacacaacacagacacaacaccaacacatcagagcacaacacgaagaggaagacacaactgaagcgaaacaacaagccgcacgagcacgacgacgaacagccgacgccgagccagcaccgacagacggacacagaacgaacaccaagacggacaggacaacgaagaaagcaccaccgacgcgccgcccacaaggaaggcgcgacaacggagaaggccagagataaacgaagaacaaaagcacgaaggacgcaagagaaactagaggacgagatgacacn

SEQ ID NO: 525342 - DNA, 116 bp, Homo sapiens
aaaaataaattttaaaaaaggtggaaaagttacggcaacctcaggttcagcataaaaatttaggatgaaggaggagaagagagggaggcttgttctttgtcgatcatagggtatct

SEQ ID NO: 525343 - DNA, 259 bp, Homo sapiens
ctcacgtcaggttattcctttttataaggtttctgttgaaattttgattttacgaagacacttcattctgcaaggacgtaaaacacacgatacatctaatctgtttcactctctctacatctctgtttcatatcattataaatgagggggaattaacattgtatgcagaggtgtgggcaccatgattcaatgcgtatacattgaagtgattctacagcgtcattacccaggtattcctaataacattaacatggaacat

SEQ ID NO: 525344 - DNA, 980 bp, Homo sapiens
  misc_feature (441)..(441): n is a, c, g, or t
  misc_feature (829)..(829): n is a, c, g, or t
gcttgagtgcgctggaacggaggatggcgctggtggcgttggtgtgctggtgtgctcggcttggtggctggcggctgagctggtgcctggggtgctgtggtgctgatggtgcactggacgtgcgtgcctgggctgctccctgtgagcctggctgcgcacagctggccatgaacgccgatggctggagtgtgccctgtgtgtcctagtactgttgtagctgtaagctgcgcattgtccactgctgccgactcggcagtcttcgatggtgggggcgttcatgcgttcgtccgtgaggagcgcatgtgtgcggtgtccattcctttttgtcggttgacccatgcgtccaagtgtgaccgctgtggccccctgctgtccggctgcgccggacacgtgctagcccgggtcatcgagattcgctattgcgccctagtagacccctantccagccgtggtgatgacttagtgagccaagaagagattatacactctgtagaagttagcctttgcagggcttattcgaggatatacatcacgttgcatttgtcacctcgtaaaggaccattagcgagagagtagttactggaacagttccttgggtgatgcgataggcgaactccaagaccaacgaggattttcgttcacggacatatgcgaatttttcacgatagggacgcgcgagacaaagtgaatacaaagaacagaaggaggagacataacggaggttattgttaggtttgggaagacacccgatcaaagctcgggttcaatcccgcgtggagcttcctagatgacgaaggaaacggatccacaggaggaacaaccgggggtnggcattgccaagagatcttcccgtggcgggacccgcaagccatccaccgtcatacttaggtagttttgaccttgaaccacggggtaacagggaagtcctttcacaagcaatgtggaaaaacacaacttcttataattggcgcaactggtgg

SEQ ID NO: 525345 - DNA, 451 bp, Homo sapiens
tcatctagaggatccttttgcggtgcctttccccaaacaggccaggtctgggactgaaagaacagaagaggtgtgagagcagacgaggagggaagtgtgggaggcggggagggagagttgaggcaggtagactggtgtaggggtggatgaggcaggatggggatagggcgactggccaggatggaagagctggtacaggcagaggaggccaggaggagagggggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtgcaatggggtggcctcacacacagcgtcaccaaaggccagggacctgagctgatggggggtcccagaccccaactaag

SEQ ID NO: 525346 - DNA, 428 bp, Homo sapiens
cccggatatatatatatatatatacatatacaaatgaatttaggatattatttaattcccctgaacaaaacacataattctcccatatctttgcatggaataatatgcagccataaaaaaaagaatgagatcatgtcctttgcagcaacatggatggggctggaggccattatccttagcaaactaacaaagaaacagaaaaccaaataccacatcatctcatttatacgtgggagctgaatgataaagaacgcagggatccatagagggaacaacacacagcgaggccttttggagggtggagagtgggaggatggagagaatcaggaaaaataactaatgagtactggccttaatacctaggtgatgaaacaatcttgtacaacaagcccccatgatacaattatagctatgtaacaaacctgtac

SEQ ID NO: 525347 - DNA, 536 bp, Homo sapiens
gatgcagtggcgtcggtgggaagcgcaggtcgaaaagcgatgccgattgtggtttcctggggctgtggccacttcggtggacccagcgctgaggcaggcgtgcggtagagtgctccaagaaatgagaagcggggctgggtgaggttgctcaggagccgatgggtgctggaggttgaccagtatccgtggaagacgtgcggctacaggagcgcactgagcggtggcttgtgtgtcatgatggccccaaatgaaaaactcttcttcgtggacactgtgctccaagtgaaacaaggtgctgacaaagaagagaaccatagtccagaagaagtcactgcttctcaatgaaagcccttcgggttgagctcatcctcgagaacacatcaaagtccctggccccaatagacgtctcgcccatcaggtccccaagccaagaagctcaggcggatggagcagctatgggagaagctggccaagcagtggcgagctgccccgggaggtgcgcaggtgccaggggccgttctcctcaagcctttctg

SEQ ID NO: 525348 - DNA, 465 bp, Homo sapiens
tatcaggattaagcccctacgcactctagcctggtcaggcagcatcggcgagcctctaccccgattgggagcagcaatgggccccgcctcactggatctgaagtgcagcagataccctgactggatccggaggggtggaagtcagtggtggtgtctgcaacaacagcaatcagtcagtggtagatggcgagcgaaagctcagttcgaaccagaacaatcacggaccacatagtatgcagttgtaagatttaatataatgacccacagagctcccatacaacaggaggggacccaaagggggttgcctttgccggctcaaatgcctgggtttatatcccaatcattgtccctccccctgtgctctcaggcaatagatgattggctatttctttacctcctgtcttagcctaattagcatttcagtgagctctctttactacctgattggtcaggtgtgagctaagt

SEQ ID NO: 525349 - DNA, 901 bp, Homo sapiens
tgctccagtagctgaacgggcgctggctgtgcagcaccccccccccatctctaccttgctccatttttctatttgtccagctgccctgtcaagagacacatgaaagccgatccttcagccagtcaagaattaactgagcactggggtgaatgcttatctacattgctgagaatggcgtcaaggtccagtctgataccaagacgaggttaaattgggacagagctgcacagtgatcctgatgtctgttcccagctacgcagtcaagactgtgataacaggaggtcccagttgttaccatggcttctgccgagcccctgacagcgctgtctcgtggtacctatatgctatccacggctacttctgcgaggtgatgtttacagcggcctgggagtttgtggtgaattttaactggaagttcccgggggtcacgagcgtgtgggccctcttcatctatggcacctccatcctgatcgtggagcgtatgtaccttcgtctgcgtggccgctgtcctcttctggtgcgctgcgtcatctacactctctggacttacctgtgggaattcaccaccggctttatcctacgccagttcaacgcctgtccctgggactactcccagttcgacttgtgatttcatggggcctcattaccctggagtatgctgtgcccggtgtctgcgggggccctccatccatggagcaggttaatcatcgggaaaagcctccggctgggctttgaccagggacccaagcctggggagctggcagccaacagcctggcaagggccgttagacacgactgagtcagaaacataatgggacggcccagagtcccataagcacctgaacagagaagaaaaccatggtggcgtccctgggaagagcgtccccaaggttaacagaga

SEQ ID NO: 525350 - DNA, 335 bp, Homo sapiens
aaccggacacattgacccagaagggtgagcaggcctacaggtgctgggcaggactgtcttgcaaagagcacaaaatgtgcaggtccctctgggagtgttatagtgggtagctagtcagaaagagcaggcaggagagggctccccataccccacacaccaggagtgtcaggtgaccatcaggtgatggtctggcggttgttgactgtctttctaaagtaataattggtcacacccggcaacagggaaaagccggctcctaatagatagaaaacactcgaaactggtgagcagtagtttccctataagatctcaggagttgagccagtgggctcaga

SEQ ID NO: 525351 - DNA, 159 bp, Homo sapiens
cgggaagggccacgcaactgggtcccaggcattaaggccacgtgcagggccatggaggtatgcttgtcacgaggcgcttcagaagcgagcgaagcgacagagaagccttgcgtccaaggcccttttgtcctggtagcaattgaggtgtgcagagcactg

SEQ ID NO: 525352 - DNA, 1598 bp, Homo sapiens
  misc_feature (282)..(282): n is a, c, g, or t
  misc_feature (1597)..(1598): n is a, c, g, or t
gaacacgtaataccgtattattcgagccgtcatgatcctggagtcttaggtcgcagttctaagcctccttattcgagccgagtctgcgaccacgccgacgtggaaccattcctaggctaaccgatccaacagttatacgacgatctatcggatcaacagtccactgccttagtaaatgactcttcgttcatagtcattatccatcgataatcggcaagcattataggcagacgtgacctaggttaccccgtaataattcggctgtcacccacgattagtggncgcttctgacccgtgataatacacaccgtaattacattcatagacctactgtactcttcgcacttcttctacctagcctctctgtctcgtcattctcgtcgactacgtcgtgatgggctcgtgagtcaggagacagcaccggtttgaagcaagtactagtccccataccacttactacaccgcgtgaaccctatactcaccaagcacacttgagaatgccctacccgttagaaacctacaccatactatcctctactctaacatccttagtccagtgtatgatcctctcgttcatagtcgttcattgcgggtcccattccaatattgcgcgtcaactcaaacatattttaattcaacatactaaaataactcacctgattacaataaacccccaatgtacccaaaaacggcaacactatcctatacggtgcgtgcaattccgtgttccgctaaagttccaccagggcacgcttcaccttacctatgctacctaatttatccttccctaagcttaacttagatttggccagggccattacacctgactagggtaaccttaaactaggtatccgtacaaaacctacgaaacagcaaacttttcttatcgaacacaccgtttccgggacgaggaaccggcggaaccccgcaaggtaacgtgagttaaccccaaaagatgtcctaaatatcccggaactatcatacgggcgcaaaccccgtgcaaagggcgccactcacttccaaaaaatatccataaacacacgggggatatccggaacaagaaggacgtccccagaagataggtgagaccccaacaatacagcccgagggagaacaacaaggcgagcggcaaagtggaacaaccacaccgcgtggggagccaagaaggcacaacagaagacgacgacacgcaggggaacccacacagggaggaagccccaagaggagagacgacacccaccatataatagtacacccacctacgtattcaacagagactacaccagagcgaggtacaataacccgcagcgatgtgacaacacgcggcgagcaaaaccggaggggcacaacaagtgagagtaagtcaacacatacgcgcgaagaccaacacagagaatgcgagagtggccgtgccaccgacgagactaagactactggcaggagacggcagagatggtagactcatcagtcagcatactagaacaacagagataaggcgagtaatacagacagcaagataagaagtagacaacgtattacgacagaaaagatatcactgccactcactgacacatacattcaccactcacctagcaann

SEQ ID NO: 525353 - DNA, 719 bp, Homo sapiens
cgtcgagcctgatagttgagaaaacatcccagaaaagtggaccccagaagtcaccgcatttctgtcccaatgtgcccatcatcctggttgggaataggaaggatcttcggaatgatgagccacaaggcgggagctagccaggatgaagcaggagccggtgaacacctgtaagacggcagcagatgtggcaaccaggatgggcgcttttgggtacatggagtgcttcagcaaagaccaaagatggatgtgacgagaggtcttcgaaatgggctacgagagctgctctgcagagctagacgtgggaaagaaaaaatctgggtgccttgtcttgtgaaaaccttgctgcaagcacagcccttatgcggttaagttttgaacgtgctgtttattaaatctataggcggtacttgatttaccttgggccctttatacagtttatatcgtataagtttacctaagattacaaactcagaagtcaatcttgctaccaggtatttagaagccaagttatgaattattaaagcgaatgtaccacaccccggtgttggtgcccaaccagggtgtcccttttgaacaacatggttcttaaacaaggacgctcacttcctgagaggtcacaccgcacttgtaggacacaaaccacaggggcgggcactaaaaatttcacagacggggaaattttcccttttaaacgatatctaggcgatactattctaaga

SEQ ID NO: 525354 - DNA, 128 bp, Homo sapiens
tctagaggatccctctccctacggtatctaaccctactctaatcacataacctattcccccgagcaatctcaattacagtatatacaccaacaaacaaggttcaaccagtaactactactaatcaacg

SEQ ID NO: 525355 - DNA, 290 bp, Homo sapiens
tatacataagctggtcggctgaagttgacccgataactccaatagatatccctgcgatagtttctacacagtatacacaggacattgaccaaaatcaagcaggatcagagctatcgccacatttcgtggccatctgaaagccttgactgtgaaaaccctctcgcgcagggcccggcggatagggaacagcacgactggcacagtgagggtcaccgcgagcagcacggccaggcgcacacagaggatgagcgggtccttctggctgtacatgtgcagcatctccgctttgg

SEQ ID NO: 525356 - DNA, 869 bp, Homo sapiens
cttgaaccatcccactctgcttgggtacctaaatccccgaagggtccccacctccctcctttacacggattcactaatcagtggcttattaatccacccctttccaaggtaaaagtcattcctctgatatgcaagaacgccctttattcactcaaattgaataataataaaggggccttctttctctcccggcggacgaacccctctccttcaagccaagcgccctctcgcccccgagtcccactcccttgcggccgaaataagaaagccttctctttcagacgcttacattttattaaccgcactctctcgccactcgttcaccactggtcctacacaccaacttgcgcgagagattgttgctcccacaaacggtggtcaagttgaaacccactcgccctcaggattgagaccacgacacattcgactcgtattgctctccccccaaagcggccacatgcaacatttgtgcttctctcagaccgccatacattagaacctgcctttggtgcgcccctttttcagtctcgcacacgcccactcgatggctggccctcgcgctgcacaccacaacactccatatcttccaaacagatgtgtgttgttaccgcaccgatacgacacaaccaccacatgcctctcagagagtcacgccgcagtcttgatagtcgtttaaacaaggaccacgccttgtcaactaacacacagggggtggggaaaaagcaccccacgcgtttcatccccttggcaaagagatacgccctggtctctggacgacattgggtgcccgaggcaacacgtctctatcaacatagatctcaaggaggccccaccccccggacatcccttggcaaagcacacccgcaccc

SEQ ID NO: 525357 - DNA, 5416 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctacccctgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggggctgacctagacagagatgaactgaggtccttgttttgttttgttcataaaacaaaggtgctaattaatagtatttcagatacttgaagaatgttgatggtgctagaagaatttgagaagaaatactcctgtattgagttgtatcgtgtggggtattttttaaaaaatttgatttagcattcatattttccatcttattcccaattaaaagtatgcagattatttgcccaaagttgtccttttcttcagattcagcatttgttttttgccagtttcattttcatttttttccatggttccccaaaagctttgttttttgggcaagcagaaaaattaaattgtccctattttgtaaatgtgagatgtttaaataaattgtgaaaaaaatgaaataaagcatgtttggttttccaaaagaacatat

SEQ ID NO: 525358 - DNA, 249 bp, Homo sapiens
tcctgccgttcatattgtatagtggatattataaacgatggggatttttttgatttctattgctgctaaccatggaaacttaacctagctttgttcatcaactctgtattgtgcatgaaacaggatctgttgcgaggcataatcttaagtggccacacacaatgtttccatctgatgccatctggccgtaactgtaacttgacttacattatcgcattctgcttatctaaaattgttaagctaaacttt

SEQ ID NO: 525359 - DNA, 1949 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcataaaagaaatacatggtcgagcacggtggctcatgtctgtagtcccagca

SEQ ID NO: 525360 - DNA, 128 bp, Homo sapiens
gaaataaagcatgtttggtttttttcacaatttatttaaacatctcacatatacaaaataggtacaatgtttaaataaattgtgaaaaaaatgaaataaagcatgtttggttttccaaaagaacatat

SEQ ID NO: 525361 - DNA, 124 bp, Homo sapiens
cacgcagtctcaaggactttcaaagaatagtgcaccttcacttagtcaccaaataaatttcatcataaaacataagattctccttgcaacagcggagaaatgcctaggagggaggcgaccgata

SEQ ID NO: 525362 - DNA, 971 bp, Homo sapiens
gcttcgctctgaggtgctgtctcaccggtgagacccggaagcgggcgagtctcgtgctgtgtcggacctgcattaatgaatcggcaagcacatggagtacctcatcggtatccaaggccccgatatgtcttgtcgcctccgacggtgcgcagaatatgtccaatgaaggacgatcatgaaagatgtaaatgatgaaacgatattactcctgtgtgtggagaggctggagacactgtacagtttgcagaatactattcagcaaaaacgtgcactttataagatgcgaaatggatatgacttgtctcccacggcaacagctaacttcacacgccgaaacctggctgactgtcttcggagtcggaccccatatcatgtgaacctcctcctggcctggctatgatgagcatgaagggccaggcgcttgtattacatggactacctggcagccttggccacaggccccttattgcagccaacgagtatggtgccttcctgacctctcagtatcctcgaaccgatactacacaacgagctatctcacgtgaaagggcagtgaagactccttaggacaattgtcttgaaggagctccagaaaaccgcttcatccatgaaatctgccaaccttcagtgtgcgaatcatcgacacaactgggccaccatggaacctgcataacatttttcttttcccaaaacaaggggtcctaaccatcaatgttctccatccaataggccagggaactttttatgatgcccccataaatttaattactcttataatgccgaactttgataatggtaatccaaaaccgtgcttggtatattcgacatcaaaacgaacagacacccggtgcgacgaaccaagaaagccacatcagtcaaaaaatataaagtgcacagccaaggcgaatgcacgtaccaagaaaaaaaaaatataaaaagcagcaatcagctacaccccctcctgtccccat

SEQ ID NO: 525363 - DNA, 5476 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctacccctgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttaaacttccctctgtggaagatattcaaaagccacaagtggtgcaaatgtttatggtttttgaatatcttccacagagggaagtttaaaacccaaacttccaaaggtttaaactacctcaaaacactttcccatgagtgtgatccacattgttaggggctgacctagacagagatgaactgaggtccttgttttgttttgttcataaaacaaaggtgctaattaatagtatttcagatacttgaagaatgttgatggtgctagaagaatttgagaagaaatactcctgtattgagttgtatcgtgtggggtattttttaaaaaatttgatttagcattcatattttccatcttattcccaattaaaagtatgcagattatttgcccaaagttgtccttttcttcagattcagcatttgttttttgccagtttcattttcatttttttccatggttccccaaaagctttgttttttgggcaagcagaaaaattaaattgtccctattttgtaaatgtgagatgtttaaataaattgtgaaaaaaatgaaataaagcatgtttggttttccaaaagaacatat

SEQ ID NO: 525364 - DNA, 1266 bp, Homo sapiens
  misc_feature (997)..(997): n is a, c, g, or t
ggacgcgtgggcttcaggcagatgtcatccacctccaggatggtcagcatggctgcaaggagaaggatgccagcacccatcactcccccagattcccagacctttcccctgttggtcacagacgccttctgtcatttttccggtctactgtccccagtgtagagggctttgctgtccctgagactgaggcaggttccttttccatggtcagaggtggaggtagatctttcgtctcaaacacatcatgaccatccaacaacacagcctccgtccgcagggaaggagcaaagctgctctgtaactcatctctgagctatcgtccccacattcatcactgaccatgaccgaccagcagcatccattcccaccatcatcacatgacaaaggataatgtgcacagaacaagtatgtttatgtatcataacatgtatgggcacacaccaacatgcagcaagcaagcaaaggtcagcaagggttccacagcattcaaatgcagcctgcacttcagtgcaccagctgtgtgcagccatttgccacatggtcaagggcctcacagcattccgttggcagacgccagccccaggtattccaagcaaaataagactggttcgacaaatagatagtgtagaggggagtgatgagcacacatgaccagcgatacatacgtagattgctagccgataattggaaagagcaatggaccctggttgtactaacttagagggtatagggagacaaccaaacttgattgagggcaactacagactgagtgacaaagtatacaccgttcagcacgcacgtcgcacacgcatggacacccgaccaatgacgtaagcgaccgaccagacatacgagacacggacgcgggcccaggacaaccatcctgggggaccattacccgccacaaggcgcatcacagacaagggcaaccagacacatgctggcggcacccaacaacacccgtatcagggaacacaaagataattagccacacacnacagcaccactggaaaacacaaaaacagcgaaattccatggtcacatcgaacacacacagtaccgcaacaaacggagacccccaccatgagagtagaacagacggcaacaccagtacaacacaccaaacatgcgacgaacatagcacgagcgccaccagcacgaagaaacaacaccacacgatgcgaacaaacaaggacaacaaccaaaggagacaagagcaagcaacaagagcaagacaaccaaacgcggacatcgaacacagcacac

SEQ ID NO: 525365 - DNA, 146 bp, Homo sapiens
tgatgctcctaggtgcaatgttgctaaatggaaaggtcatcatctggagttctcacgtcctctagaatgatgttatacacacaggaaagtaagctcagaagacacagctgctggaaaaacagcatgaggatgacatcacgggatac

SEQ ID NO: 525366 - DNA, 5456 bp, Homo sapiens
  misc_feature (5224)..(5224): n is a, c, g, or t
  misc_feature (5272)..(5272): n is a, c, g, or t
  misc_feature (5274)..(5274): n is a, c, g, or t
  misc_feature (5277)..(5279): n is a, c, g, or t
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctacccctgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggggctgacctagacagagatgaactgaggtccttgttttgttttgttcataaaacaaaggtgctaattaatagtatttcagatacttgaagaatgttgatggtgctagaagaatttgagaagaaatactcctgtattgagttgtatcgtgtggggtattttttaaaaaatttgatttagcattcatattttccatcttattcccaattaaaagtatgcagacaaaaatctgcanacttttaattgggaataagatggaaaatatgcagattatttgcccaantnttnnnagattcagcatttgttttttgccagtttcattttcatttttttccatggttccccaaaagctttgttttttgggcaagcagaaaaattaaattgtccctattttgtaaatgtgagatgtttaaataaattgtgaaaaaaatgaaataaagcatgtttggttttccaaaagaacatat

SEQ ID NO: 525367 - DNA, 472 bp, Homo sapiens
  misc_feature (5)..(5): n is a, c, g, or t
  misc_feature (26)..(26): n is a, c, g, or t
  misc_feature (32)..(32): n is a, c, g, or t
  misc_feature (44)..(44): n is a, c, g, or t
  misc_feature (59)..(59): n is a, c, g, or t
  misc_feature (165)..(165): n is a, c, g, or t
  misc_feature (420)..(421): n is a, c, g, or t
gcccnggaaggaaaattagtgtagtnaaatcnaagaagcgtttnactggactaatatgnaagagcctgtgatggatcattaaagacaagcatcaagcatttaaaaactgctgctccctatagggatcaaagcttaagtaaaacaaataaatataaggcaaaaatnaagttagcctactttttttgttttatttttggagacacggtcttgctctgtcacctaggctggagtgcagtagcatgaacacggctcactgcagcctcaatctccccaggctcaagtgatcctcccaactcagcctcccaaatagctgagaccacatgtgcacaccaccacacccagctattttttgtatttttagtagagatgaggtttcaccatgttggccaggatggtctcaaactcctgatctcaggtganncgcccacctcggcctcccaaagtgttgggagtacagcgtgagccaccgcgc

SEQ ID NO: 525368 - DNA, 224 bp, Homo sapiens
gctcctactcctcattgtacccattctaatcgcaatggcattctaatgctaccgacggaaaattctagggctatatacaactacgcaaagggccccaacgtgttagggcccctacgggccaatacaacccttcggttgaaggcataaaactttttcaccaaaggggcccttaaaaccggcaaaattacctttaacccttacataacggcccgactttgggtcta

SEQ ID NO: 525369 - DNA, 387 bp, Homo sapiens
tttgttttttttaattacaatataaggggctttacccacctactagtaaacattcaaaaacttgcattttaaaaatgctacgtgctgactgggcacagtggctcacacctgtaatcccagcactttgggagaccaaagcaggcgaattgcctgggcccaggagttcaaagccagcctgggcaacttagggagaccccgtctctataaaaatatacaaaaattagcctggtgtggtggtgcacacctgtagtcccagcttcttgggaggctgaggtgggacgactgcttgagcccaggagttcaaggctgcaggaaaccacgattgtgccactacatgacactgaactccagcctgggtaacagagcaagaccccatctcaaaaaaaa

SEQ ID NO: 525370 - DNA, 319 bp, Homo sapiens
  misc_feature (65)..(65): n is a, c, g, or t
  misc_feature (73)..(73): n is a, c, g, or t
tcagctgctcctgggcctcagctctgcccagggccagccaggttctgctgggaagggaaggtagngggtattnggtatatgcaagcagtgtctgagcctcaggtagtttttcctccctctttgcctatcccctcccctctgcttgagccttggagccttgactgggagcttaaaggagtttcagcttttggcctgagacctccttctgcccttcttggggaggtggggaccagcagataaatcccacccttccttgacgtgtcgctgtactctgaagttcagccagctcagattttataaataataatttaaatccccc

SEQ ID NO: 525371 - DNA, 335 bp, Homo sapiens
tcaattttttttgttgttctgtttcccaacctctatgtcagataaagaatcacccaggccagacacaatggctcatgcttgtaatcccaacactttgggaagccaaggtgggagaattgcttgaggccaggaatctgagcccagcctgggcgacaaggcaatacccctatctctacaaaaaataaaagatagccaggtgtagcgacacacacctgtggtcccagctgctcgggaggctgagcaggaggatggcttgggcccaggagttcaacgctgcagtgagctgtgattgcaccactgcactccagcctgggcaacagagtaagaactgtctc

SEQ ID NO: 525372 - DNA, 236 bp, Homo sapiens
tgttttgtattttgttgttttaattaataggctttatttgtaagaccagttttatgtttccagaaaaattaggcccaaagggattcccatatccctccttttttttgcatatttccccctctaattagcatgttgcattagcagggccctttgttacaactgatgaacttgtattcattattagctccagtgttcatagtttatattaaagttccctctttgtgttgtgcttccta

SEQ ID NO: 525373 - DNA, 173 bp, Homo sapiens
ggtcatctagaggatcccaacacgcatctatagtgtatagttacatacacaagggtctcactatgccactaggctggagttcatgatacatcacagctcaatgcagctcaaactcctgggctcaggctttcttgcaactcaactctaaagtagctggggactacaggtgagca

SEQ ID NO: 525374 - DNA, 795 bp, Homo sapiens
ggaccaagaacccaccaattccggacacactgggattacaggcgtgagccaccgcacccggcttttttttcgggggggggtggggaccggacgtcttgcctctactcgcccaggcctggcacctgcccgctggcgccccactctggcgcttccccctgccacatcctcctgccctcccgcgcagttcccacccagcactgcctccctgcccctcgcgccctccgcgcaactacccctcgggcacctactacgcgctactactgcccaccccccccccctggcgcctcggcactctccccgcctgctcccccccgcctcgcacgcaccccgcgcgcttctccaccccacctgcctctcggccccaccgactctaggcgtcctcacgcaacaccctcccagtgaaaacccctccagccaggcctcccacgaaaccaatcacctacacggcaccacctacacccacaaacacgcctgccacccgcgacaaactcaacacccgagccacctcgaagcgactaaaccaaccgccgccacccccacggcgcccaccacaccgcacaaacaacatacaacgaggttcagagaacaccaaacaaccccccccaggacaccgaacactcacatggcagaccaatgagggaggcggcaaccgcccgtcaaccgcgcacacacgcaccaagccccccccctgaccgcccccaccacaagccgcaacccgcggcccacagcacgaatggacaacacaccaagaccgtcgcacaaacctccgccccacaacacgggacccgcgccaga

SEQ ID NO: 525375 - DNA, 655 bp, Homo sapiens
aagcactggtatcaacgcagagttgccattacggccgggctgggagtcggaggggtgtcttctccctcgcccccttctccatgtcccaggaatcccagggcgtcaggcacaggccggtccccccggaccccaaggttattgcgggggaaacacattagagttgcaagcaaaggaaacagccacatttgacaggacagtccccaagtcacccggcacaaaacggaaaaaaaaaacgattaaggaacgcgcagaaaaacacatacaggcgacagggcacaacggacaccaagaacacacacggcgacgagagaccaagcataacaacagaaacacagagaacagagacaaagagaaagacagacacagaacagggcctgatgaccgaaaccaacgagaagagacacaccactcgagagaaaagaaacgagaagtcatgacgcagaagaaacaacagatggagagaaaaggggcagcggaagacgcggggaccacacacacggatcagaggcagagcacgggtagcacacacgaccgcaaggcaaccacgagcgcgggggacagaacgaagaagacaaagacaacacgtaggaggcccaaggacaacagaaaagggagacgaagagagaacgagacaccaacacataaaaacacaacc

SEQ ID NO: 525376 - DNA, 201 bp, Homo sapiens
tatctctaacattatggaaataacagtatctgcacatatagggtacaaattcctgcgaaattacctgaccccagttcatctctgctgaacatttggaaaccatgcacgtagcgaacccaacatgacttctagctagtgtagaaggcatttggtctatacgagatgagacgagatgcgcgggcagagtagtgatgagagcag

SEQ ID NO: 525377 - DNA, 210 bp, Homo sapiens
ccccccccccccccccgcccagcatcctacttgggttgggggggtaagagggcctgggggccttttttgtgggcccccccccctgtaagtttttttaaaaacatcgccgaaacatttaaatggggggacgttttgaaaaggtacagcttcccgcagccaaaagcaactgttgttttggcaaaacggtcctgatggtccaggttggtttga

SEQ ID NO: 525378 - DNA, 1065 bp, Homo sapiens
gagctacccaaaaagtggccttactacagtcagataatacagagtggctcacagctcctgatgctgaaatgctgtacatgcaggaggtagagagaatggatggctactggcgaagagagctaccctgctaaggatagccaaggaagtgacatatccattaggagcgtgtcttgaaggtatctttggtgaacacacaaggaatggcaaggcatcctgtggtatttaggtggcatgacattgcacaacatgtcccacaaacaagatcctttgatgcattagagctggcaagatacaagacggacgaccagttcaactttcaagactgagagacagtggaaacagcaaaatagcatttggagactctggtgttagcgcgagacaagttttacaggaactaacaccaggtggtaaactggcaaacgtcagactggtcacaggggaacccgaatcaggagagcaaggtccttccgtccaggtgatgtgtttctctggcgtgtaagcccccaggcctatgcggtaagtgctatccgccacaacgcgggaaagaagggcatcatactaaagtggggcacaagtatatcaacggagacaaacaaatagtcagaatctattgtcccacgagaataaaaacaacctctaggatgggaggacaaaaacaagaagacagaggggtacaacaaaaggtggaccacatcgatgcaagaagactctgtgggatagtaaggcagccacccaaatgaggtaggacatccatacgaagggcaggacaggaccctgcccgactaggagaatgagaaagatcggaaaataagcaaggtatgacaaaagagcaggccaaaagaagacggacacaaaaaacaaagtacacttccacagaaggctacccttagccatagggccagaacggcacggaaagggaacgagaagcaaagacgagataaaggaagtacaacacgcgacaagagagtcaaacgcaacgatgcaatgtggcacgggcaaaaaacagaacacccctgacgcggcaacagaagcaacagcagccaccacgggcgaagaaggacaaac

SEQ ID NO: 525379 - DNA, 309 bp, Homo sapiens
aagcatgtgtctcacctcctctgtgatatctttctttgcaccgcagacatcagtctccaacatgtttctgttgggttagtttgattcagcaaaaatctcccagtgacaacatcgcaatagttttttacttctcttaggtggctctgggaatgggagaggggtaggatgtacagggagtagtttgtttatagaaccagccgtattttacatagaagctgtataattaattgtcattatttttgttagcaaagattaaatgtgtcattggaagccatccctttttttacatttcatacgcccaggttagca

SEQ ID NO: 525380 - DNA, 355 bp, Homo sapiens
tacctggcccgcccttacgctatttcactgcactagaatcatcatatcaatacagtgtacacacttcatcactaatgttgatggtaaaggtggaaagaatggccgagtgtggtggctcatgcctgtaaccccaacacagtgggaggccaaggcaggtggatcacttgaggtcaggagtttgagatcagcctggccaacatgacgaaaccttgtctccactaaagaatacaaaattagccaggtgtggtggcacatgcctgtagcctcagcttctcgggtgggtgaagtgggaggatcaactgagcctgggaggttgaggctacagtgagctgcaaccatgccactgcacttctag

SEQ ID NO: 525381 - DNA, 186 bp, Homo sapiens
cacggcgaaaatcacgtcgctcaattccaccagaatcagtaccagcatcagcggtgtggcgtacagcaatccattcttacgcacaaagaaatgctcgttgtcgatggtgtcggtcatgcgcaaatgaccgcgtaccagcgcaccagcgcttgtcgccaatgcctgattcatcttcatgggcgagcg

SEQ ID NO: 525382 - DNA, 477 bp, Homo sapiens
ccatgattgtgaggctttcccagccacgtagaactgtaagtccaataaatctcttacttttgtaaattacccagtctcaggtatgtctttatcagcagtgtaaaagtggactaatacagtaactttataatgatctgtttcatacactgctaaatttcctaatgcagataacactgccttgcatataacaggtgttcaataaataattgtttaaaaatgacttgtttggcacaagttttaaataactgaaacatgtagaagtaggtagatgtcttgtctaactgatggtaattaatttccatctcagcccaatttagtccccaattatcacatcttatatacccagttaggaaattagttcaacctgaaccacccttgtggtttctttggaactcaaagctagcggtattcaccccatttgcctctgtctcttcaaagacttcaaagctctgagtttttcctgttgacagtttcaaa

SEQ ID NO: 525383 - DNA, 306 bp, Homo sapiens
ctctcgaggatccctatcataagtaagaaaataagggaattataatggaaagatgttttaagacagattggacaattacagagttatacttaggccaagcacagtgactcactgcctgtcatcccagcacttcgagaggctgaagcaggcagatcacttgaggtcaggagtttgagaacagcctggccaacatggcaaaaacccatctctactaaaaatacaaaaattagccaggggtggtggcgcacacctgtagtcccagctacttgggaggccgaggcaggagaatcacttgaacccaggagg

SEQ ID NO: 525384 - DNA, 1292 bp, Homo sapiens
cggggagagtgtggtgggggcgcttttgtgtgtgttctgaagccagtggtgtgtgacggtgtgtcgtcggcggcaggtgttgtgtgggggcgcgccgctgccgcaaggggtgtttctcgtgttcgtagagagtgcgctttgagctcgttccctactggtggtccgcgtatttgcctagattgcgtggccatcagtgtgtatgggtgcgagcgagttgtggtgcgtccttgcgtggtctatcgtgccgccgtgggtgtgggttgtcccctgctgtagtcttgctgccttttatagggtaggggccactagtgcgaaggcggcgtcgtaccccaggcggtgggggcgccaccgggggagggagttagataggacgcagcgttgatgggggggggggtagcgacgcggacgtagggaaaggagagaggcgagcgggggcgaaaagataggggggggcgcgggagagggaggattctttgggggggagccagcaaacagaagggggagatggagcgccgtcgagggggagggaggtgggcgacacgagggcgcccgagaagggggaccgatctaataggcggtggctcgccagcctggcgcgcaaccggagagaggagagagagataggggcgggagagaccgcccggctaagtgtgctagcgagcgtgcgcactctggcgagttgagagagacaaccgcgcgaccgatcgtcgagggggagcactctcacgggagggcgctttcctggattttgctgggcgcacgctcgctcctcgaggagtgtcgcctcggaggtctgtgtcttctcgcacgcgggtccagggcacacttctcttgttctgtctattcgcggggagggttgtctcctcgcggggagacgatgcccggcggggagaaacttcacataccgcacggacgcgtgcacacagcacgcctcacacatggggggaggccgctccgacggagactaataatgatggtgacgccgcgggagtcatgcatgttgttgaggtcaccacgccagccacgcgaagatgggagatacccacgcgcagctgtgagagaggggccctcgatggagcaacccacctcccctcggcagtcttcgtttcgtgccccgatgggagtgatgacacgttggcagactgagagaagcagcaagttatctttcctcacccacggttctattggggtgggtggccgcacggcgctgaagtatgtgctatacacacacacacacacacacacacacacacacacacacgatgcatttaataaagatgagttggttttca

SEQ ID NO: 525385 - DNA, 125 bp, Homo sapiens
ttttttggggtaaaacccccctttagaagccctttaaaaaatttgtttttttgccagggaccccccccttttgccttagaaaaaatgattaaaaggaaattaaataaatgttgccttttttttca

SEQ ID NO: 525386 - DNA, 854 bp, Homo sapiens
  misc_feature (104)..(104): n is a, c, g, or t
  misc_feature (563)..(563): n is a, c, g, or t
ggatgcataattaataatgggagctgcaaaggcagatcgtgacaagagatggaccggtcagaagaaacaatggaacggacaacggttgttgaccctcctgtacntgagagacattaagaagactgcagtggtgtcggtgccagcctattcctgctgctttcatgggacagtatcagcatgtgtgagcgtaacagcctacatgtgccttggccctgcttctctgtgaaccatcagcttaaggatataccaaggggtggtgatccaaagctattccaagaaatcagatgaaggcacccatttcagggcatatctggaatctgaagtggctaatatctgaggagtgggtccagacaggtaccaggaattctggctctgtggccatgtgaactgcccgataaacggaactcaggcgcctcttcttagtcgacagattagtgatcctctgcacgtttgccgggtgcactcgtggggtatttacctatgtttggtgccttgtttaaatgggtctgacccctactgatttggggtctccatttcacctctttcaggggtcccgttcaatntaatgaaacggggatcagtgcccacgatagagccattatcccaaggacttggcggacatcacgaactagtgcacacgaggcaatgggtaacaatccaaggccaaaaatccctgggattggagcccgcaaggctgcagtgagaaacgcgccaaaaaatttggaagcgggtcaccttacagcggacacccacgagacaaccggggcgggcacgcacacaagaactgaggtcgagcacgctccacaaccgcggtgaccctactccagacagccggggggggcaaaaccggcccg

SEQ ID NO: 525387 - DNA, 981 bp, Homo sapiens
  misc_feature (716)..(716): n is a, c, g, or t
cggacgtcaaagtatctagctgactcgccaaactccacggaagcacatatgaaatgatctggtgcaggtgctctgagaccctgaggattacatcttttctttatcagcgtggggtggacttgactggcattgtataagactaatctcatcactgaagacatcgtcatatacactgaccagcgtactagagtttgatagtctcaaattccatctagtgtccgtagacgaataggagctgaatctctggcatcataggaaggctatccatacacatgagtttcccctattctcaggctaacatcccatagacacaaagcgtacagccaaaaatacagtttcaacgtatcatattcatcggcgtagatctaacttgcttcgccacaacactttctcggctatccggaatgccccgacgttactcggactaccccgatggatacaccacatgaaacatcctatcatctgtaggctcattcatttctctaacagcagtgatattaataattttcatgatttgagaagccttcgcttcgaagcgaaaagtcctaatagtagaagaaccctccataaacctggagtgactatatggatgccccccacggtacaacattcgaagaagccgtatacataaacatctagaacaagcacaggagggaatccgaaagcccccaagaagctgggtttcaacgccaaacctcaggtgcggccaggacctncaaagaaactagaaaaaaaaaaaagacccgcgagggcttcaacacgggggggggcaaaacgcgggcaccgacggggtccaggtcactggttggtcccggacgcacggttcgggcgcaaggggtcacgcggcgggcccccaaagggggcgataaatccgaaaagtccggtatccgagcagcgggacacaattacacacacatcgacggcacaggaagaagcaggaggcaggacgcaaaggcacaatgcaacaaacgacaccgcgag

SEQ ID NO: 525388 - DNA, 707 bp, Homo sapiens
gaagaaggacctgggctttgggaggtcaaagcgggaggatcacttgagcccaggaatttgagaccagtctggacaacatagtgagaccctgcctctacaaaaaaattaaaaattagccagatgggctgggtgcggtggctcatgcctgtaatcccaacactttgggaggccgaggctggtggatcatggtgaaaccatgtctctacaaaaagcacaaaagttagctgggcatggtggcacatccctgtaatcttagctactcaggagactgaggcaggagaatcgcttgaacctgggaggcagaggtggcagtcagctgagatcacacccctgcattccagcctgggtgacagagtgagactccatcccaaaaaaaaaaaaaaaaaaaaaaaaaaaaatttttgggcggcttgggccctggaaaaacctttttataacccattgtgttgtgggacccgggggccccagtagaggtatacgggtaaccgtgggccaactagctgtctccccttagggaaacccggggccacagtaacaagagggcggtgggaattctttcccagattatataaaaagcccccgcgggggcaccgcgaagcggttctgtgacaaaattccccaaatcggatcacaggaggggacactcaccgggggactcctatcacacgaggggagctccaaggagagacctcgatatcaaattaccc

SEQ ID NO: 525389 - DNA, 87 bp, Homo sapiens
gtcctcttgtgttgaaactggaagtagtggttttttttgtagatgctttttatcaagtagaggaaggtcccttctgtcgtcttcctc

SEQ ID NO: 525390 - DNA, 1078 bp, Homo sapiens
gaaagtgcccaggctacagagacaccctgtaagccacagaaagacaaaggaaccggttgaaacactacttaacgttgtcctagtgaggacttagcagaatttctgtagatccagactacaatggtcctgcttcaaaggaatcgcgtcaaaggaatcaaaggaattgcagcgggctggtccttgcttctgcctatttcttcgggattccatgggaggctggagcccggccgagatcatcctactcaagttcctgaggaattagagaaaggctctttcgtgggcaacatctccaaggacgttgggtctggcgccccgggagctggcggagcagcggagtccgcatagtctccagaggtaggacgcagcttttctctctgaacccgcgcaaatggcagcttggtcaccgcgggcaggatagaccgggaggagctctgcgctcagagcgcgcggtgcgtggagagtctaatatccttgtggaagacaggatgaaacttattgggatagaacatagaagtacgtgatatcagagtgaaaatggtcgcaaaattccaagcatgaaagatctagacgtaaacattaatgaaaatgtcgctgcgggaaatgcgtattcctctcccggaagctattgatccggatgtgggcgtgaactccctgcagagctatcagctcagcccaataagcacttctcctaagagttcagagccgtgccaatggcgtcaagtactcggagctggtactggaagcactcccttaaatcgagaggaagaggccattcaaccaccgtggtcctcaaccggcttccgacggggtgaacccttacgatcttggcactgtccttgtcacgtgtcgaactggcttacggatggcaaattgaacaacgcgcgggtcttcacctttggcagaaataccgcgagtgaatggtcctatgaaaatttgctctgggtgcacccagtttgttgacaagtaaacagcccacgacagggcacaaaggtccccatgtagcaactggacgattaccttccggaaatatccttagaggcaatgtgtgaaatcccagtaacacatattatgggcacta

SEQ ID NO: 525391 - DNA, 688 bp, Homo sapiens
atattagaacaatgtctctcaaatttctcttccatgagcttcctgcctgaccctagagctccctcacctctttggcttaccagctcgccatccttcaaagtttctgagttattctgtggggaattgagctactctcttcctttaggatccaggccatctcagctaggtccagagagcctcactcacctcccgcaactaagcagagcatccctggaggtatgattcgttcagtgcgaagggcgagttcctgagagaattgattgggattagctcataagagggattatactgtctttcccctgcatcatgagcagagagtagactgaagtctactgactttaactgagaattctctgtgaagagtctgggagggacggttgagggtaagtccatctacaagggtgctcagagaggttcggagcgaaggcgattggtgtcgttatgatggcatatctatggcaacagtgagtgtacagtgcaccaggcactactgtttaaagacgttctcaagtgttcattcatgttaatctcttagccagcaatacctgtgagggacttccgtgtgataatctccgaggtacttggtgaggacgctgaagcagagaagtaactaatgtgcccaaggcctttctccttgaggataggcgccttggttcaggaatgccaagtcaatcctctgcgtcaacca

SEQ ID NO: 525392 - DNA, 460 bp, Homo sapiens
gcacgagggaggctggagcaggagaatcgcttgaacccgggaggcagagactgcagtaagccgagacgcgccactgcactccagcctgggtgacagagcgagactccatttaaaaaaaaaaaaaaaaggaaaaggtacaaagttttgtatacacgtttaaaggaggtaggccaggcacggtggctccgcctgtaatcctagcactttgagaggccgaggcaggcggattgcttgagctcgggagttcaggaccagcctgggcaacatggcaaaaccccatctctacaaaaaaatacagaaaattagccaggcgtggtggcgagctcctgtagtgccacctgcttgggggtctgaagtgggaggatcacttgagcttgggaggttgaggctacagtgagccaagattgcgtcactgtgcatcagcctgagtgacagaggaagagtctgtctccaaaaaaaa

SEQ ID NO: 525393 - DNA, 127 bp, Homo sapiens
tgcttgccctggtgaacgtggcgccactcgaccgtgggggcgctccctgacatcgttgtcgcggtgccgccgttgccccctctggggggctcctctcgacgtcgcgctgacggcctgaacgcttggc

SEQ ID NO: 525394 - DNA, 303 bp, Homo sapiens
tacataatactcgataacaatcatgccagggaggtatgatcatactcattcctaattaatattctattttagagacagagtttcactcttgttgcccaggctggagtgcaacggcgtgatctcagctcaccacaacctctgcctctcgagttcaagcaattctcctgcctcagcctcccaagtagctgggattacaggcgtctgccaccacgcccggctaattattataatttttagtagagacagagtttcaacatgttggtcaggctggtctcaaactcctgacctcagatgatccacccg

SEQ ID NO: 525395 - DNA, 388 bp, Homo sapiens
ccttccccccctctctttctttttaagggcccgcggaggaaaccccggcccccttttgttttttaaaacccccttttttttggccccccctttttggggggcccccccccccccctttttttttttttggggggggggttttttccccggggggaattttttcccaggggggccaaagaacccggggtttttgaaagccccctttttttttaaccagggggccccccccctttggggggggggggcctcttttttcccccccccctttttttgggggggaaaattttgggccccctttttttttgggggggttttttttttgggccccctcccccccgggcccggggttttgttttttcccccccctgggaaaaaaaggggggtttta

SEQ ID NO: 525396 - DNA, 914 bp, Homo sapiens
gggaaagggagccagagctgtatacctgggacaggccaggcagcctttagatgccagcagggcctgtgtcctgtggatgtgatgctagtgagtgaatgggagggcgggcctggagctgcgtgagagtgaaaccaagaagcggatggggaagggagagctggccttggtcaggctatagggatgaataggagaacggaatcattcgtgggcctcggctaggtcccagactgattacatgagactgggtgagtccttccctgtccagttctctcatttattacaggctatcccgcacaagactcgtaccccgtgtgccctggactactagcactcgcgcgtttgggcctctagcactttgggcgctggtcagcagtaccccatacctagaagtgctctctctggcagctgggagaggcggaacgaggtgctgagttcgctttccatgacatgcttatgtatacagtaaaggggtcaggtgcttgggctccagagagaccctaggttactgccttactaactactgcatccttcagtaaggggaccagggactgggaagtagagggaaaccatatgggcccaggggaatgggagccttggaggactgctgatagctctgttccggctcatccaagtgtcggaggtagaacgcctggactcaggacccagggccgataggcgttgcgcgaagtgggcaggggcaaagggggcacctcggtcgagctcagagtcattttggacttgccgccccgatctacgccaaccaagctgttaagtgtaacgagagactctccggtgtgccccttgcctcaattcacggaaggccatagccgggcaggcttcgctatgggatattctacgatgggcgttcatgagtaggaactatctgcagattagtccctattgatgagtttcac

SEQ ID NO: 525397 - DNA, 190 bp, Homo sapiens
cccgcttcagcattagatacagttaccctgcatcatgttaaataaaaattgtacatttgcttctgagatctaatttttttctacttctgtctctttattgcatcaactagtttccactatattgaacaaggatagaatatttcctcgtggtttctcagggtggtatccaatgattcgtcattcatgattt

SEQ ID NO: 525398 - DNA, 121 bp, Homo sapiens
cagctcggtccattgtagaatgtgctcagtgactttttaaactgctaaaaatttatgatcaaagaatactgaatcaaaacatcaaagatagaaaatagaggctcagcagcacatcttccaa

SEQ ID NO: 525399 - DNA, 258 bp, Homo sapiens
ttcccctagctggtataagcacaggtatctaggtccatctacatagcctacaggcagtgggtggtgcatagtccatgctaccctattctgggttacctgtggtagctctagaagttgcagcgactagcgatattagaagcctagatttagatacaccagtgtttactgtacatgtaactagtaggatagagttatagctacctagacatagtagacacattacaaccctgatggaccctgatagttttatcacaccaa

SEQ ID NO: 525400 - DNA, 1112 bp, Homo sapiens
tttttttttttaatggggcttgggtgagggaggtaggtggtagtttgtgttataatattttaagttggagtgatgaggaaatagtgataaggagtatgggggtaacttatggtgggccatacggatagtattttagttggggcattccggataggccgagaaaagtgttgtggagaacgaaagttagatttacgcccgattgcaaatatgaatagctgaacagtggatttgcggcgatagagttgtggtctacgggtgtgttagccgtgcaaaacatacggggaaactacaggtgaactgaagccctcctagtgactgggcacaataccagtctccgatatgtgatgaggaaacattaggtggcaagtgtgggatctaacaagcgataaaatagcgtgtgtgtcggagtatagaatacgaaatgtttcaagagtgaatgagttttgtggctaaaactaaacacatgtgcacagatacaggccacaaccttaacggggtgaaaacagacaagtattgcaactccataagggggcctcaaaagacgacgtgcgaggcagaactccatatctcataatgtcgcttcccgagtggagagttggttggggaagattcacgactaaacattcctttgtgaacaccgccagggttggaggactagccggcaagtgaattcctcatcgggttcacccggagcagtgctcgcaaactattgccgaccggtagtttgatcatcacgagtccctaatcaacccataacctgggtaaaccatcactaatggcggattgccttccaaccacggagataaacacccctctagggcacgcaccacattgggacctctccataagactcgacaaacgcaatacccactattgtgttcttccaaaagtgtgggaccccctactgacatccggggaggacacaaccaagcggtctccacaccacgtgggggacagatcatattcacgcgaagggcacagcgcagggcgtacaacaaccactaacagccttatgcgggggggagcgggacaaaaaacacccacattagacgtgagggcaataaaacgtggggcggctacacgccatcccgacgcgaggtgagcacaaaccg

SEQ ID NO: 525401 - DNA, 216 bp, Homo sapiens
  misc_feature (1)..(1): n is a, c, g, or t
nggtccgaaagcatcatggaagtgggtcatggataacaaaagtggtatatgcatacaaggtatattattcagccttagatagaagaacattctgacatacgctacagcgtggaagaatcttgatgacactactccaagtgaaatatccattcacaaaagaataaatactgtatgattacaattatataacctaccaagaatagttcacattcataa

SEQ ID NO: 525402 - DNA, 369 bp, Homo sapiens
gcgaggtgtgcggatcacgggaggtcgggagtcgagagcatattagatattcttgagggagataaatcttagatatgtatataaagatgtagttattgggtaatcttagtagggccaagatctaggtgggtagggtgtgtgggaatggtgaagttgtctgtctttcatatgccacatccataatcaatgacctaggtgtccagtgcctagttattataaagaacaaaaacctaaaaacattcatgaagtaatctatgtgcagagtccttctagacttttaagatcccctctccagtcttctcagtttgtttgtccatataagtgagcagtaatttctttttttttgggcggggtgactctaagcaagca

SEQ ID NO: 525403 - DNA, 400 bp, Homo sapiens
tgctgctccctcttcagagtaattcaaattgaatcgagctctgctgctctggttggttgtagtagtgatcaggaaacagatctcagaaaaggcactgaagagagagaggtggtgttaagttggtgtggctggaatctctgggtaaggaacttaaagaacaaaaatcatctggtaattctttcctagaaggatcacagcccctgggattccaaggcattggatccagtctctaagaaggctgctgtactggtcgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgta

SEQ ID NO: 525404 - DNA, 170 bp, Homo sapiens
aaataatgaaaaaagaactagttgaaggatatttcacaattatgaagatattagatgatattaaatggagagctttattgcaaatgtgaaactttttatgtggtgtgattggatacacgcattgcatcctgacacggtatctgactccactatcaatgagtcaggtcaat

SEQ ID NO: 525405 - DNA, 535 bp, Homo sapiens
  misc_feature (150)..(150): n is a, c, g, or t
  misc_feature (155)..(155): n is a, c, g, or t
  misc_feature (315)..(315): n is a, c, g, or t
  misc_feature (332)..(332): n is a, c, g, or t
  misc_feature (371)..(372): n is a, c, g, or t
  misc_feature (416)..(416): n is a, c, g, or t
  misc_feature (468)..(468): n is a, c, g, or t
  misc_feature (480)..(480): n is a, c, g, or t
aattcgcggccgcgtcgaccgagaagacgacagaaggggagactcaacaagagctccagcaaagactttcactgtagcttgacttgacctgagattaactagggaatcttgagaataaagatgagctctgaaaattgtttcgtagcaganaacanctctttgcatccggagagtggacaagaaaatgatgccaccagtccccatttctcaacacgtcatgaagggtccttccaagttcctgtcctgtgtgctgtatgaatgtggtctcatcaccatttaatcatagctctcatgcctatcagtgggccaatacantgtccagccaatacacntctcatgccatcagacagccagtttctcagctcgaggannggttggctaccagaggaaagctacttattctactgtgagagganctggacttcagcccaaaatgctgttctgaacaggtgctactctgcgtcatgntctgaaaagacngcttttagatacgcagtagagaggacacgggtggacgggaccggtcaccagggtg

SEQ ID NO: 525406 - DNA, 91 bp, Homo sapiens
taaacattttaaatttaatcataacattatggttggtgggggtgtctatagcaaagttttctatcaatttcccccatcccatccccacgat

SEQ ID NO: 525407 - DNA, 318 bp, Homo sapiens
  misc_feature (100)..(100): n is a, c, g, or t
cttcaacagtgcttggacggaaagccctggcgctcgttccccaccccggggcccggcacgcccatatgccatgcgccatccagtcacctcttcacactgncaagccccgctctggacttgccccaaggagcccccctgtgcctggccagctccatgcgccctgcgggcaaaggtgccgacctgcctgccgccgccagtcctttcctttcccccttttaacgtccgccgccagtgaaaccgaaaacgccggccggtttccacctcgcagtgtttgggccagggcccccgaaggaaaaagctaacacctaccagggggaa

SEQ ID NO: 525408 - DNA, 621 bp, Homo sapiens
tggatattttaaaaatagcagtacttgaaaaatcagaagcaactcgatataatagtatatactgacaaccacgtgctcccaaggtgtggggattacaggtgtgagccaccacacctggcctatatgattttgaattgcataggcacaaagtggtgtataactttttgaaaaatgctacctctattataaaccctgtaattctgtattagttctgtttagtggaaaagctatatatatatatatatatagagagagagagagagagagagagagagcagcagtgtgagagagagagagagagagagaggtgtgtatactatatactatatattgagagagatgatgcattctctctctgctgaggatagagagagtatgctgtagttgacaggcatatctttttatttgtgtgttgatatattgcatcacgagcgggttatatatgggcgttgtatcgagagctacacatatatagcggtgtgtctagcgcagctcgcgtgagtcaagttgattattacacacactgtagcgctaaaaataacataccgtgtgtgtatctcatatataaaatgcgcgtcaccacactttcttatttaaactgactcagagagtgtgttctct

SEQ ID NO: 525409 - DNA, 680 bp, Homo sapiens
ttgggaccggacgccaccagacttgtctccaaaaatcaccagctttaatactccccggtcctgcacacacccacagtctcactgggttccaactctcacttactgcccgccgtgatggccttgaggctgtccttgcccgcgccaggatggtttggcacaatagagccagcccgaagtccgctcaatgctctcgatgggcaccaggaagcgctcctaatgggatggccttcatccacaggtgcgttgggcatcacataagtgcggagctcaattagcccacctgactgcctccaggatcagtcagcttgaagaagctgtgtgcggcacgtgccaccgtggttctatgccgcatgacctggtactttacgtaggatctgccatctagcctctgtcctgtgggcagagccaggcacacgtggcgcagggggcctggatgaacccaaagccacctcttccaggcagccttccctgatctgtcctctaacttctgtcgaactgcaggaccacgccgtcactgtgagactctagtagcactgcctggatcctccttgaggctggaactctctccagggtggttaactctttccctctgtattacttattgcccacacactgggtcaggcagagcggggaacaaataaacgctgctaggcagaactcggagaaacaaacacaaaaac

SEQ ID NO: 525410 - DNA, 337 bp, Homo sapiens
gctcatgccgtggcagagccatgagccacccgttgaggaaggagctgtaggcacagtagggcttcttggctaggagtgttgctgtttcctcctttgcctaccactctggggtggggcactgagtggggaagctggctgtcctatggccgttattccaccgtctgcctgcctgcctgcctgctgacctgggcatggtgcgagacctgtgactaagataggttttaaatgtgtaaattatggtgcatatgggttagtggatgtgaacagggctaggtaagacctttccacagcctgcgctagcctccgtgcctaatgtctattctgatgaaaatatgcc

SEQ ID NO: 525411 - DNA, 325 bp, Homo sapiens
gtcattgagttctcccttcacatatcctatttcaccacttacaatggccaccttccacagagcagcaggacacctacacagcatctgtaaaaaagataacgccttctctacagatctctctccttgtgcggcttcaccagaatcacccttcatagcaaatacccctaaaactcttacagcctatacctgctacccagctccaaagctgcttccacatatttaaaaatttgttacagcagcacctcattcccagcaccgatttctttctcagaccatacaggttggtataacaaaatgctatagactaggccatttataaacaact

SEQ ID NO: 525412 - DNA, 781 bp, Homo sapiens
cagcggtcacgctcaagaacctgacgggtctaaaccagcgtcggtgagagaagggaacccgtgtgctgggaggagcagcagtagatatgaagggctttgacaagatgtgccacccattgaacaggatgttaatgagaacacactgaagaacttggagtcgtatgacagccacaaggctggaaatcacaatgcacttgctgccgttctgacctggaactgggccacttcttcagttcctaatgccaggcctggcctcctgatgccttttgcattgcagctgtgtgtttgaaaactgaggctcacatccaaggtttcaaaccacaaaaccttggcatgactctgccatggtgtcacaggcatcttgatcatgtcttgaccatagaattgctctctaggagctgggcatggtgacctacgtctgtattctcagcactcaggagactgctacagcaagattgagagatcagaggcaggcttgtctttgtagagaattacaagcctgcttgagctacagagtgtgatcctgtcaaaatcccctgagaaatattcttaggggctcacaaccaaggtccggaggcaacacatagtgggagctcttccccagcacagggcagacagtgctcacaaacatttgccactggccatgcctctggatcccctcagaaagctgctcccctaggcaggtgcctttggacagtcgtgctgagcctgggcatcaacagacaccaggcatgcacttcaggatcattagtgtattttgaatctgtcaaaacaaaaaaag

SEQ ID NO: 525413 - DNA, 199 bp, Homo sapiens
atgtctggcttttttcacttaacataatgcttctgaggttcatttatatggttgtatatattattaggtatttcttttattactgaataagtgttccattgtatagatataccacaatgtgtttatctatttatcagttagcctttagggctgcttttgtttggggctattattataataataaagctgctataaataa

SEQ ID NO: 525414 - DNA, 610 bp, Homo sapiens
actttcccagctccattcagagggttttcccctgaacatttttgaaacagaggcagttgttttcagataaaagaaagcggcagaaggtagaaatgggagcagccgactgagggaaccccggcctaaaggcactgcattttgagcacacacatctggtttcctctatctactgagaatgcagaaattctgtgtaatgtccaactgagatcatgctgaactgctgtaaatctaaggtcaacgcaagaagcccaaggacttctcagtactatttagatacaaaatcctgaatctaaccaagaatccactcaggtgcaacgcaaaaccaaacaaaagaaccccaccccccatgcctttaaaagatacactctgaacactgctgaagtgtgtggacagaaacgaggatgaaaccactaatccacaggtgtgctggaaaagccaagaagtcctttgtttttgtcattcagctttgaatccaacttgttaaggtatgagggctgagactgtaaccaaggtgcctttttcaaatctagatgttcacttcaaagaagcttcctcatcctagaaaaatgaggtgctcaggctgggcgtggtggctcatgcctgcagtcct

SEQ ID NO: 525415 - DNA, 487 bp, Homo sapiens
ggggtgcccgagccacccggtccgccgcgtcccgccgccgccgccgcgtccccgccggggccgaccgagcctgatgccgggccggagcggcgtggcgcgtgccgggcctgccatgtgatccacaatgccgctgctgcagtgagctgggccgcccgcctacaacctgtgaggccggccagggcgactacgcgtgcgggccctgcacggctacgggtgccatccccggctgagcaccagcgtgcaagaccgtccttacccactaacctcgtatacaatggataaactaaccaaaacatcccaacatcaacaagcagttcgcacagacacaggaaccagttaaaccgcgatcatcactagacaaccatcgaaagtcgataagtccgataacggatgagaaagctcctgatcatgcacacggtaagaggagtcgtaaaaaaagagctgattcaaagcataatgcagaactctacaatgtcccaaccaaacc

SEQ ID NO: 525416 - DNA, 781 bp, Homo sapiens
  misc_feature (282)..(282): n is a, c, g, or t
atgagctgggtaccggagagaggactgatagcccatggtcagtgataggctggcttagtgcatgtcgccacggctcttactgtgtgcgccgtgccggattgttggtgtgcggctggctgggcggctccttgaacgggggagcattggcggccctgtcgtcctgcgtagagagagagcgtctatagcagctgattgcgtcccggtgcccaggctccgcctcactgtctgcctgagatctgtcggcctgcatgggtgagtgcatgcgtggtggcggatggtccnatgctgcggcatggctcccgtgcgcgctgggtagggcgatgacgatgagaaacggagctgtgggacggaaaaggcgaacccggcgaggcccccaagtccaccgcagaaggggtctgggaggagccgagggtcgaccagatgtgacagatgggtcaccttggcgaaaacccacgcttttccgcccgtcttgcctggtaaaaagtgtgaagtttctcgggcgacccagtccggtggtgttcacgttacttgggctgtattcgtggaacaccaggctggcgtggcaccagaaacctcagtgacgtggtaaaaggtcgggctcgaggagttgtgggttcgctgttgggtacggaaacgcttcgacgattgcacatgtttgcgccgtcgagtgtcttctaaaagcgttcagcctcccttacaagaacttgtcagatggagaacagaccagaactggcggcctgtacgccagagctcactggggagggaaggggtgtcacatgga

SEQ ID NO: 525417 - DNA, 121 bp, Homo sapiens
gttaattgctaggaggtgtaattgcctggaggcgttcaattgccggaggctgttaattgcctggaggtcgttgaattgccggaggcgttaatggccctggatggcgttgaattgccctgga

SEQ ID NO: 525418 - DNA, 328 bp, Homo sapiens
gctcgacggagaacaaagcttcaactttgactttctgccagaggagagtgagcacaatatctggggcacctaagatgtagcatgtttccgaaagtgggaggtttaggactgaggcaagaaaggcttaaaggcagtgactttgctaagcagatgaagcgtagttgttaggagatggcatctgtgggctttctaaagtcatttagttgtttattgttttctcatctaacgcacagttgtctaatcttttggcttccctgggccacactggaagaagaattgtcttggaccaaacataaaatacactaacagtaacaataactgatgagct

SEQ ID NO: 525419 - DNA, 210 bp, Homo sapiens
tcaagcttctaacgatgtacggggacatgcacagcagatttatggctggccctttcccctgtcagttcctttgggaaccttgagctctgagttaagaagaaattctcgtagtttgttccaagttacagccttacttagtgtttgttgagagccggttcagtctccacagcttctgttacttcagtgtctaaatgtttgcttgtcaaaaaa

SEQ ID NO: 525420 - DNA, 592 bp, Homo sapiens
  misc_feature (442)..(442): n is a, c, g, or t
  misc_feature (451)..(451): n is a, c, g, or t
atgatttgtttcattcttctacatgtggcttgccagttttcccagcaccatttattaaatagggtatctcgtcctcaatttatgttttggtgtgctttgttcaagatcagttgactatacatatttggctttacttctaggttctctattctgttcaattggtctgtgtgcctacttttataccagcaccatgctgttttggtagctatcaccttgtagtataatttgttctttttgcttaggattgctttggctattcaggctctttttgggttccatgtgaattttaggattgttttttctaattctatgaaaaatgatgttggtattttgatgggaattacattgaatctgtagattgctttgagcaccatggtcatttgcacaatattgattcttctaatccatgagcatggggtatgttttcatttgtttatatcgnctatgattnttttcagcagtggttttgtagttctccttggagaaatctttcaccttaatgggtaaatatacttctaaggattttaatttatttttggccacttgttgtaaaggggaaaattctgaccctgtaaatccattttggatggga

SEQ ID NO: 525421 - DNA, 109 bp, Homo sapiens
ttgcctgcgagcactttcagaacctgatagaaggcgagctccgagggtggcacggctgcgggcgcgggctagactcgctgcacaagaacagcgtcagccagatctcggt

SEQ ID NO: 525422 - DNA, 240 bp, Homo sapiens
ccccttttggggggggggggggggggttttggacccccctggccccccttggaaaacccccttttttttttaaaatccaaaaaaaaagtggccggggggggggggggccgcctttttttcccccctcttttgggggttggggcggggattttcttttcccttggggggggggggttccgttggcccgggttgccccctttcccttttgcttggggccccaaagggaaaccccccccccca

SEQ ID NO: 525423 - DNA, 390 bp, Homo sapiens
  misc_feature (1)..(1): n is a, c, g, or t
  misc_feature (65)..(65): n is a, c, g, or t
  misc_feature (95)..(95): n is a, c, g, or t
  misc_feature (119)..(119): n is a, c, g, or t
  misc_feature (125)..(125): n is a, c, g, or t
  misc_feature (132)..(132): n is a, c, g, or t
  misc_feature (141)..(141): n is a, c, g, or t
  misc_feature (145)..(145): n is a, c, g, or t
  misc_feature (160)..(160): n is a, c, g, or t
  misc_feature (171)..(171): n is a, c, g, or t
  misc_feature (199)..(199): n is a, c, g, or t
  misc_feature (217)..(217): n is a, c, g, or t
  misc_feature (225)..(225): n is a, c, g, or t
  misc_feature (238)..(238): n is a, c, g, or t
  misc_feature (259)..(259): n is a, c, g, or t
  misc_feature (384)..(384): n is a, c, g, or t
nggggagggtgggaggtggttatgggggataaacagaggtgggggttagcgaaggactggggttngtgtgctccacaggcccagtgccctactgnacaacagctttagctacccttgcngacctnaggtctngccaggaanaganactttccagtgaaanaaaaaacagtngatgctgccccagccccctcctgctctngcacctgtttttactctnttcaccangtgggtgagctangtagctctgagttataaagcnatctgggggacgctgcctcagccctccctccctccccaggaaagcaagaatttacactccattccctttttccggcttccctgccacagtggtgctggattctgacagaactgtgggccagtttnaggtgt

SEQ ID NO: 525424 - DNA, 181 bp, Homo sapiens
cggccacatatcttctggacgcagtcaggatagtgtaaagctacttctggcagctccatccttacttcccgtcactcatcttgtactcctcaatcagcctggcgatccgtgtcatctctgatgctagggaagtcctccccattggatactaagatctatccccactgatcttcagtgtatt

SEQ ID NO: 525425 - DNA, 214 bp, Homo sapiens
aagcgctagtctgtgatgtattgagctgccagaacgaacagctgtaattgcacatgggaatgccgaattcatgaatgggagaaagaagagatgcctaagatgaagtcacaaagacgaaaagatcattaattggccaaatgataatgacttgggaaaatatgatttatgttttaaaaagatcactcactgggggctgtgggggtaccgtcgacgg

SEQ ID NO: 525426 - DNA, 1175 bp, Homo sapiens
tggcaaaggggacaattttaattcaaccacaagtccaaagaaaaaaaaaaaaaaaaaaaaaaaaaaaaaaaaaaaaaaaaaaaaaaaaaaaaaaaaaaaaaaaaagagagggggggcgcgcgcgccacaaagaatactccccgagggggcgcgccccaccacgcgcggcgaccacccacgttttgttgtggaacaaaagaggggggccccttaatagggggagccttatatattatatataaacacacgagaggcgggcgggggcgcgtggttattaacaacacacgcgtgtgaggtgggggaaaaaatcgcggcaacccatggaggatctttgtggaggaaggagcgacacttcttattttgtggggggggcgaacacacctagtgtgggcgcacaaaactccacctacagcgagagatatttataaaggctctctatggagggacacataatattaatatttttcaacggtcattactgggggtggtaaacacaaataccgccccaaaaatgtgcggcgtggcgtgggcgaaaaaacatgttgtgtggcacccagtggatgtttttgtctttattgaagaacaatatttttatatataacacggcgggcccctaaattttttaccatgcggggacgaacaacggagcagacggaaaaagacgaagcgagagaaaagcacaagaaagacaggggcaaagggagggagacggaaagcgacaaaacagaaaagaaagaagaacacgcgacggacagccggaaggcgaagccaaggacagagaaagccagaagggggagggggaggagaaaaagagagagcgcgcagaacgcgaagggaaaagaaaagacgaggaagagagcagagcagagagagaaaaaccgagaaccgacaacaggcggggcgaagaacaggagaaagcacgagaacaaaagaagggaaaggagagaaaacctcaggagcggaccaagcgacacggaagagacagagaacacaccaaggagaccaaacgagagggacgcagcagcaaggcgggcgacacgcagcgcaggagacggggaccaagcgacccagcacgtgcaggaccgacgacaaagcacgcacgaagcgaaaaaaggcagggcaggggaaagtggaacacagaacagaaccagagaagcgacccacagagcacgcac

SEQ ID NO: 525427 - DNA, 427 bp, Homo sapiens
gtgatcggtccagtctgtgcaccgttggccacggacgcgacgaccgtgttgttgaccgtcgggctcgacgaggacgagaccccgccggtgaaattgaccgtcgagtaccagacgttgcgcccggtgatcgtcaggttcgtcaactcggccgcgccgctcgtcggcgtgaacgagattccgtacggcgggtagtaataaaagccggccgagacggcggtgttgccgccgaccgtgacactgatcgaacccgtatcgccgctcggcgccttgaccgccagactcgtcgggctggccgagacgacagtggcataggtcccgccgaactgcaccgtgttgttggccgggttcgcatcgaagccgctgccgacaatcgtgaccgtcgtgttcggtgcgcccttggccggcgagaagttgtcgatcgtcggtc

SEQ ID NO: 525428 - DNA, 361 bp, Homo sapiens
  misc_feature (49)..(49): n is a, c, g, or t
  misc_feature (72)..(72): n is a, c, g, or t
  misc_feature (76)..(76): n is a, c, g, or t
  misc_feature (96)..(96): n is a, c, g, or t
  misc_feature (105)..(107): n is a, c, g, or t
  misc_feature (121)..(121): n is a, c, g, or t
  misc_feature (146)..(146): n is a, c, g, or t
  misc_feature (170)..(170): n is a, c, g, or t
  misc_feature (177)..(177): n is a, c, g, or t
  misc_feature (220)..(220): n is a, c, g, or t
  misc_feature (354)..(354): n is a, c, g, or t
ggatgggtggggggagtggggggacaggcaggggcatgggtgcgaggangggcatgcgcacgagtgcatctntgtncatggccttgtgaatgagcngctccagtnnnttgggctggttgtnctgggagttctgtgtggagcaaccnggggaggtacttgaagggcttttngtattcnttgagcgggtagtgccccagggccaggtagaagaggtaatcgngctgtgcctccttgctccctttgggcagcagctcctggagcagcaggatgcctttacggatgtgatcattgtacttgctccgtaccagggaccaggggtattcaaactgcgtgctcttggacaccgagcctgcngcgttgt

SEQ ID NO: 525429 - DNA, 375 bp, Homo sapiens
  misc_feature (222)..(222): n is a, c, g, or t
acggattagttgctggatagtacgggaatgaacaatgatccgttttctgacatcatcaagctcacgcaggcccagtctttggttactggcggttttaccgcgtggcggtcattgtggcgctgcgttttccgtgccccgtgaaaaaatcaagtttttcgccatacgtaacaaggcaggttgttcgggtcacttttgcacaggggagccaagcccccagtgcgngttttctacgcggtgatgttggggctgcttgagcgccaagcgatcttttattcctcgccagccaatccaggatgttgacgccggtcgaacgccatgagcgtgtatttctgggtgccgcgtaaaagtcgcatcaggagcgagttccacaatagg

SEQ ID NO: 525430 - DNA, 753 bp, Homo sapiens
ttctctggagcagcgtactttatctccgtccgcttctctcctagctaagtgcgtgacccaccgatggaagattcgatggacatggacatgaagccccctgtagaagccaccaaactatgttaatcagggtgtgaactaaaggccgacacagattatcacttaatggtggataatgatgaaaatgagcaccagtgatcttaaagaacggtcagataggggctggatgcaaaggatgagttgctcattgttgaagcagaggcaatgaattatgaaggcagtacaattaagaagtatgactggaataactttgaaaatgtcttgtacagaccaaccggtttctccttgggggctttgagataagaccaccgagtggtcttacaggttgaagatgtggttgcagtggccagtgactcctattagtggacagtacgttagtagctgtggaggaagatgctgtagtcaagacagtatgacggagcgaggaggatgtcgaaactctcaacatatatcttgcagagaagccggtctgtccctggcaaggtggtagcaaggttccacgcacaccaacgagtaaaacttgctggctgatgacagatgatgacgattcatgactgaccgaggatgatccttgacagattgattgactgatgaccgatcgtggtcgctgagggaagcttggatccaggaagcgcccgatggagacatctagacgagattcccgacccacttgccgggagccattcgaggcccaga

SEQ ID NO: 525431 - DNA, 362 bp, Homo sapiens
cttagcagggcgctaagctttcacgtgtgggatagggcctttgagagacagagcacatagcttagccatagagaaaagcttttcctcttcccagtgaaatggtctatcccaactgcagagttgtcagaaaaagcaattcttcatgtgcctgtagtcccagctactcaggagggtgaggcaagaggattgcttaaggccagatgtacagacgttcaagaccagcttgggtgacctagcgagactcgatctccaagagaagcaattcttcctcttcctgttttctgtaaatcattgtggtggctaactaattggtttatcatgtgactgttgatttcagtatagagaaaaagtttgggtgatta

SEQ ID NO: 525432 - DNA, 345 bp, Homo sapiens
caaaaccccttttttttttttcccccccattttgggagccccccccttttttaaggcctttaaatttaaaccccggggccgggggggggccgggggaaaattccccttttccgggcccccggggcccccccagaaaaggggcccgggttgggggggggggcccctttttcaaaaggggggattttttttttttttgccccccctttcgccctttttttttcgggggttttaggtcccttggggggggggggtgggcccttttcttgggggttttttccccccttttttttttggcccggggggggttttttcttttttaatttggggggggttttttttttttca

SEQ ID NO: 525433 - DNA, 1363 bp, Homo sapiens
tcttttgtgtgttgatagtgggtgtgagaggtggggaggtgttgtggtggtgtcgatcaggtgtggagatgtgatgattgatggttctttggtgtgggggtgatgaggatggatgctgtgagttttggaggggagaaggggtggggtgatgtttggttggacgatcatctcgagactcttggagttggtggtgtgattagcgtagtgctgggtgtgggtggttggagagtgcttgatgtgtgttgtgagtatgagagagagaggagtgtggttgatttattgttgttgttgggtgaagtgtggagagagagagggggttagggtggagtggggggtgtgggggagtggatttggtgggggggagagtgttgtgtggtgtggaggagttggttgtattttcatgagcgtgtgatgggaatggagtgtggttgagagggaggggagaggggtgttgtcttgggtggtggatatgatgtggagaagggggatgggaggaagtgtgtgtgttggagagaggggttgtgaggtgcatcttttttgatgtgtggtgttgtttgagaggtgaggagggttaggatgtttggattggtttaggtgtatgatgtcgtgagtggtggtggtttttgtttcttttggtttttcgggtggttgtgggtggatgcgagatgttgcagtggttttctgtgtgtggagcatgggggattgtgtgcgatgtttgtgggatagagtgatttttgagcttttgtttgttggtttttggtgatggtgtgtgttgcggattgttggatttgtgtttgtgtgatgtgtgtgcgcagtggtttccttgagtgttcttgtgttttgtagtgttggttgtgggacagcgcgcgctcggggaaacgcacacgcgcccacacgccgcgcgctcgcgcgcagtgtgtctggatttcttggtcttcgtctctctctcgctcgagtcagtgtgagactcatcgcgcccctccctctctccttctgtgtttttgtttgtgtgtggagagcatggtacttttttttttgtatttcttgactttgcatctcttctccctctctctgttcgtgtagtagacgacgcgcgcccgcgccgcgccgcacacccagagcccatgttctctcttgtgttctgtagtaagatgagagacacagtacactcattctctttcgcgttgtgtgaggatgcagtgggtggtgggggtgggggcgggttgtgtgcctcttccttctttcttttgctgttgtggtttcccccggtgggggtgtggcttctcactatcttatctatagatattgattatataatatatatagaataaaaagaaataaaaatataattataaagaatata

SEQ ID NO: 525434 - DNA, 146 bp, Homo sapiens
actctgtgtgccactcttgctacttctcactcatccccaacttccactgtgtagtggaggtcaattctcactctctgccatgggctacagaccctccctgctctggtcccatctaagtcctgtgccccgacgcacgacgggaactg

SEQ ID NO: 525435 - DNA, 160 bp, Homo sapiens
caggacctttgatcgtctgtatctcctctctggattagcgggtgccatcacggttaacaatagttatggtaattggtctatcaaaggcattgggcaggtctgtgactgatgtacaatcttcttcaggtggagctgaagcattgaagcaatatgtgtcata

SEQ ID NO: 525436 - DNA, 124 bp, Homo sapiens
taaaatcgagcgaggaacgatggcaagtggatgctggtccacaggactgaggtgatcaagtacacactggaccctgtgtggaagccattcacagtgcccttggtgtccctgtgtgatggggaca

SEQ ID NO: 525437 - DNA, 540 bp, Homo sapiens
  misc_feature (8)..(8): n is a, c, g, or t
  misc_feature (238)..(238): n is a, c, g, or t
  misc_feature (245)..(245): n is a, c, g, or t
ctcaaccncaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcaaaagggnaaaaaanaatttaaaggtggtttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttca

SEQ ID NO: 525438 - DNA, 441 bp, Homo sapiens
catgtacgagctccagctgactatgcatcttcaagactcagctacacttcatgttgtccacagaacgccttactaactccctgcaaagggacatatataataaatcaccacttctttaagatcctaggaacaggatgtgtatcctagttcaaaaattttcagattttgaaaaggtaatagcgtgtatttaccaaatactacctagcactatcctaggggtgtctggggcaagatgctataatcaaacacgtaaacatttctcccacaaaaaacaaaaatatgagcacttttaagatgaaattaagacctacaaacagttttacagcactgtatgtcagattttgctgccaaatgaattcacattagttcatattttactgctacataaactaccaaaaaatcctttgcatatctgaacctgtaggatttcagagtggcaat

SEQ ID NO: 525439 - DNA, 227 bp, Homo sapiens
gttttaaaatttggggtttccccgggggtggggttgtttttttagttttggcccttggtccaacctttttggaacttttgatttggttttggctggactagggggttttttttgcggtttccccctttgggggggatttttttgatttttagggtttgggactgtttttaatttttttttggtttggggttggccaagggggtccccttggcctttgtttcccccca

SEQ ID NO: 525440 - DNA, 370 bp, Homo sapiens
  misc_feature (35)..(35): n is a, c, g, or t
gggttcagaggtatttctgtatgttttgacataanataagtgccatggagattacatcaaaatggcatgccaaatgaggcctggtgccttttggggtatgaatcgtagaaccttgcttttgcaagaaagggaacttggccaggtgcggtggctcacgcctataatcccagcactttgggaggccgaagcaggtggatcacttgaggccaggagttcgagaccagcctggccaacatggtgaaacgccatctctaccaaaaaatacaaaaaaattatctgggcatggtgatgtgtgcctgtaatcccacctacttgggaggctaaggtaggagaattagcctgggcaacagagcaagactctgtctcaaaa

SEQ ID NO: 525441 - DNA, 230 bp, Homo sapiens
caacaactcctttccctcctaggcatggttagcacggtcagaattcttacacaagagccaggacgacaccctgtagcctttctgtccaaacaacttgaccttactgttttagcctggccctcatgtctgtgtgcagcgactgccgctgctttaatacttttagagaccgtggaaagagagggagagggagagggagagcgagtaaattctttaaaatgatcaaagtgttg

SEQ ID NO: 525442 - DNA, 224 bp, Homo sapiens
ccaggtagacctaacagtggtggtcgagccaaacgctattcatcccagcggctaaagacctgtgccagagacccccgacccctccgatgcgcatatcagtatcatgagagggacgttactatcgatccacgttgagttttttcgttactgttcggggtacttcttcattggcaagggtgaacgtgactgtgtagataccagtgctcgctggctccctgaagttt

SEQ ID NO: 525443 - DNA, 292 bp, Homo sapiens
ttttttttttttggtttaaaaattcccttttttggggtaacccccaggtaaagggggggggggcttttcccaacttccccccccttggggggccaaatcggggggggggggggggggctaaaggaaggccctttttttttttaaaaagggggccgccccggggtttttttgcctttttccaatattccggggaaccaaaggggttttttccttcctttaaaaaaaacccccccccttttttaaattttttttggggaaaaacccgcccctaaaaagcggggttttgggccca

SEQ ID NO: 525444 - DNA, 1294 bp, Homo sapiens
gggaacccggcgctacgtaccccaccccggccggccgcccatagccagccctaccgtacacctactatacaccgcaccctacggactagccccaaggcccccgccgccgctaccagcgccgcgcagccaccgccgccgccgccgcctactacctaaagtacgccgccatagacgaccgcgtacacctacgcaggtagcgccagaactaaccaccagtgactccatcaggcctgccctacaaccgcctagataccacctaggagctactaacgcctacctaacgtattcaccctagtaccatagtactatcactaactatctgcacccgcgcatccactgtagcgctttcgcacacatactttctggccccaacctacctatatcttatcacgctctctacttcactgcattccacatgcggcacccactggccttgcagacacatctgcactagacagtctatgtttcgcaaagcccacatcgcagggcagcgccctcgaccctcctattcccttatccatgcccataacctccaccttaataccctccactcactcttgtgctgaccctcgcccccttgcgcgccgccgtctgctctccctttcctcctttccccctcctgcgacccgctgcctcctcccatactcccccatttctgcacccccacctcctccttcgcttgccactttccacctccccccccttccccttgcctcaccccccttgtctcgtccacacacccctttctcctcctacttctcctctatctccctctttgcaccccccccccaagcctctgctctcctcaccccatccccccctcttcacacccactctcctccactatctaactcccatttactctcttctacccctcctatctctcttctcctctctccccccctctcttcccccctctaacacttcgccacccctcgcaccccccctatctctccactctcccatcccccttatactccccccccccctccactctcccccaatcccatccccctccgatcccccttcctgtccccctcttgcccatctcttcaacccatctcctcccccctcctggcaccttaattccccacgtccccccccatgtctcccttccacccacctctgtaccttctcctttccacccaccccccttaccccctccctttccacactcctccacaccttttatccccccccccctattatcccctctaccctcctcacttacccattttcctctctattaccacacccctcactccctcctctctccccctttcccccctaactt

SEQ ID NO: 525445 - DNA, 890 bp, Homo sapiens
gactaatatattccaccctaaacctgacttcgctaattccccccagtcctgaccaccctcgatgaagcctaacgaaagaaactcataggcccccagtatatgtaacacatccatgagtcggatccaccctttggttatcacgtctccttccccataagaataattcatagtgcctacgaccaggaagtaatcatctcgaacggacactgagaccagcaacccgaaacacatccccaatcgtacctccctgagagtctttcaaagcctaagactgaacttcctaccagtagactgagttcactttcgccatgctgcgcgagtgggtggccgtctagcgagtggctgcgccattccataggaaacttcgtacaccctagttgggagtgagtactgatacaactaccgagaccgcggaagatcattgaactcaagtacttcaagatatcgtacttcatctagccctagattagcagtactacactctatagttacgcgctgaggcaagcctattgccaggctgatatgcaatcgaggcgtagaggagggcgtagcgaaagatatccttcttggctcactcaggttgatgatacgcccgagcagatgccaaacaggcaggagccaattcaagcgatcctatataagcgatatcgggatcatcggtttcatcctcgcctgagcgtgatataatgctacattgcaattcatgagacgcgaccaataaatagtcgcttctgaagacgctaatgcaagcctctaccccacttaatatgctcctcctaagcggcagcaggcaaaatcagcccagttagttgtttgcaacccctgggatgcctttagccgtagaaaagacgcaaccggttcagggctagattcaatcaaggcctattatg

SEQ ID NO: 525446 - DNA, 306 bp, Homo sapiens
cagaacaactgaagcaggataagatgaactggaaggacactgaagcagcataaagaataccaaggacttgcaggaagtaataggagaagaggtgagtctccctgcaattatgactagggaatgtagatagagttcaactgagaactctttcccaagtaggaattccaaacgggcaaagagttgaacaactatactgagtcctacacactatcaaggtaaaatatagtgcagagaaatatatatataaacctaggactaccagatacccctcaaggatctaccgaataccccatacaggatctccga

SEQ ID NO: 525447 - DNA, 679 bp, Homo sapiens
tatcgaagcagaagacggaggtggtgtggcggggtccccacccaggtggttgtgtacggccttcagcagtctacatcctggtggtggtgacccagtttgggaagatgggcacctggtctcctggagcccagcagagtggccagtgacgtcagcaagcctgtgctcaccaacaaaagtccttctggggcaggatgagcctctcatccatgtctttgcaaagaacctggtagcgtttgtgtctcaaggaacgcgggaaacagacgcagtcctcctcgccgtggccgtgaaggacaaaagcatggaggggctgaaggcgcctgagggaaggtgatccgggtgtgccaggtgtaaggtgaaccctggaggcatccagccccgcgctgctcagcaggactacgtgaacacccagattcacccaatcaggcgactcaagtctctacctccctccccgcatggaggcaggaactatggcactagccttggagccaggagaaaagattcgtgtctcaggcagactcttactctggttagtaagatcatcgtgcgcatagacggtgaggatggaacacgtcaccagaggagtcgtgacatggttctcaccagcacgtgaatcgttgctgctgtgtgagaattggaggaatgagtcaccaggcgtggaatcacggccccccggtgtgaa

SEQ ID NO: 525448 - DNA, 141 bp, Homo sapiens
cgggagctgcctcagcttactttaactcttcagtctctctgaagcttcagctgtatttgtctttctgtgtttccagttctgaattatgcttctgaagcttgccaatttctcttccacagcatccctgtatctcttcccctt

SEQ ID NO: 525449 - DNA, 222 bp, Homo sapiens
  misc_feature (79)..(79): n is a, c, g, or t
aggatagtctgagcagcggtgtccgacactgcactgactcagggcacaggtgaaaacttccttgccaacgagtcccacnacatcaggtgcctgatctgccactctctgcattgacagcttgcacctgctcccgctacagcacagtacaccatacctcttcttctgtatcctggttcctctcacccacagagtgagaggtggtggacccattggctgtcctcg

SEQ ID NO: 525450 - DNA, 443 bp, Homo sapiens
  misc_feature (13)..(13): n is a, c, g, or t
  misc_feature (19)..(19): n is a, c, g, or t
  misc_feature (61)..(61): n is a, c, g, or t
  misc_feature (73)..(73): n is a, c, g, or t
  misc_feature (131)..(131): n is a, c, g, or t
  misc_feature (432)..(432): n is a, c, g, or t
  misc_feature (440)..(440): n is a, c, g, or t
accgcaggctgtntgagcnccacatactgctcttgctgaccacgggcatcattgataaccnccgacataacgncccaattttaccgccgccttcgaagatccaacattctgtaacggtgttatcgacaaantgacgatcgtggctaaccagcaataccgtgccctgatagctgtcgatcagttcttccagcagttccagcgtttcgacatcaagatcgttggtcggttcgtcaagaatcaataagttgcttggtttgaggaacaaacgcgccagcagcaagcggttccgctcaccgccagaaagcgcacgtaccggcgtcatcgcccgtttcggatggaacagaaagtcctgcaaatagcccaatacgtggcgtggcttgccgttaaccatcacctcttgcttacttcggcaaggttatccatcaccgtttnatcggggncgc

SEQ ID NO: 525451 - DNA, 111 bp, Homo sapiens
tctagaggatccctggttgccagtattataacccaagctgatgaggcaggctttgaactcctcgtggacccagtgtgcctggagtgatcccggtcaaagtggttgaaggag

SEQ ID NO: 525452 - DNA, 141 bp, Homo sapiens
cccccctgaaagggtcccttccccagtcctgccaaaaaaccccggggggggggagggggcagcatgcagggtcccccctccctttttggggttgatgaaaaggtgaagtgaccaaatgaaaaaaagctgcattttcagtga

SEQ ID NO: 525453 - DNA, 1419 bp, Homo sapiens
gggcatgctctagaactgatgctggaggattcttgcctaccgatacagagccttcgacgtctgtcctgtgggccgccattacacactaccacctccatcctgcttggaaatggccttcgctcccggcctatgactggtcccagcgggcacgtacagaccaccctagaagcccctggagctcccactttatacgggcacccgtcccaatccttgtgagctctatcccacaccaatactaactccgcacacatcaacgagcgactccccaaaggattggagtatgtgctgcgctcccctaacacacacatttaacgctgtcccactcccgccctaccaatcgcgcatgatccgaacacccgggaccctcgatccggaaccacggcaaccgggcgcccacaacccaatggacaggaaggtggcaattcccgtctgcccaggacccacacacatcacgcgccccgcagtcactttgacaccacacccgccagctcctgcacccactcaggagtgcacactttactcttccctcccccaacccttaccctataccccatcccccttctcgactgaaccacaaacctaccactaactacacacagacccgcatacgtctcacactgataacatctcacacttactccaccctcgactcctccaccacaatcactccataccaaaaataacactgcaccacaacgacaacccatcaaaccacagctcacattaaccaccaacaaataacaaaccctcattaccaacctcccccacatcacgcgcaacgacagaataaagacacaccacctgccaacacccagaaaacagcgaaagaaaatcacacacaacccacaccacgactcaaccgagcccacacatgcccggaccaaccgacaacacgtaacaaagagggaaacaacctctcaccaacacacagtagactagagacacacaacgaacgacatagacacagagaaacacatcggagggaccagagacacgaccgacagcagggcacgagagaccacaaacgacacggaacacaacgacatcggatacgagaccgagaacaggatatcaaagggcaagaccaacaacgggcaaagcgcgaacaacgacgggtacagccacagatcgagcgaagcgcaccgacctgagcaaaacaaacagccgagcggcacaaagaaagaactcacatgcatccacagaacattgacactcaaataaacataaaccccatatcactccctcataatacctcatcaccactcaaccgacaatatcaaccccatctacatccctcctccctcaaactacatcacaggtcataaacactcctaacaataccatgcaccatcactaccctaacacatcctactaaaattcaccactcccatatcactacacacacaactctaaccaaca

SEQ ID NO: 525454 - DNA, 724 bp, Homo sapiens
  misc_feature (337)..(337): n is a, c, g, or t
  misc_feature (378)..(378): n is a, c, g, or t
gcatgtaacatgaggcttctgctgcttctcctaatggtcggcgtctgcgagtggtccgcgagccgaggcctcggtccaagtctgggcggggtgcccagcaagagattaaatgatgcaggtacgccaacggggcctggtgcgtctggaaagattcctgggaatttggtgattgccttgaagggtcttagtagagctgggatgttccgaaggaagctacattgcggggattatttagcccagtcggtataacccagtagcatcccgcaattgcaagtgcaggagagacttactctccacttcaaccactaagtgatattagaatcactgtgagcatccnttttccctgctcagtatctttcacaacctagcatatctaantgagggcgtgtaaactagagtctgcttgggccagaggtagtcccgtgttcgtcgtatgtcgtatggagtgcaaatgcacaagtgcatccctaggccatcatgggccagatggggggaccattgggaacaattgaagcggctgtataggtgcaattgctatagaatttgggttttttatcatatcctattgacgtcaaacaattggagttcgaggagaccaggagtgtaattggcttcaaaccagggcttgccacttagtgaggaatacatcttatttgaaccttggagttgtacccatggtgattggtcggtaaatgcttggacaatcgttggtcacgcgttctca

SEQ ID NO: 525455 - DNA, 332 bp, Homo sapiens
ctgaagcctggtaagtacaatgctggcgtgctcgtggatccaattctattccggatgatccggcaaaagaagcttccttgatgagccccagagcaagtgagcagctgcccctgcccctgcctctccaggtccaccatgcgacatatcgacaagtgggtcctaagtatgtgtaaaggtctccagggccactagataggagcctagtgcattacgtgtcaacgtggagcttcacaagctgggagtgagccatgcgagacccgacaaacgcaacaccattatcaaggtatgtcaagcactcagcaatagaggtctctccaaggagtgctacacgg

SEQ ID NO: 525456 - DNA, 1432 bp, Homo sapiens
ccaggcggcgcgtggtctacgccgagctgacagagacgctcaggctgtgttctcacggatgaccgagctggcgagacagcagcaccagcggcgcgcagagaccccacgacatcaacgctccctcttgcgcgcaacgctgcgcagcaccgcactgactgctgcacgactcacatgacactcctcccctgccagcgacttacactctgcacgctgacaggacgacagctatgccacagctacctgtcctccacagctgcacgggccggctactgccgcccacaacgccttccgcccacagcctcagctgctcccacttgctggcacgcgccctcacctacacatcccactcactgcactgccaacaggcccgccaaccacaacgggccacacgcacaggcctccactgaccctgctggccgccatccgctccaaagccacatgccctttccgcaccactcacctaccaccactgcgctccacacggccccagcacacaccctcctgcccagccccccctgccctgacacccgacccaccccatccacaccagctgggcgcccgcgcccccccgcgccccgggacacctcccgccaatcgcccacctcgcgccccgccgacccggcccaccctgccctcaacgcaccgcaccagcgcacctcgctcgcgccctgcctcctgcccgccccccttcccggccccgcctgcttgccccccccagtcggccccacccctggcccctatgcctcgccgcccacaccgccgccgccgtccgcccccacgcccctcgccccccacccggcgccacccactctccacgaaccccccattgcgtcggcacccccgccccatgcgccccgcaacaccaaacgcccctcgccccccaccgcggcccctgcccccaccgccgccgcctcccctcctcgcacccgcctcccactaccaggaccacagccacacagcgacaacgccaccccagccgcacgccacgcgcaccccgaccacacgcgcacccacagacgttcaaacccacgcccatcgcactatcacccacacacaccacgctcgcccccgcacacccaaccgcccgccgactcacgacgcccactctccggagcagcgacagccaccccgaccccgcacccacaccccaccaccccccctcccccaccccccccccacacccccccccacccacccccccccccaccccacccaccacccaccacccacccccccccctcacaacccaccacccaccccggcgccccgccgcccccgcccccccccaccccccacccccccgcccccgccgcaccccccccccgcgccccacccccccgccccccccccccccccccccgcccccccccccccgcacccccaccccccacccccccccccacccccccccccacccccgccccccgcctcc

SEQ ID NO: 525457 - DNA, 1078 bp, Homo sapiens
aagtaaaaccccatagaagaaacatgggaatacagaatatattctggggtcagcttcttaaagttatactactgtttactgctttctccgtctcttttgtattcccttttttttttttccttggagaacggagtctggctctgtcacccagactagagtgcaggggcacggtctcaccttcacgtgcaaccttccacctcctaggttcaagcaattctccgtgcctcagcctccgtgagtagctgggactacaggcattgcaccaccacacccggctaattttggggttttatagtagccagtgggtgtttcaccagtgtttggccaggctggtctcaaactccgtgacctcagggtgatccaccgtgcctcggcctcccaaaggtgctgggattacaggccttgagccaccggtgccgtggccccttaatcgtgcgtgaagaagagaagacagtagaagaaaattcaaccttgagttaaaagcagcaggtggtttgggagtttactaagctcagggtcttcattgagagaccgtcgggaaatacattaagggatggggggggtagataatccattcagccagacaaacgggggccagctcgttaaaataagaaagctgagactgaggaggtgaacctgcacttaccacgagaacgtgcatcctctaatccccagtgcttgtatacttcaaggtgcatcaggctaggaccgggggttacgctgttggacctgcggaaccttcatcactggattgaaaatgtacataataccgggccaagggggggacgcactcaagtatagggggacaacaggcacgggcgcgagacgggtaccccaaggggcaggatggcgttcccaactaacacctgtgacaaggcgccaagaggggtaacggggagaccactggccccagagagaagccgtatgtgcccatcggggactgagcaacagatcctagagggccaccacaacacgggggcgatacggacagaacattcaaaaaggtgcgcaccacgctgatcaagccacgtgagcgacacagcaggcgtcgctaccggtaccccaacacagatgggca

SEQ ID NO: 525458 - DNA, 261 bp, Homo sapiens
gtacccaagaaccagatgttcatgtcaccccgaggtaactcagccctgcccgtcaatagctacacaccagcaccagcccagcagaagagcaagcagaagtcatgtggtccacagccatgcccgttgaggagccggccaccaggatgctgaatccccgtatcccagtctctgtagtatgagtcccagttttgccttgcaagtaagggcatgcgtgtactccccccagaggagagaagtgtgcatagtgaagccttttccttt

SEQ ID NO: 525459 - DNA, 230 bp, Homo sapiens
ctactccagacaagttgaccgggaagacacctgagagaagcaacacaggaaaagctctctgccctcttcttatctatctaaaagaaagacataaatttgccttttcgaagatgtccctcattctcccccacaccagaaagatgacaccaatgtgtctgcataaacaaaccctactaactcttatcttctattagtttccttatatatttacttcggtcaacttgtctggg

SEQ ID NO: 525460 - DNA, 199 bp, Homo sapiens
agttgactctgaggatccccaatccattccagtgtattttgtgaggctggagcaggagggatctcagaggaaactcggtagtgtagatatgggaggacttgaaaggttcctgctagcttgggctggggatggagggaacatggaagatgggtcttggtttagaggaagctctttatcctggtacgctggaatggcatgg

SEQ ID NO: 525461 - DNA, 281 bp, Homo sapiens
gcagtcgtgagcactgtgtctgacctctgaactgttttagattaatggctcttaactttaaaaatgacaatcaaagcagttgaaatgagcctcgaggaagtgggtaaaggggctgccactctgcttaattttctccacactggggtctcatttcctccttgccagagggcttggagagtgagacttccaaagcagctccagtttccacaggacccactaggtgggatacctgtgagtgggaagggaggtttcaagcccttcccgagagacaaagggaaaca

SEQ ID NO: 525462 - DNA, 254 bp, Homo sapiens
  misc_feature (14)..(14): n is a, c, g, or t
  misc_feature (16)..(17): n is a, c, g, or t
  misc_feature (24)..(24): n is a, c, g, or t
  misc_feature (26)..(26): n is a, c, g, or t
  misc_feature (118)..(118): n is a, c, g, or t
cgggtctcttccgngnngcagggngntggaggtaggtggaagcagctgtggtgtggtgcaggggggtccatgcgcactttatcccctgagcgcagcagtgcctgatgccacatccgcnggaggggcaggcgagtgaagatgtggcccaaatccgggaccacaacagtgtccttctcatacctaaaagggcggggcacccctccagcacacggggcatagagatggtagatgtggaggccagagtggcccacgag

SEQ ID NO: 525463 - DNA, 621 bp, Homo sapiens
  misc_feature (4)..(4): n is a, c, g, or t
  misc_feature (96)..(96): n is a, c, g, or t
  misc_feature (98)..(99): n is a, c, g, or t
  misc_feature (108)..(108): n is a, c, g, or t
  misc_feature (122)..(122): n is a, c, g, or t
  misc_feature (145)..(145): n is a, c, g, or t
  misc_feature (151)..(151): n is a, c, g, or t
  misc_feature (160)..(160): n is a, c, g, or t
  misc_feature (164)..(164): n is a, c, g, or t
  misc_feature (170)..(170): n is a, c, g, or t
  misc_feature (189)..(189): n is a, c, g, or t
  misc_feature (201)..(201): n is a, c, g, or t
  misc_feature (203)..(203): n is a, c, g, or t
  misc_feature (210)..(210): n is a, c, g, or t
  misc_feature (215)..(215): n is a, c, g, or t
  misc_feature (235)..(235): n is a, c, g, or t
  misc_feature (237)..(237): n is a, c, g, or t
  misc_feature (243)..(243): n is a, c, g, or t
  misc_feature (247)..(247): n is a, c, g, or t
  misc_feature (251)..(251): n is a, c, g, or t
  misc_feature (261)..(261): n is a, c, g, or t
  misc_feature (304)..(304): n is a, c, g, or t
  misc_feature (359)..(360): n is a, c, g, or t
  misc_feature (369)..(369): n is a, c, g, or t
  misc_feature (385)..(385): n is a, c, g, or t
  misc_feature (401)..(401): n is a, c, g, or t
  misc_feature (439)..(439): n is a, c, g, or t
  misc_feature (499)..(499): n is a, c, g, or t
  misc_feature (511)..(511): n is a, c, g, or t
  misc_feature (513)..(513): n is a, c, g, or t
cttnatggggaaaatgaatggacctgagtagctgaaggaaggcccctccctacccaaagactggaggcttctcagcctcaatttccctgtctgtananntgaaggctntgcctgtcccccantgctatcagtatggaaccccaantggggncccctattnaatnccgacnccccccaccgccagcagcngctcctccagcnanacccctnctgcnccccccacccctagcccttnancctggntggnctgnaccgctccanaggccaccagatgggctcctgaaaccctccccaggctgcttanagctcattctgctgggggtagagatgaggaggagggagtaagtaaaaccttggannagcaagtanaagcctggggggatgngtgtgcctaagtttcntcctccacaactgaatatagtggctgaaaactgggganatacttgatggcgcgaatgtccgttttctctcccttcccacctcctgcaggaagcagganggggcaggaagnanctggtaggcacagtgctttgcccctcctccccttcccttctggaagtcttggggcctcagtgcttgacaacaaccggccttgggaaataaaagactaggttgtttact

SEQ ID NO: 525464 - DNA, 658 bp, Homo sapiens
aaaaaatttaaaaaaaaaaaaaaaaaaaaaaaaaacaaaaaaaaaaaaaaaaaaaaaaaaaaaacctggtgggccgcttggcccaatccgattttagattgggccagcttaaggcagggggccgaatttggggctaattggccaaatgccccttatggggggcggtttaacatttaatggccggcggtttaaaaccgccggaatgggaaaaccctgggggtacccaaattaaatggcttggcagaaaatccccttttggccagtgggggaaataccaaaagggccggaccggatggcctttccaaacggtggcccacccggatgggcaatgggaaatggaaggcgtaaatatttggtaaaaattcgggtaaaattttggtaaaacaggctaatttttaacccaataggcgaaaatggcaaaaacccttaataatccaaaggattacccgggaaagggttggggggtggtcccagttggaaccagggaccccttttaaaggaccggggactcaaacggaaaggggcaaaaaccggtataaaggccgatggcccattacgggaccaatcaccttaaaaagtttttgggggccgagtccccgtaaagccttaatgcgacccttaaggggagcccccgtttgttgacggggcccggccgtgg

SEQ ID NO: 525465 - DNA, 132 bp, Homo sapiens
tcctcaaaagggcaacctgcttgtcccgcctaccctgaggcttctctcaggaggtgcgggcgccccgttgagaggcggggcgccgccggccgcagcccggattgggcgaggggcggggctgcggagggattg

SEQ ID NO: 525466 - DNA, 248 bp, Homo sapiens
  misc_feature (14)..(14): n is a, c, g, or t
  misc_feature (16)..(16): n is a, c, g, or t
  misc_feature (39)..(41): n is a, c, g, or t
  misc_feature (43)..(43): n is a, c, g, or t
  misc_feature (106)..(106): n is a, c, g, or t
  misc_feature (119)..(119): n is a, c, g, or t
  misc_feature (122)..(122): n is a, c, g, or t
taatcgcttaactntnccttcactggatacctgatacannngntcgtagtctgtaatatctttccatatttctgtcatagtatttcctcctatatctaattatatnacttattagatanggntggcgcttcttgttctgctaactttgcacgtccttttttagagaaccaaggcgaaacagtcaaaccaattgcgtcattcattacgtaaccatgaagcaaagcattcgtaagttgcgtcaccttgcc

SEQ ID NO: 525467 - DNA, 995 bp, Homo sapiens
aaggggccgtggcgctttagcttgtaacattacttggtccccttggtctgtatcaatttataacaaaaccgagggccccgatccgactgaccctgacctgggacggcgcccccggctccgcctgagaagggcgcaggaggggccccgaggccttcgcgcggcccacgcccgggaccctcccgcgcccggccccacgcgcgtgtacctactaggataccgcagaatatacagtagcgaacggacgtggagtagcggacccggagcaaaggacgtagccgcatagctagggtgggccgcccgagactgagaagtagcgccgcccgaacagctacggaggcatacccggagcgggtaagacaggtactagcaggcactacagcactgggaccacactaccgacagacgagtgcgagctagacgcagcagaacgcgacatgccgacgggacaacccggaccctagaagacgtacatagtacctggggaccgctagcacggcaagtacctagtaggagcaccgtaggtagtagacaccagagaggcacaccagatacaggaggcgatacgaggaacgcaagaaccgggacagcagacacacaactgccgtggcgaggaagatacgagagccgggcggacccttgacacccttggtagccacattcccaaggagcaccgaggcccaagagaagcatttgggacaggccgaacccacacagagaggatcaacggcgtaaacaatctcccatcggtgcacacaatgacggcccaggggccacacagggagttccctgggggccggctaccaagtcggaggatagcagccaacgagcgagggcaagcatgcgcaagggtacaacgctgtgaggaagccacgccacggcaggataaagatatgaagaacgaagggaagagaactatatgagtgaacccagcaacggggcaggctagagcgatgtgatgccagaggcccccaagtcaatcccgggtcaataaatgg

SEQ ID NO: 525468 - DNA, 176 bp, Homo sapiens
atcagctcggtccgctcttcgtgaactcctccatatgcttcaagtgcatgccctaaaagcaaaaaataacaaagcaaaacaatcacctggggcagcatccagctcaaacagcctccggagaaagggtgctgatgcaggtagggcacccgcccacagggggacacaggtgcagtgtc

SEQ ID NO: 525469 - DNA, 446 bp, Homo sapiens
gaggaagtagaagaacatcttccagagatgttgcatctgcatgaggaacatctggaacatttggttcatgatggttttccttaggttacttggtccgagcgccgcgcttggtcttgcacggggcgcattcggcagccgcaggaagggaacgaatcgcctggtcgcgctggcggatcaggcgatagatggcgcgctgttcggcttcccgccagttgttcacgttgaagtgcgtgaacccggtgttctcgggaaacttgtcagtggccttgggcagggaggcttcgaggggcaggtagatcaggttcgtcttcttcaggcagatgccgtccgagcgaaccgaattgccgatgaaagccgagtactgcgggtcgatgttgaggtcgtgcatggcctcttccaccagctcgtccttcgcttcctgcagcgtgaagatgcggtagtcgaag

SEQ ID NO: 525470 - DNA, 179 bp, Homo sapiens
tcagcgcaatctattctagagtccatatcaacaatagggttgacgacctcgatgtttggatcaggacatcccgatgtgtgcagccgctattaaaggttcgtttgttcaacgtattaaagtcctactgtgatctgagattcagaccgagaataatccagcgtcgtgtttcatatctactt

SEQ ID NO: 525471 - DNA, 247 bp, Homo sapiens
tccataggtttcataagatgttgcagctgtgcataatcagtctccaaaaagggtatgaagtaattggtcacaattgtcagttgactcatcagcaacacatgggttagcgtattcagtaacagcattcgctaatttaacatgatctagtaatggtcactgctcaagataatgaccaaagccaataaacaccaagacattgaaattgtcatctcacatatctttaatccgatgagcagccacacttgtg

SEQ ID NO: 525472 - DNA, 788 bp, Homo sapiens
  misc_feature (152)..(152): n is a, c, g, or t
  misc_feature (176)..(176): n is a, c, g, or t
  misc_feature (179)..(179): n is a, c, g, or t
  misc_feature (192)..(192): n is a, c, g, or t
  misc_feature (207)..(207): n is a, c, g, or t
  misc_feature (218)..(218): n is a, c, g, or t
  misc_feature (240)..(240): n is a, c, g, or t
  misc_feature (249)..(249): n is a, c, g, or t
  misc_feature (304)..(305): n is a, c, g, or t
  misc_feature (322)..(322): n is a, c, g, or t
  misc_feature (331)..(331): n is a, c, g, or t
  misc_feature (336)..(336): n is a, c, g, or t
  misc_feature (345)..(345): n is a, c, g, or t
  misc_feature (347)..(347): n is a, c, g, or t
  misc_feature (356)..(356): n is a, c, g, or t
  misc_feature (372)..(372): n is a, c, g, or t
  misc_feature (375)..(375): n is a, c, g, or t
  misc_feature (457)..(457): n is a, c, g, or t
  misc_feature (671)..(671): n is a, c, g, or t
  misc_feature (675)..(675): n is a, c, g, or t
  misc_feature (677)..(677): n is a, c, g, or t
  misc_feature (691)..(691): n is a, c, g, or t
  misc_feature (750)..(750): n is a, c, g, or t
aaaatggcgagtgaggctgcggggactcgctgagcagcggagggggagcgtgcagagccgctgcggccctcacagtccggagcccggccgtgccgtgccgtaggaacatgcacttttccattcccgaaaccgagtcccgcagcggggacagnggcggctccgcctacgtggcctanaanattcacgtgaatngagtactgcactgtngggtgcgctanagccagctcctggggctgcaanagcagcttnggaaggagtatggggccaatgtgcttactgcattccccccaaaaaagcttttctnnctaaatcctgctgaggnaaaaaaaangaaanagcagtaananaagtaaatnaaagctgttcggcaanaancattgattgggagcagcgagaatttaaaaagtttcctgcgatagggcacaaaaggagaaaaaaaaggaccccaaaaaggaantgtccttggaaatgctgctcagcaaagggcagaaagttctggtcaaagtgctaaattcaaaaaaaaatgaggatgtactggaggctgtagctgcaaagctggatcttccagaagaattgattggataatttagtctattcttagttcgagaaaaaaaggatggagccttttcttttgtacggaagttgcaagagtatgagctgccttatgtgtntgtnancagccttcggagtnaagagtataagattgtgctaaggaagagttattgggactctgcctatgatgacgatgtnatggagaaccgggttggcctgaacctgctttatgctca

SEQ ID NO: 525473 - DNA, 972 bp, Homo sapiens
  misc_feature (1)..(1): n is a, c, g, or t
  misc_feature (287)..(287): n is a, c, g, or t
  misc_feature (307)..(307): n is a, c, g, or t
  misc_feature (320)..(320): n is a, c, g, or t
  misc_feature (363)..(363): n is a, c, g, or t
  misc_feature (379)..(379): n is a, c, g, or t
  misc_feature (395)..(395): n is a, c, g, or t
  misc_feature (407)..(408): n is a, c, g, or t
  misc_feature (416)..(416): n is a, c, g, or t
  misc_feature (419)..(419): n is a, c, g, or t
  misc_feature (427)..(427): n is a, c, g, or t
  misc_feature (429)..(429): n is a, c, g, or t
  misc_feature (444)..(444): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (456)..(456): n is a, c, g, or t
  misc_feature (462)..(462): n is a, c, g, or t
  misc_feature (480)..(480): n is a, c, g, or t
  misc_feature (486)..(486): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (521)..(521): n is a, c, g, or t
  misc_feature (548)..(548): n is a, c, g, or t
  misc_feature (556)..(556): n is a, c, g, or t
  misc_feature (574)..(574): n is a, c, g, or t
  misc_feature (577)..(577): n is a, c, g, or t
  misc_feature (579)..(579): n is a, c, g, or t
  misc_feature (592)..(592): n is a, c, g, or t
  misc_feature (602)..(602): n is a, c, g, or t
  misc_feature (616)..(616): n is a, c, g, or t
  misc_feature (649)..(649): n is a, c, g, or t
  misc_feature (855)..(855): n is a, c, g, or t
  misc_feature (939)..(939): n is a, c, g, or t
ntataaaaacagcttataattgtatgaacacaaaatacaaacaaatacattttattgcacataaaaatattttaaatgaagtattgaagtattgcacgtaatagaattgatttaggaaagtcacaaacctattataagactagtattattctaggtctgaagattacagaatatttcctaatagagatttgccacatcacatattgcacattttccaacactattctatgtcttgcaaatattcctcatagtctttgcttatgtcttttctctgtaagacactgtanaaaagattataaaggcaaanaaatatgtaccancgaaaagagacctgtatacagcagaggaagtaaaaaaataaanacacgatcaacccaanctttttggggaaaaanaacaaagtaaannggcaaaantcnctaaaaananagaaaaataacaaanctnaanaancanaagcanttgatccataataaaaangctccnagaaattaaaggagattaaataanacnaaaaancnaagtaaccagccaaaattccattgaanacattcanaatcaagaaccaacatcnaantnctatccagaagtncaaatgcaanaaagggctcaacantgaaggtagtaaatcagcaataaatagtaagtncacgcctagttatttcattatttctggattcaaaataatataaagtgcatccaaaggttgcatagtcattcttctcattcttgggcatggttattggtcaacctgtgatgcttctagctcatggcaataaaagcccacagtgcagattttcctggaatttcttcctttttttccatagttctgtttgggaagaaaattcccaaganactataaaattttttttcacaaagtctctatgggagacttcggaccacagagcagcatccactggacacagatttccttgagtnccattctataatagtcaataagtgaacacgttt

SEQ ID NO: 525474 - DNA, 463 bp, Homo sapiens
  misc_feature (48)..(48): n is a, c, g, or t
cagggcccggggttctgatgagtctctcttcgcttgtaaagcctgagncagctgcctgggtgggactgggatgcaggattttttcacccctttcctttgggacttcaagagcctctggcatctctttctgccaaggcatctgaatgggtctgggttcctgttagcataatgtgaggaggtggagagacagcccccccccgtgtcccccgtgacccctgtccccacactgacctgggttccctccccgatcatttttcctgttccagagaagtggggtggatgtttccctctctgtctcaactttacgggggctgagctgccactttttacttccctcctgaaaataagaatttgaatataaatttgttttttcaaatatttgctatgaggggttggtgggttaattaaataagtccattcctgggagttgagagagcaaataaagacctggggaccttcccga

SEQ ID NO: 525475 - DNA, 1123 bp, Homo sapiens
  misc_feature (33)..(33): n is a, c, g, or t
  misc_feature (40)..(41): n is a, c, g, or t
  misc_feature (67)..(67): n is a, c, g, or t
  misc_feature (71)..(71): n is a, c, g, or t
  misc_feature (191)..(191): n is a, c, g, or t
  misc_feature (198)..(198): n is a, c, g, or t
  misc_feature (507)..(507): n is a, c, g, or t
  misc_feature (943)..(943): n is a, c, g, or t
aatcggtaaggtatatgacgagtaaatagtccngaagagnnaaaagaggtgtttgttgttcaacttncctnctcacactcgttagtgggagcattaatccggatttattgcatacgagaggagagcaagatgcgaagtcgtgtttacagaaaatacgtgggaagactctgtctgcactctagagagatgtngctagtngattcttcgccagacgatagtagctctctttcgcacaaccaagagaatgttgcttactcaggatactactcaatatggcgttcacgaacacaagaccaggatgtcagaaacctcttatagcatttgtagaatggcgccatgatttgacacacgaacactctagtagatggttcatagaaatgttttggcaaacataacctgtagtttacgcacacagaagcttcttttatacactcaaggtggtgatcttgaatcatacggaagagacaaccctaccctatgtgcaccttgagatacaacacataagcnggtgtctagcaattgtcgcttttgtttgaagaaagaaattgaaaaatataaaaattgtgccatcatccaataaccatttttagaagaagagtagctagtgaggacagaatagaagaagcgcatggagggcatgaattttcttaggttgggcgccccgtgggggcctaaagaatgggaagacactcttgcgagccggtttttactttataagtgaagaggataaaagttaaataaatacactaggcttcacttgaactcacttggcgctttggtgtggatcagcttatgaccaagctgggtattacatctccttcaaaggggcgggttcaagtgtttttcccacattattctccgtggaattaccccaggataacaagattgttaaccaatacggcccaaccaaagggcacacaaccccctaaaaagggcgcgggtntttttggatgttatttatttaaaatcccaccccccttgtctaatctttccaaaagaaaggagctctatgtaagtcaggcggaagacccaccccgggttatttaagttaactagcctggtcacctccggagtcgttttagagccctcttactggatacactcaggtcgtttactggaaatt

SEQ ID NO: 525476 - DNA, 181 bp, Homo sapiens
ggagatgtctgggggaagggaggtgcatgggtaatcagtgctttggaaggtgaatttccttgcagtaaaataggcttggtttactgggtcaggacaaccattcagactgacagtgccccttggacttccaaggcttcagtggacgagggcacagggatggtgattggactatgatatatcc

SEQ ID NO: 525477 - DNA, 167 bp, Homo sapiens
accctaagcagaccacagcagtgactgcctcaaaaaagtacttattgaacctgttacttttttgctttagagcaacagctacattagcttttcttcaagcatccagctcatctcatatgttaagatgcttgagtaaggaaactatagtgtgctgttgtcttctgcag

SEQ ID NO: 525478 - DNA, 764 bp, Homo sapiens
ccccctttcggaaacattgctctgcgagtcctcccgtttaaacgcattcaatttttgggtctctctctctctctctctctctctcttcttctcttctctctctctctctctctcctctctctctctcctctttctcccccctctctccctcctctcctctctctctcctctcttctctgacactctcttctctttctcttttcattacatattataataggttgttccccttcttcttctcctttctctcctttttctcctctccctcctgttgtctcctttccactcctattccgtgcagaaagagagagcggctacaactttaaagaaaaaaaacaagggaggcagcgacggaggaggaggccccccctttcgtattcttcttatcgttttttatacatatatgatttctgcggcgggcggcacgcgtgtcgccctgccgcgctgtagaacagcccgccccttctccatcctacaccctcactccaaactagccacagcacccgacccaaccccctccccctcctcccaccacagcactctgccgcagcagcccatcctcctcgcccccctctgccgcagcactaccctttgtctctcctacaaccccctcgtcccatctgtttgggccgctttcgggcgcgcttcccctatcctgtggttgccgttcttcctgtacgctttgttggtggtcctcgcttctcttgtgtgttcgcttactgtcggtagagcactttgtgcggtggctcgttcatcagctgcgg

SEQ ID NO: 525479 - DNA, 836 bp, Homo sapiens
  misc_feature (1)..(2): n is a, c, g, or t
  misc_feature (528)..(528): n is a, c, g, or t
  misc_feature (580)..(580): n is a, c, g, or t
  misc_feature (590)..(590): n is a, c, g, or t
  misc_feature (830)..(830): n is a, c, g, or t
nngccctgcaggaattcggcacgagaaaaaataattgaaatagtacatttaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattaccattttcaaatgtttaattttttaaagaaaattaatattctatttttggtaggcttctctagaaatngcagctttatttattacccccattctttcaagtccttggaaaataacatatnaagggtacangaaataacacatgatggaaagtcattgtgacgccatgaattcattgagttaactcattactcaaattattttatagacacctaggatctcaagattatattaatggtagctctaaagtgattgtctacatatgcgtgggagccacgatttagccttttgcaattcagactctggtgattttcttgacagagatgcagtttttcaattacaattggtttacatgacatatttggttcttanctggcg

SEQ ID NO: 525480 - DNA, 361 bp, Homo sapiens
cggttagtgcatggctactactaagggggtggaagtcttcaaaatatttcttatcttttctttttttgacgtaagagtctcgctctgtcacccaagctgaagtgcagtggcacaatctcgactcactacaatgtccacctcccaggttcaagcgatcctcccacctcaacctcccaagtaggtgggactacaggagagcaccaccatgcccagtgaatttttgtatttttgtagagaaagagttttgctacgttgcccaggctggtcccaaactcctgagcttgagtgattcgcctgcctcagcctcccaaggtgctgggattataggcgtgagccaccacacccagccattgcactccgg

SEQ ID NO: 525481 - DNA, 340 bp, Homo sapiens
ttttattcttttgtgttttttgagcgagtctcgctctgtcgccaggctagagtgcaggggtgtgatccttgtgtcactgcagcccccacctccttccaggcttcaagcaattctcctgcctcagcctcccgagtagctagtaccacaggcacgtgccaccaaggccagccaatatttttgtatttttagtagagacggagtttcaccatgttggccatgcatggtctcgagcacccaaaatgtgctgcagttttagatcttaggcatgaacgaaagaaagtcagtcagggatggcactgaggtattggtcctgcagggcatgggaggactgaagctgctg

SEQ ID NO: 525482 - DNA, 378 bp, Homo sapiens
  misc_feature (102)..(102): n is a, c, g, or t
  misc_feature (315)..(315): n is a, c, g, or t
tgtaggaatacggcacgaggtggggtttcaactcgtactccgtgggcagaccccagatgccagagctcgacggcagacacggacaccatacctcagaatagntatatataaaagggacacggattgtgacaggttcaccccatttggttctaaccccgctggccaagaataaggtctgtggtgtggtctgtgttggttttgggttctcccttgtggcaagtctcttctgggccaactgggtggctgtggaagactgtgaggtggcccaaccacaagcatacctattaagagaagcccagagctttcagaccccanttcgctcttctctggccccacatagcctccttcttcggtatatttccccacccccgttttttt

SEQ ID NO: 525483 - DNA, 1253 bp, Homo sapiens
  misc_feature (800)..(800): n is a, c, g, or t
gtggcggcttccagaaccgagtgggagtgcagcggtggagtgaggcaactaccgacgaggtttcaacgtgcagtcggagtgtggtggctactagccatgaaccagtatgggggtaacaatcgtaccgggaataacatacaactcctaacatatcagaggctagctacaaccggtgctccccagcaatcatgctcgccatgctgctgctaggccatccgaccaccagcagtcaccatcccttcagcgcacctgtcaccaccctctcgtacatggcctgcatcggaacccccctaggggccatgcacctacaataataactgtaacattccctgtgctcaatgcgccaaatatccttgctacccccaccgtcaagcatgctacggccctccacagccgatgttacagcctatccacccttactaaccatggtagggttacatccaggggctacatagccccaccgtctccatctctactaatatctgcctttcaacttctgtggagctatcgtgcggattacaatgccgagaccaccttattactaccggtcgcagaggctagaaatcgacttttcagatcttacagaagtcctggttgatttcccaaggtgctttataccctttactctggtaaaaaggcgtacgaatgacttgggtcacttgggccttccataggcacgtttgacctgcatgtattcagacgacttgaaaccgacgactatttgtacagtacattgcctggcaaacttgggtgcttaaccttaagggtacccccttctgtcttcgtgttagcactggganttccaccacagctgagataggctcatgagcttgacttccgcaaccaatgatggctcgcaaaattccccatttgtgtaacgtttgacaagggtatcgtggcgcgcagataatgacccatacaggtgtaacaaccagccattcgtggtggtgcagttgaacaccacatcaacaaggggcttgggttataattgtaagacacatacaaacagaagcaagactacacctgaaaaaatagacaaaagcagggcgcgccgccacaccaatccgacagacctggacgcataacaagtatatataacgatactacataagagacatagaccacgtacagttgtcaaagaatggaagcagacggccgtgaaaatcaccgctttgctaccacaccgcattactcgtggtaacaacaatacaggtgatagcagcccggaataactatcagacaaatagtggtga

SEQ ID NO: 525484 - DNA, 126 bp, Homo sapiens
tcgctgggggcgaactgtgagtggcacttcagggccaggagaggcacttggggatgtgggtcaccggcatgctactctgggcacgctagaatgctactagatgccctccacatgagcggtacttgc

SEQ ID NO: 525485 - DNA, 475 bp, Homo sapiens
tcgagccggtaccccgtagtatagaagtttcactagcatatagtagaatcggagaagcctcggtgaatgaagtcatgtttgccctaagcccctggtccctctttatattggcgagtggataaactggaaagtaagtgaacgtctactgtaccaaagctagttcaatatagaaaacaggttctacaaggattaaggaacatctcttggcccacagaagattcatgtggatcctgtgttaaacccgtttcatccatgtatgaaagtgattcaaccgttaagttagccatttattatataaatggaatacttcttccatatggtggcttttagatagatgggcagacctgtccccaactccttccctgttgaccatggacaatggagggttcgctgtataaacttgattgaagggttggcctttagctggggtggattactcaggcagcaatgtgctattgaaacttctaaaactagg

SEQ ID NO: 525486 - DNA, 112 bp, Homo sapiens
ttcggtaccggtgatgtagggctgggcagcttcgggtgtaaggtgaacggtgaaacgtcagttactcctctagtcccatcatctccctttatgatgtgtaaggtgtagggat

SEQ ID NO: 525487 - DNA, 237 bp, Homo sapiens
tctagaggatcctatggttgctccatcagccaatgctaagctggttcattagtacgaaaggattagaagcagcacttgttgtagtagctggaaaatgcccatgtagcagggaaaaagcacaggagaagtggtgtcagcgtgttgtaaggtaacggtgttcaatgcaagcactaaaggctaagagccaagggagtctggggcactagtgagactctgctctctagtggtacattagga

SEQ ID NO: 525488 - DNA, 207 bp, Homo sapiens
caattgctttttgtgatttttaaaaaatggggcacccgtgttattactgtaaaatgtttttaaccaaaatttggtgaatttccctagtctccctcccattttgttaatgattcaaaattgtcttgggtccactgttaaatttttgtcctttgatttaatttgcttaatgtattaaagttttctccccccccctcccaaaaaaaaaaa

SEQ ID NO: 525489 - DNA, 542 bp, Homo sapiens
  misc_feature (157)..(157): n is a, c, g, or t
  misc_feature (162)..(164): n is a, c, g, or t
  misc_feature (316)..(316): n is a, c, g, or t
  misc_feature (351)..(351): n is a, c, g, or t
  misc_feature (363)..(363): n is a, c, g, or t
  misc_feature (538)..(538): n is a, c, g, or t
aatgaccctcatcaatggcctgtggagtaaggtcaatgttgaagaggttggtggtgaagccttgggaaggcttcttgttgtgtacccatggacccatagattttttgacagctttgggaacttgtcctctgcttctgccataatgggcaacccaagngtcannncccatggcaagaaggtgctgactgcttttggagagtccattaagaatctagacaacctcaagtctgccttggccaagctcagtgaactgcactgtgacaagctacatgtggatcctgagaacttcaaactcttgggtaatgtgctggtgatngttttggctagtcacttcggcaatgaattcacagntgagatgcaggntgcctggcagaagctggtggctggggtggccactgcgctgtcccacaagtaccactgagccctctctctagctgtccagcaatcctgtgtgtccgctatgcctcctttctgcacatgaatactggactgttccttgaaagcacatcatgtttaataaagatcatccttcctggtnatca

SEQ ID NO: 525490 - DNA, 144 bp, Homo sapiens
attggaaagaaaagtttttgggtggagcccacttaggggctgaatgacgaaaacctatgtgaactggaagatacagatgtttcttggggacatcacacacacattggggaagaatttttccatatgttgacctagtgatatatc

SEQ ID NO: 525491 - DNA, 638 bp, Homo sapiens
cgtcttcgtcccatcagagaatactataaacacctctacgcaaataaactagaaaatctagaagaaatggataaattcctcaacacatacaaagctcccaagactaaagccaggaggaagttgaatctctgaatagaccaataacaggctctgaaattgaggcaatagttaatagcttaccaaccaaaaaaagtccaggaccagatggattcacagccgaattctaccagaggtacaagaaggagctggtaccattccttctgaaacgattccaatcaatagaaaaagagggaatcctccctaactcattttacgaggccagcatcatcctgataccaaagcctggcagagacacaacaaaaaaagggaattttagaccaatatccctgatgaacattgatgcaaaaatcctcaataaaatactggcaaaccaaatccagcagcacttcaaaaagcttatccaccatgatcaagtgggcttcatccctgggatgcaaggccggttcaacatacgcaaatcaataaacgtaatccagcataaacagaaccaaagacaaaaccacattgatttctcaatagatgcagaaaggctttgacaaattcacaacttcagctaaaatctcatcaataggtacgtg

SEQ ID NO: 525492 - DNA, 341 bp, Homo sapiens
tccggggtgttgtggcaggcgatcgcggaccagtcaccgtgccaccggtggtggtcacattgttgacctggagggtggtgggcggccccgtggggtccgcggtgaacagatccgaggtgaccgggaggttgccgatgaccacgttgttgtggtctcccagaccggcaccaccgacggcgcggatatccacagcagaggtaccgtgtgcggggttgcaggtccacttggtgccgagtcgcatcgatgttggtgtcagcaccaggaggccgctgcgccgggaagggcttcgtggagccggagtcagcgccgagcaggaggcgcaccgttgtggtgccactcgg

SEQ ID NO: 525493 - DNA, 100 bp, Homo sapiens
acccagaactgacttcaaaggcagcttctggacaggtggtgggggtcgcggttcccaagaggaggcaataaaccttctgtgcagaaaaaaagaagaaaaa

SEQ ID NO: 525494 - DNA, 675 bp, Homo sapiens
ggggagtgtgctatcttcagagaggaatagctctttagttctttgcaggaaggtagagatcaagacactttttcagaactggcagtcggtatcagaattcctcaagcaggccttgtttattgaaaatgaagagcaggaatatgttcaaactgtgaagtctcccaatggtggtttttgatcagcggtgttttcctatcctaccttcaatccatcctcggatgtccctgccttgtataaggccatagtggttaaaggagtggatgaagcaaccatcattgacattctaactaagcgaaacaatgcacagcgtcaacagatcaatgcggcctatctccaggaaacaggaaagcccctgcatgaaacactgaagaaagcccttacaggccaccttgagggaggtctgttgtagctctgctaaaaactccagcacaatttgatgctgatgaacttcgggctgccatgaagggccttggaactgatgaagatactcttattcgagattttgtccatcaagaactaacaaagaattcatatcctttaacaggttctacagagaggaactgaggaagatcctggcccaaaccctaccctcaaacacatctgggagattttcggacgctgggcctttttttgctaagggtgaccgaactgaggactttgggtgctgctggcctg

SEQ ID NO: 525495 - DNA, 266 bp, Homo sapiens
ggcagtgcacgctgcagtgctgcatggtcgagctctagaaggatccccccaggtagacctaacgggtttacatgaggaatggtagaagtggtcttttgttgaaatgtagttgcattcagcatatatgaattgtcttaaatattttaggggatactcccccgactttttaaacagttgcataagatcgtggtaaacatctctgtatatcttcactaccgtttcaagaatcgttgcgttaggagttatggtctagcctgagggtgacc

SEQ ID NO: 525496 - DNA, 162 bp, Homo sapiens
ccccaacacaaaaatataaaaatcagctgggcatctgtaataccagctactcaggagctgaagtgggaggaatcacttgagcccaggagtttgatgcagcactgagccataatcatgccactgaactgaactccactccagcccaggtgacagagcaaaacc

SEQ ID NO: 525497 - DNA, 153 bp, Homo sapiens
ttacaccccacgatcacatctccccagctccactgccacaaccactgcctgacaccctctccagcccagccccaccctttttttgtttgttttgagatggagtctcactctgtcgcccagactggagtgcagtggtacgatcttggctcactg

SEQ ID NO: 525498 - DNA, 190 bp, Homo sapiens
aactgtcacgacaagcagcacgaccacccttcaccaaccaccacccccagccgctcaataacgcaccacaaccacccctccggcaagcaccactcccagcagtggtgtatgtaacacaagcaggtcgtggaggtggacgtggaggcggaggtggggtggggggaagtgagggtggtggagtgtgtggggg

SEQ ID NO: 525499 - DNA, 1558 bp, Homo sapiens
  misc_feature (322)..(322): n is a, c, g, or t
  misc_feature (1558)..(1558): n is a, c, g, or t
tgtgtggggggggggaaacccaaaaaacttctttattatcaccccccgcggcgcgcgcgagagggagcgccgaaaatacccacgcgcggggggggggggcggggagagtgcctcgtcgggagggggcccgcgcgaacaaaccacccgggggggagaggagacacagcgcgccgcgcgcggagggagagagagagagggcgccgcgcgcgcgcgcggtgggtgggtctctccatccccaatgtgggtggcacccttcactcgcgcgcggaggagagagagacacacgcggtggacacaccgcgctgtgcactcgcgcgcgggngttgtgcgcgagtgcgaagagagagagagcgagagagagagcgctctccgcgcgagtggcgactctatcatctctctctctctctctctctctctcgttcgcgcgaggcgagcacgcgcgctgctctctcgttcgtcgcgtcgacgcgcgcgagagagagagagagagagcgagcaccacactctctctctccgcgcggagagagcagagggtgcgagccacacgcgacagacaatgagagcgcacccctctctcgtcgtcgacgcgcgcgtgcgacgcttcgtaccgagtagagaacacacaacacgcgcgcgaggcgcaccacacgacacacacgcgacacgacgcgcaacgacgcgtagagagacgacacccacactctactacactcgtcgtcgtcgagaagagtcaacatcacgcgaccgtagtagtcgtagaacaacacaacgacgcgacaccgccacacatcgtcgcgacacacgacgcgcgtagacgcagcagaacacagagcagagagcaaggcgcccccctcgcgcagcgagcgagagacaaaccgaaggagcgcgagcgaacacacgccgacgctgagtgaagaagctaagatgaaaaccaccaacaaggaggcggagcgaaggcgatgcgcagaacaacccgaaagaaaagtagataagcagcagtagagagcacccgacgacgcggcgacccatcaacacagaaggaagatgaccaaatgcggacacaccccgcaagaacaacaacaccaaacaaatgaatatatacaaccaacaaccacgcaaaaaaaagaaagacgcacaaacagtaaaaacaaacaaccacacgtgggacgaataaacaaagcacaaacaacgacactccttcctcttgtgttggcggcgcgagaccaccaaccaagtagcaatacagcaggaagccaaaccaccacccacaccccccaaacgaccaggacaagaacataacctacaccctaatgatggcgcacgcgacctcaccatacgccaacacataacgctcataggatagaacagagaggaagacgaaccacacacaaacacgccacctacacaccacgcgaaaacgaagaaaaaaaaacacacaccaacacaagcgaagtgcgatcacatacccacagcatgagaagcaatgagcaacaaaccaaacaaacaacagcatccccacaacaacacaaagcgaaaaaaacacaaaagccgaaggagn

SEQ ID NO: 525500 - DNA, 726 bp, Homo sapiens
  misc_feature (424)..(425): n is a, c, g, or t
ccattgtttgggtgtttttttgtgtggccgggggggggccttgtaaacaccccaccgccctttccggtcgcgcccttggggccttgtgcccctgttttctggggttcccccttcgtggggaccccgtttccgccttgtggagtgtatcccccccccccccaccccccgggcccgcggttttgtgggggggacgagaagggccccctaccacaccccccccccccgcgggtggggggattttttatataaggggggccccacggttttccccctggaaagggggcgggggggccccccccatttttttgggtttgctcccccctttggccccccccgctttcccccttttgctcccgggggggttttgggggggggtgggggggggggaccccttttcccccggggcccccttttcccttttttnnattttttttcccccccccttggggggtttggccccccgggccccaaatttggccccggggggttttttttaaaaaggggggttcccccggtttccccgggggggttttttttccttaccccgggtttccccccccccccgtttccccaagggggggggtttcggggccccccccccccccccgggctttttttttttttggggttttttttttttttttttgggccccccccctttgggggggtttttttttttttgggccctttttgggggttttttttttaatcccctttgtttttcca

SEQ ID NO: 525501 - DNA, 551 bp, Homo sapiens
tatgagcacgatcgaggagctcatcgaggagacagaagccggtgcggctatggaggagacccgtggtggtggcagtggctacggtggagaccgaagtggaggctatggaggagacaggagtggtggcggctatggaggagaccgaggtgggggctacggaggagaccgaggtgggggaaacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtgga

SEQ ID NO: 525502 - DNA, 935 bp, Homo sapiens
gcggccaatggcggaccgatgcttcacacgcgttgccgggagatgcggtcgcattcgtgcctctgcagtatatgaagctgggcgcgtcgaggactgggatttcaaatatgcgtgcattagcagaatgactttctcaattctcccccatgattgaactgttcggattggctgggaacgtgtggacagacaccgtcttgctgaacgtacagaaaagcatccagactcagcgaagataggataattatcaagaccaccatgccggaggcagtctagcgaggggccgcgttccacccatctgcgggatgataagtctcaagacaccgttccgaggcgtctagctcgattcgcccttcgcacaccatacagtcttcccacactcagcagatgagtacatatcgaaagacaacctgcctgaagcgttctggagagggggccgagttccaaccctcagacgggatgagtcactctcgagagacacctgtaccgaagacgtcaggactcaggcatccgccttcacaaaactcaagagctccataccttcagcaagatgaagtaagtactacagagataaacagccggaggcgtactggaggagagacagaacactcgcaagagacgcgcccaggctgcccagacacctactaaacgagaattgcatcaatacatcaaagaaaaagtgataacgcgaagggcgattgacgtcctactcaccccattaccctccgcagtccaaacatacaaacgctactagtggaaatgaacaataaatgcaaaggcaacaaaatgaccggaaacgaatcaagatagagagcacgggtctcgcagcactatctagaggacgtcacaatacttcaaggcacaccaatacacgaaaggtcaacaaataaacctcaccattggcacctatcaagcttcgagccctcacggcagaagga

SEQ ID NO: 525503 - DNA, 536 bp, Homo sapiens
ctagtacggcgcagtgtgtggatacggtcagagtccaacagtgcataccccttcgagggcaacactccctatactgctcccactaccagaaacaactcgccatttcacgagtgtacactgctatccatattcatgcatataatggggattctatgtgggtcgtgtattgaagatcctttcttctgatacatttgaattaaaatatgacagtatctggatctcaaatttttctttcacgctagtgcgagtagataagatgcagagttagtgagtaaacttgatagggtccatgaattcaatgaactgaccaccacctggatctggtgagaaccagctcatctatgatgatactagaccagcactacacgtacgtagaatcacttctaacgtttaatccatcaccaatttcaattcctaaacccaaaaatctgtatcagacaagtctattcccaaaacagtgcataagcaggtgtattacataagccaccaccagtgcatcctagtctacccttaccgaaggcactagtaggcctctg

SEQ ID NO: 525504 - DNA, 483 bp, Homo sapiens
tggggtatacagcaggcctctcgctgcacagtctggctgcggtgccccacatagtcccggacacaggagtacctgggaccccctactcctttccggtcctatccttcaggtcacgcagccctgtactgtatccagcaccacagaaagctcagtgtatttcctcgtgctggctccggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggtaggtaggggagcttattcttttctttccttttttttggtttaggtttcggttatggttattggtaacatgtaaggagttaatgttgcaaagagtagtaacatcttcactttctgaagacacttgactttaggaccgatgtatctgtgacaagca

SEQ ID NO: 525505 - DNA, 1657 bp, Homo sapiens
  misc_feature (313)..(313): n is a, c, g, or t
  misc_feature (422)..(422): n is a, c, g, or t
  misc_feature (1063)..(1063): n is a, c, g, or t
gtttgtgttgtgttttgttgtgtctgttgtgttggttgtctatgtcttggtgtgtgattgttgtttagtgttcgtgttgctgtgtggttctttgtggttgctgttgttaggtatgtgtgtgatggggtttagcttgtagtgtgtggtgcgagctggttgttgttgttgtgttgttgtgttggtctggtgttctgtttgtgtgtctgattagtttcgtgtgttgtgtgtgtggtgtttgtttgtgtttagtttgtctggctttcgtgtttatggttttgtttttctgctgctgtagtgggcgatgggtgcagcncctggcagttaaacacatccccgtggagggtgtgtagacgcgccaccaatccccctgtttttggggcacccctctattggaacttctcgcaagggagccgcccccacgnggtgtggttccacaaaagaacgcacgcccttttgtgtaacacgctcggctccccgtgttactcgtattaacccgggtcctctaaaaggtgtatactaagaggcctcttggggtggtcctaaaatttcggccacaccaatggggtcgcaatacaacaaatcgtctgttgaatgtatcccatcttgtcctttggcccaaaattccatatgcgttgaataccacaccccccccgggaagaagttgtccccgaccttttttgggtggaaccccggggatatctttggcccacatttctgggtttaccaagaggtatggctatgactcgtatacccctgttaaaattagctctggtgtcttcctatggctttagcgccctaggatccccagggtgctcacctggcgcccagaatatgtttgtaaaaaagaagcgtcttggcaccagaattttacccgggcgcccaaagactcccccgggggtggacccccctattgtggatcgcagcgccacaccacagtttgtgggccccacaaatttggtgtatatgatgtaactcttacgttgtaggggcaccaggaatttgtggagtcccccgagttgccttatgtgagacgccgtgtgttgcccacacgaagtgtacccanggagtgtgggagaacacccactatatatctgatgttgctgtcatgcgcaaactgtgtgccacaaggcccgacacctgggggataaagggagatattttatgtcaccacgcataggatattgtgtcttgacaccacgaaatatgtgtcacacggggatattttggggacacccagcgggggaagggtggtgccctgagttatatgttcgcgattggacccccccgtgtagattaatactttgccgaagctggctctttgggagacacccaatgtccaggcaccatagaggcccaaatgtagtggagatgtctcctctttaccacaccgaagcgcccagaaacctgacaatatgagtgtggatcttgtaccggtccctttggagagtgtgttttggccgggagagtgaaacccttgggggaaaatgctaggagattcttttttgtctgtttttgtgtcttcattttctcgctccggaaaattttttaatcctcctttggtggccattactgtattcccaccccatagcgtgtcgccccattttccaagtaatctttactggccccacttgggaatggggaaattgcctttaaaaaa

SEQ ID NO: 525506 - DNA, 448 bp, Homo sapiens
ataaatggtcagaaaaagacaaaaagaatatttcgacacgtgaaaatgataggaaatcctgattccagtgtccatgagttaaagcttccggaagcagccgctccgtccacttccacgctgtctgtggctgctctcgcactacagcggcaggcttgatgagctgccagaggccacccggcccccaaggcctgagccattgtctgtcctggtcagaagcttgccagcccttccctgggcacaggttggcttggctgttgtatgcagcctcatgggggcccacagtggctgagtctgtggcctcctggcgcctcagcgacggccaccgcgtccttgctggcgcgtgctgtgtgcctgccctcctgtgcatttgtccacgtttcctgccaggtcatttgctccccacactcacgcccagccctctgctgcttgccttctgcttgaaggacgc

SEQ ID NO: 525507 - DNA, 629 bp, Homo sapiens
tcacggtcagtacacccccgacttatgtacgaggcctgggtggcgcccacgctggagactgtggagaagggctgtcagactgaagccagctctgagcggcccttcagactgcgaggtgtgtggccgatcctacaagctcgccggcagcctcatcaaccacctggcagagccaccagaccggccactttggctgtcaggcctgctccaagggcttctcaaacctcgatgtccctcgaagaaccaccggcgcatccatgcagatccccgacgtttccgctgcagcgagtgtgggaaggccttccgcctgcgtgaaacagctggccagccaccatgcgggtccacattggaacaggctgtggggtgtggggagcacccgaagaggcagagctcgaggtaacgatcgaggccttccgctgtgaggcatgtgcggagctggaccgtatcagaccacgccgtgcagcctcctgaaccatgcggtcgacagtcacagagacgggccatgtacagcgtgcccagctgcccaagaactagtccaaccgcatggcccttaaggaccaccagaggctgcactcagagaatcggtggcgacgggctggacggtccaggcgcacaggtgtgcgttgcgccct

SEQ ID NO: 525508 - DNA, 333 bp, Homo sapiens
tttgaagagacgggttttcaccacattgcccaggctggtctcaaacttctgagctcaagcaatccaccacctcagctaaaaacataaaaaactagccgggcatggtggcaggcgcctataatcccagctactcaggaggctgaggcaggagaattagtgtgactacagtgatcattttattatgaggtcagaagtagaaaaatgagaaaaactggaataattcgggtaaaatgaatagaatagactttattttgtggacttattttaaatttcatctaataaagataaacttggattaacaaaatacttctaggaaaattctgaaactactcc

SEQ ID NO: 525509 - DNA, 722 bp, Homo sapiens
taaaaatctcaacactcagtcattaatcccgttttggcaaccaaagcaggtaataaatattatttagcacttggtttttacaaagaataaaacagatgatacactctctgcgaggggcgggtgcgatcagaggaaggggtgttacacggcagacgctacaaagcccagttggcaacgcaggcagcgccgaggcggctggcacggaacgcaggaagcacgtggaggagtttaccattggggttaaccgtggcaaaaagtaaaccaaaatagcaggaaagcgggcttagactccgatggggctggcagtccacgtgagcaacacagctttagcatggggcacttaccctcatcatggataacatttacacattccaaaaaagcaaaatttgtaaaaagccaaagagaaacccccaaattaacgccaaaggtggtttccacgagcaacgtggccttttaatctcgtggtaagcgttctcagggtaccaaaattacaccaaattcacttggggcttagacgaagggacacgatgagttcggtgggcgtagttccctactttacacactaataactacaattgcacccggccccgtgtaaaactcggcgagctatgggggttatttccaatcccacaaaggtgggttcctaactcggaagtgtctataacactggctcataacgtgttgaaagaaggaaacatccacgagatttatcgagaaaaacc

SEQ ID NO: 525510 - DNA, 104 bp, Homo sapiens
gggtacatggagtgtacagcaaagaccatagatggacgtgagagaggttttcgaaatggctacgatagctgctcgtgcgcacgctagcaagtgggaaggaaaaa

SEQ ID NO: 525511 - DNA, 332 bp, Homo sapiens
gcgctcgccgttgctgtaggtggcgtaaactttgccatcgtcatcaacctgcacaccattctgagtcgcggaggcgtagccgttggcggcgttggtggtgaccgaaaattcagagccgtattgcgtacaggtcgagtaatcaacggttaagtcgatgggtgcggcagcgtcggtttgaaattcaatggtctgcggcgtggttggcgaggtcagcttcccggtgttcgggtcgaaggttaacgtcgtcgccggaacgccggtctgctgctgaccgtcgaaggtgtactgcacttcccaggagttgtcgctggttttggtgaagtactggcatg

SEQ ID NO: 525512 - DNA, 520 bp, Homo sapiens
gatccccgggcagtaggatgggtaaggggctccaacctcgtgggtgcactgtggatggtgcgccccatgagctggaattgctgtctgtgtcaaactccacaggcattcttggctgcactgcgtggatagtggatggtgctgcccccaacatgtgactggccctgtctcctggcacaccccagccccggccacatgaaggttcctttggcttctcctcagatgtcttcatcatggacactatcgggggcggggaggtgagcctggtgggacttggcagatctcaccgtcaccaacgacaatgacctcagctgcgatctgtctgacaggacagatgcttttaagaagacgtgtaaccccaagttcagcctgcgctcgcgctaatgatggcattcgttccctggccttcccacccacagccaggtcgggtctggtcacctgcctccgaggacgggacgctcaaagctctggaagcttgcatgaattgcgtgtcacggcccacgaagaatgcggcgctagattg

SEQ ID NO: 525513 - DNA, 715 bp, Homo sapiens
cactaacgctacaggtagaccacggtgggcttggcaacaggtgtcttgcgcagatgctggcgttaccgctagaccaaggagcgctctggtggccctgtccgggcataacagaaagctcgcactcttgtcttctggtcactcctcactgtcccctcagctcctatctctgtatggcctggtgtttcctaggttatcattgtagagcgaggattattataatattggaataaagaataattactacaaaaaaaaaaaaaaaaaaaaaaaaaaaaaaacaaaaaaaacaaaaaaaaaaaaaaaaaaaaaaaaaaaaaaaaaaaaaaaaaaaaaaaaaaacaaaaaaataaaaaaacacaaaaaaatcaaaaaaaaccataacaattcatagggggaaaccaacaacctctcatacaacaaaaaaacctttgggccccctgctcccaacacttccttatacgccgacaatttttctctctggtgcccaaatttgggcctctttggacaatctccccataaaggggggtcgtataaaaaatccgcggccgcgtgtttaaaaacaccgctggtcgggaaaaaacctcggggtccccctacattaaactcgttcgcgaacaacaacccctttttccacgctgggtctatattaacaagagcccccccaagtggtctttcatggtgcaccccctctgggcgctagtttggcccgcttatttct

SEQ ID NO: 525514 - DNA, 167 bp, Homo sapiens
aatttgcccacagaaccctctaaatccccttgttaaatttaaactgtttagtccaaagaggaacagctcttttggacactaggaaaaacctgtagagagagtaaaaattgcaacaccatagtagggctaaagcagccaccattaggaagcgttcaggctcaacacca

SEQ ID NO: 525515 - DNA, 1559 bp, Homo sapiens
ctcagagtgtccgtgacgcgctaccgctaaaatgtccaaagatgggagacaggaagagagactacatatccaagcattgctcgatcgagtagggcatcgacggatacgcattcgggcgacgctccaccaacctactggccaactctgcatctatacaattgtccggggggcaatcggtacaaaaggaaccgatttgaacagaccatttagtagaagagagcgtcatcgacgtgatcagtgaggacacaggagactcgcttcatagaatcattgccataggtggtccttcgcgtatgatagacttggacgaagcgtcgcatccggtaaaaactggctggatcatcgacactcatatcgagtcatctctcccctagggatcgtggcacagtcttgcgaaaaccggagcatagcgcttacatgatagtagaaagctactcaagttgcagaggcccctccagggtacacatcagcaaggactctatgcattcccaaaagacacactccataggatgttaaccttgcgagaaccattgcttcctaagacgcatttcgtgaacattgtacggcatttggtacacctacggacttttggttacgcacttaggcgtgggggcttgctaacggagcccggcatttggccggaacaggcaaagcggttagtacggtacactagaggcaataggtggcgcagtcgaaaggaactcccctgtaggaaagagccaggttgcttccccttttcctaggggcttgtgaacgacacatccgctgggcgggattggtggacttcccgaggaaactacacagtgtggttgcgaggtgggctgcaaagccaaacacacttgggtatttgccgcaatcgtaggggggccggtgcccacttaagcaaggacccaacgggacacggccacggactaactggcaggacgcaaaaacttgggttggacgacccggacacggatacaaagagaccgtcctaattaacaagtactccaatgtgaagaccacctttcgggcctacactaaatcgcgcctggagcctagcaaaggttaagcctggtgacgtgtagaccacatatgcactgggcctcggcacattcgcgatgaaccatccgatttgcgtgggaagccacaaagtggcgtcaacacaatgggccgttgaggtgtttcaaccggtgtcgtcggccaaagaatcacacccaggtagagagctttacactattacctgcgttggaacacctacacctgactttgaaaggtccatagagacgtggaaatagataacaacaaaatcggttgaaaaataggacagggacccctgtcgccgtgagcatctccgaaggtaacgacacaacaaagagaggcaatggcgacagaaaccggcaagaccgaaagaagaagaaaaaaaacaagaccaagaatgaggcacacaatgaacacaaactaacagcagagatacacaagaaaaggaacacaaagcaagaaagcgaacggaccaacaaggacaaccgaaaccgacacgcaccccgcgacaacacagcacgcgagaagaacccaaacaa

SEQ ID NO: 525516 - DNA, 112 bp, Homo sapiens
acatggcctggtctctgaggagtgagttgcatccacataaaacccggcatccagatatgacatggaccgccagttctcgttctagcaagcctcgttcaacgtctcgtgtgtc

SEQ ID NO: 525517 - DNA, 1536 bp, Homo sapiens
  misc_feature (558)..(558): n is a, c, g, or t
  misc_feature (1059)..(1059): n is a, c, g, or t
ggtttgcttgagcagggccatggtgtgtactcaaaggattgccgtcacctgctcccatgtcactctcggtgtgtgagcttcccttgtccttcgtctgatgctcttcagacttaagaatagaaggcccctttcaaaggggtttgtacgctctggctgcgagggaacctcttcgcttctatatccttcccatgagtgctcgtactcgtatacgaagattctctatccgcgatagggtacagggggaccaccgaatgggaataacaaggtaccctcgtagcgatgccggatagctctaaggcatgagagaatagacctgccattcagacgtgagtgctgttccaacttgtcctggaaggttcctggattagagatcctgcgagtggccgcgttagtcgaggcagacactgtgcagtggactccatgtgtgacacagcgtagtacggcacatggaaggctctctttactacactaccatacccgagctattccccaagatgtttggcagacgaagaggaaaaacccaagcagaggctcacaagattatgcgcctcaaagtantggccttgggaggcactcattgtccccttggaagcattctcgagctaagctggatgccacttgctagtggatggctctaccttgggacctcgtgagtgtccattccccttcggtgcggtagtgcgccccttggcgtgggtgtttgggccagcgattttcccggggcccctggaagctaatgcccctttttaatttggttgcgcttgtggggacccacgggaagcgacgacggttaaccggcgagtggaaaccaatcccaagcgttctaattccccaagttccagtttggccaaccttggcctacaggacaggtttgggggagccttttgctttccttggtggggaacgcgaaccgcaacggttcacggccccaaagggcgttttacaggaacccgctaacggcaacttgcggggggggttccaattccaaagaaaagggtggtacttggtgccgtcccccctttttccaaaaacacccacacccaaaattttcaagtgggngcaaggaaaaacaccccaacggataatgggctatgtttccccgtttcccgcaagatttttctccccaaaaagagtttgcaagccgccggcatatgatcacattgggatgccgattatattgggcggcaacacactttgtgtgtggccccaacgccgaaaaatatcggggcggtgtagccacacgtgacaacccttgtggcctttcctatttgggccctttgggggggccacacggcttggaggatcggattggcgaagaaaaacccacagggctggagacagcgtttccatttccttaaatgttggaaacacacccgtcgacaacaacggcccccagacacgcaccacacgcgacagtttccgttcccttgggttggggaacacatttcccaacattaatttcacaaattggggagcgcagaacacatttggcgccccccaagagaagattcccctttggttacttccattttggcg

SEQ ID NO: 525518 - DNA, 89 bp, Homo sapiens
  misc_feature (11)..(11): n is a, c, g, or t
  misc_feature (83)..(83): n is a, c, g, or t
aaagtcttacntgccttattatgtgtatgggattctaaagtggcattccacttggatttcctgtgctacctatccaaatccangtacct

SEQ ID NO: 525519 - DNA, 209 bp, Homo sapiens
atttcacttatttggtaacataataagaaaatattaataaacaataaatatgtggtaagctctgtgctagatactgggagataataatgaacaagacacagagcaggcccttagggagattagaaacgcaaatgtaatgaaacaggcatttatactgcagtcagaataactacagtcaggctaggtataaaaacctgtgtaagctgtgt

SEQ ID NO: 525520 - DNA, 380 bp, Homo sapiens
gatggatggatggatggatggatggatggatgacagatggatggtggagggttaatggaaggaaggaagatggatgggtggaaggaagatgggtggatggatggtggagggtggatagaaggaagatgggtatatgaatagatggctgggtgggtggaaggaaggaagatggttggatggatggaagatggatggatggatggatggagggtagagttttaatggaaggaagatggatggacgaatagatggaaggaagatgggtggatggaaggaagatggatgaatagatgggtgggtggatgtttggatggatggtggagggcagagtgttaatggaaggaagatgaatggatagatggagggtagagtgtagatgg

SEQ ID NO: 525521 - DNA, 943 bp, Homo sapiens
gcccatcttcgtgccggcttgcgttgattatttctgggtcaaggacgccatctgcttacgagactgccctatgggaccaaggggagtgaggatctgctcctccgggtgctagccatcacccagctcctccatccccaagaacatccagagcctcaggtgccgccgctgtgtgggtcgtggggaacgggcgacgcggctgacggaacagctcagctggagagcatgccatcaagcacagtacgacggctgggtcaatcagactggagacaaggccccaggaggactggctcatgagggtgacgtgggcgtccaagaccaccgagtgcgtcagctgtcatacgcgcggaatgtcggcgccagcgtagcggagcccccaaaggtggaaagagcaacccaagaacacagaacaccacggcactggagagcgtatgcaaagggcaaggggagaagaccaacgtgggagagaagagcgagtccgtggaggcggagtaacgaacgccggggtggcggaacaggggcacaccatgggaaaagacagagcactcccgcacgtcccactcagtgggggaatcggctccacagcccgcttaacaacccagacatcacgcggaacgccttaccaagccgcacaggcagagccactcggcagcaagcaaggcacgccacgacccaacacgtggcctgcaagagcgaggcgcgaacggccaaacaaagaccaaccggaacggaacttcaagcacagagatgacgccaacacaaagggcgccgcgcgactgggacaccgctcaacggcaaggacgccatcgcacccactcgtgatgcaaactaagggagccaacagataggccccgaggcctgatgaggcgtacaccacagaagaacagccggtaccacagccagacgaacgacaagaaccaaacaaccacgccgagacacaagtgag

SEQ ID NO: 525522 - DNA, 409 bp, Homo sapiens
aatcatagttttataacattcactttaatcagaagttcacttgaaaggattattaaatgattgctgtagtgtaaaagctctcaaaataggaaattattaatttttattaagagaaattctaggccaggtatggtggctcacacctgtaatcccagcactttgggaggccgaggtgggtggatcacttgatgtcaggagtttgagactagcctggccaacatggtaaaaccccttctctaccaaaaatacaaaaattagctgggcatggtggcagtcgcctgtaatcccagctacttgggacactgaggcaggagaatttgcttgaatctgggaggtggaggttgcccgtagccaagattgcgccattgcactccaacctgggtgacagagagagactccgtttaattaa

SEQ ID NO: 525523 - DNA, 189 bp, Homo sapiens
  misc_feature (18)..(18): n is a, c, g, or t
  misc_feature (43)..(43): n is a, c, g, or t
  misc_feature (69)..(69): n is a, c, g, or t
  misc_feature (102)..(102): n is a, c, g, or t
  misc_feature (180)..(180): n is a, c, g, or t
cctgtgcccaagcaaganggtcacctagacagcgagagcccanccaatatcccactgacaaagcaaggnggttccagggatgttcagggaccagaccctgtntgcagtcaacccatccagcctttgttttggcatggaagcagcctggttccccagggcccaggcgacaccctaccaccnttgccatgt

SEQ ID NO: 525524 - DNA, 307 bp, Homo sapiens
acgtacttcatacactattctttaagatcaggagcaaggaatgttcagaaatatctctcccaccggttttttttcctattttaggttcagggggtacatatgcagggttggttagtgtaggtaaactgtgtgtcacagggagttggtagaacgagattattttggtcactcatggtactaagaccactagagcttaatttttttgtttctggatccttctctctcactcccattccttcagcccttcggagtacggctccagttgtgctgtggttccctgttttggtggtccagtgagtctcattct

SEQ ID NO: 525525 - DNA, 1470 bp, Homo sapiens
tggaacagtcggccgcttgggatgctgtctaagcttgtgatacctgatgttaataacggacaacagataaagctccgcatccttgtcgccacgtgcttcggtccgtggttggctgtgcatgacgtttgacctgtatggtgaccctcgcgatttgcaaagtgtgctgaggatctggaatacttgaagctgtgatacggcacactcattgtgttaggggagcattgtagtagtttgccctcctgttgactgcagctggcttccactacgagagagtgcaaacggtgcaaagcgctcatgcgtacctgcatggcgcctctcgttgaccccgtacctcgcgcacgcggttagctcccggaggtcggcggcatcgtgcctcgtcgcgccgaatcctcccgtcatgctgctttcgaggctacggtgtcgcggaggaccgcgcttccggaggggggccggatgaatgcccaggcgatcgcgtacgcccgcgcatcttccggagatttaccgaggtcgatggccctagaactgccaccggccgtttgccttgtcccgtgggtgacgtgggacttgcttgggcggacaaggctttggcttccgctccgcacccactcgggacgtcggcccgggtacctacagcaggctggcctcggtccgggcgaccaatttcggctcgcgcgcctcgacgggagtcccccggacgggtccccgaaccatggaagaccgggcgaaggccgcaaaggcagtcccttatcccttgggccacgaaaaggcccccgtacccccggacacggtggggaaccctgggagcgaaccccggaagggacgactaagcgacacggaccgcagggcgcgcacatacaacgcgctctcgagcacctaaccgctccctcctgcgaacaacgccgcaaggacacctcttcccccaacacagaggacaaccactcgaagccaaggaacacctcccgacacagtaggctgggcaccctacccaacacagctggaaagacaactcacgcgatcacactaacgaccccccaacagctacgtggccgccgacacgaacgctacaacggctgaggcaaaataccaccgactacgatccccgaacaagaaacgtacaaacagcacacaaatacgcgaggcgcctacctacgctaagaaaccccacaacgacgacaaaatcacgaagaggcgcagggacccccccataacactaacacacggcgaaatcacaccagaacgcgctagcaccatagcacgcgccaatgaacgggcccacctcagcccctggttgaccacccggacacacgcgttacaacccagtgacacacttataactggaaaccgacaacaatctcctagcgaccgacatcgctcccagcgaccgcgacaccgaaccgccgactgaccacactggacacacggcacggcatgctacaggccgagtaagagacctaccccgcaacaagcgac

SEQ ID NO: 525526 - DNA, 800 bp, Homo sapiens
gctgaagcggctggcggagcagaacggattgctaggatcagctcgatgtcatctgagcctcctcgcacctaccatcagtgcccccacccatcacgcttcagtcgggctgctggacatgccctcggagccgtgagcgctcacctatcccctctgcggcggcaatcgtggtcccaagtgccactggccactcgtccgtgacgaggtaccttctcggacgacgcgtgcgtggcttgtcactagggtcccgcgttcttacggagaggcatggtctgcgaaagtgcgttcgtgcgcaggtcgcgaaggggccagtgggctctcattgagccccgagactggatggtcggcctccgagcgatccttccgtgcagcagtctactgcagtgtgtgaacgtgggatgtactgtcccaagtggaaggcgacgaggtcacctataaataggtgctccatcgcagccaaggaatgaagaagctgccaggcctgttggaaggtcggtccattcactctactcgtggtcaccgagggcgacgaggcattgcagacctggtctggacatgtcgatccaggtcctaggagatggtggaagcactcgccttggtcctgtgcttgtgggagacttggcggggaggaggcagcagacactggagatgacattcttccacacgagacggggcttcagccgggcatggtccctctcaggtatctcctggaggaaggggtataggaggggcaggtgtgggagagtgggggtagtcccggcccaccagtgacaggctatgaccattgcatacaacctctcacc

SEQ ID NO: 525527 - DNA, 474 bp, Homo sapiens
gacctctagctcggtaccctaacttatattataacatgatgtacgtataaaactatcatttttaaccacgccaatgattaaaatcattgtcagttctaagcctgtaagtgggaaaggaaatgagtgttttctaaacctttaaccccatcaaatgcatgatattattgtggaaatacttttttagagcccaagtgcagttcgaccatacccgtcgtaccgctcctggacaatatattttagaggtaagtaaaaaaaggtcattaaccccccctcccctcggataattcctagcttcaccactatcacaatgttgataataatagccaaaaactcgcctctggatcagccacttatttacgcaatttcaattatttaggtatacctggattacgaaataaattcagccaaaaatgagttattaccataaaattttgcagtacacttgactgaacacaaataaaaatatattattat

SEQ ID NO: 525528 - DNA, 169 bp, Homo sapiens
  misc_feature (45)..(45): n is a, c, g, or t
  misc_feature (73)..(73): n is a, c, g, or t
  misc_feature (137)..(137): n is a, c, g, or t
cagaaaggaggcattgagcaaaaactaggaaaatctgaataaacngtggacctcgcttggttaatatatttanactggtgactcattttaaaactttcccgggcgcgatggctcatgtctgcaatcccagcacttgngaggctgagcgggtggatcacccaggtcagga

SEQ ID NO: 525529 - DNA, 321 bp, Homo sapiens
  misc_feature (189)..(189): n is a, c, g, or t
caggaaaagggggtcccccctttttttaaagccctttggttgcattttattttatttttttaaaagtcctttaaaaaggccagtcaggaaggggatggggccccaaacccagcccccagcatttggaggggccaggccccaaatttttgcttcccgtagttctccaggggtttaacaaaaaaaaagcantggcccttggccagggtcctcccctgccccactccaagggatgggtatggatcgctgggccccaggtttttgcttttgggggtattggaggggcagggtttgggactgaaaaaagttcccttttgggggcca

SEQ ID NO: 525530 - DNA, 305 bp, Homo sapiens
cagctatggacagcgacatagtatgatatttatctcctcccatgatgctgagaggagctcgtattctgatctctgagtgaatcctttgttctctgtttaaaaaatcctaaaaggaaaagggaaaaaaaaaaagaactggtgggggattgtcaaccagcttatctgcgggatggtccagatctgataaatcctgatggaaacgggttatgatccggaattccgtaccatccccattggaatatacatggaatattgtaaaacctacatgagcagatgaaatagacgcattaaatatttttatctat

SEQ ID NO: 525531 - DNA, 121 bp, Homo sapiens
ggccggcaaaccccccctccccggggtttttgggttgcccgaggatggttgggccggaccccgttttaaatttttcccgggcccccgcatggaaattaagcccccccccctgccctgggga

SEQ ID NO: 525532 - DNA, 847 bp, Homo sapiens
  misc_feature (44)..(44): n is a, c, g, or t
  misc_feature (63)..(63): n is a, c, g, or t
  misc_feature (88)..(88): n is a, c, g, or t
  misc_feature (90)..(92): n is a, c, g, or t
  misc_feature (105)..(105): n is a, c, g, or t
  misc_feature (113)..(114): n is a, c, g, or t
  misc_feature (124)..(124): n is a, c, g, or t
  misc_feature (145)..(145): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (164)..(164): n is a, c, g, or t
  misc_feature (172)..(172): n is a, c, g, or t
  misc_feature (179)..(179): n is a, c, g, or t
  misc_feature (202)..(202): n is a, c, g, or t
  misc_feature (204)..(205): n is a, c, g, or t
  misc_feature (253)..(253): n is a, c, g, or t
  misc_feature (279)..(279): n is a, c, g, or t
  misc_feature (282)..(282): n is a, c, g, or t
  misc_feature (309)..(309): n is a, c, g, or t
  misc_feature (313)..(313): n is a, c, g, or t
  misc_feature (325)..(325): n is a, c, g, or t
  misc_feature (327)..(328): n is a, c, g, or t
  misc_feature (355)..(355): n is a, c, g, or t
  misc_feature (357)..(357): n is a, c, g, or t
  misc_feature (432)..(432): n is a, c, g, or t
  misc_feature (443)..(443): n is a, c, g, or t
  misc_feature (453)..(453): n is a, c, g, or t
  misc_feature (471)..(471): n is a, c, g, or t
  misc_feature (502)..(502): n is a, c, g, or t
  misc_feature (527)..(527): n is a, c, g, or t
  misc_feature (534)..(534): n is a, c, g, or t
  misc_feature (554)..(554): n is a, c, g, or t
  misc_feature (568)..(568): n is a, c, g, or t
  misc_feature (589)..(589): n is a, c, g, or t
  misc_feature (613)..(613): n is a, c, g, or t
  misc_feature (617)..(617): n is a, c, g, or t
  misc_feature (633)..(633): n is a, c, g, or t
  misc_feature (706)..(706): n is a, c, g, or t
  misc_feature (714)..(714): n is a, c, g, or t
  misc_feature (736)..(736): n is a, c, g, or t
  misc_feature (766)..(766): n is a, c, g, or t
  misc_feature (771)..(771): n is a, c, g, or t
  misc_feature (809)..(809): n is a, c, g, or t
tctcccacacgccggtcggcctggcccacctggggtacaccgcnggacccggtcccggcttancccgggcggtggcccccgccccctngnnnggcacccacaccncctcaccnncacccgggtncttacggccccctttttgttnccccgncnctcnccccccnctttgccnccccccnccccctcccacccccgcgccccncnntcctcccctcccggccccacacccccccccccccccccccacccttcncctttcccccaacctccccccccccntcncccccgcccccacccctaccctcctcnaccncgccctcctccncnnccccacctccgtccttctccccctttntnaccccaaccttccctcctcacccaaccccgccttcaactcttccaccccaacctcaccgcccccctccccaaccncctcaacttcncccccatcanaccccttcattcccttcncaccacccgcctccacatctacttcaccctnctgaccgaagggggcggcgagatcnacttccnctgccccctggaaaatcccngctggaacgcccanatcaccctaagcctggtcaanttcaaaaaccagcaggccatccanacantgcgggcccggcagancctcgggaccgggaccctcgtgtcctaaaccaccaggcgcaccatctttccttcatgctacccaccacctcantgctgaanacaaacttcattattccctctngcttgtgggggcacggctgtgctccatgtngcaangtggaaaacataaacgtgtggaggaggcgctggagctntaagaaatggacgaccctcggaggagggcaaaagctac

SEQ ID NO: 525533 - DNA, 955 bp, Homo sapiens
ggcttcaggaatcaccgtgcattgattggcgtgtggccctgcgcttcctctcactgacacttcgtgcccacatgtgagtgtcgaactcagtggccgtgctgtgattataccgctgcatcagcaggctggcatatccatcgtgcatccatgtgggatatcggttgggagtcgagtggatctgctcctggcgatctgctgcgtgccaaactgaccctcgtgttaacatgtctgcccacatagtcgttattccaatacccattgacaaatgttaccattgttcaactgttcaattgtctgctcatatggagtataatctccggtgcacttcattggtctactcaccatacagctatctgtgcaagattcgcatattcccgccactatcaagtggtggcgatgctctttttgcctggagttacgatctgtgtgatgtcccacgtggggtcattcagactagcgcgattggagaaaggctggggctcatttgcagtggaggtgagccaaaagggtcagtcatcatctgccccctctgctgaatgcccccatgttcgtcatgggtgtgaaccatgagaagtatgacaagcaggctcaagatcatcagacaatgcctcctgcagccagcaagtgcttaggacccctggccaaggtcatcgcatgacaactttggtatcgtggagaggactcatgagcacatgtccatgccatcactagccacccagaagactgtcggatggcccctcccgggaaaccttgtggcgtgatggccgcggggggctctccagaacatcatctctgctctactggcgctgccaaggtgtgggcaggtccttcctgatctgaaacggggaagctcacttcgcattggcttccgtgtcccactggcacctgtctggtggacctggacttcgttaaaaacctgcatattgtgaatcaacgtggtaacagcttgaagcct

SEQ ID NO: 525534 - DNA, 926 bp, Homo sapiens
ggatttcgctatgttggccaggctggtctcaaactcctgagcttgtgatccacctgcctcggcctcccagagtgctgggattgcaggcgtgagccactgaagcccgagagtaaataatataatactgctataaaatcttctataaataaaatctataaatttcaacttatgtacaatcggtcgatccgtgcttggctctgttacgcagtgctacagccctgatggcgagttacccccagcctctcattcctatgttctacaatgcataggaagaccacacatactgattgagcttagcttactctgcctaccccaaaatccactgactgttcctggaacaaacactgagtccaggtggtacagctatctaatttcactggtcacacacctctacaggtgagtacagagcactgtcattggcaacaaatgtgcttgctcatctatcaggccaccacaccttacatcacatagcatcgcaaccttacccattctgccctatcatagtacaggaaaggtccttacctatccaccggcaccactcccctctatgcactgctgtccaccatctcaatcttgcctcacaaggacctcccgagactatgctgccaaccgctccacatgtccaccgcccggaccggccagaccgagcccgggcacgcgcaaaacagcgagcatcacgacaatatcctaccccgtcaaccccgcggggccgccaacaggggaaccacgcatgacccaccaacaactagggcagaccacagccgacaacccaacaaagccaacgcgaccggccccccgaactatgcgcaaacacacggacaaaagacaccgcccgggacccaccgaccacgacagccgcacgcagcgaacaaccaccacagccccctcacgcaagacacgacaaagcacaccaatacgcacacaaa

SEQ ID NO: 525535 - DNA, 377 bp, Homo sapiens
cacgaggcgcctcgcagtctcgacaaagtcgcgcttgacccgctcgaggccggcgcggtccagcgccaccggggcgacttcgctcggggcatgcggcaccgcggagggcgcctcggtctgccagccctcgggctcgtcgggacgaatctgcgcgccgccatcccagggcgcgcggctcgaggccttgcggcccgcatgcgcgatctgcatcgcgacctggatcggcgaataggcgcgcacggccttcagcacgcgggccagcgccgcttcgttgtcgtccgagtacaggccgaggtcgtaaggcgtgatccgtccctgcggcgagaccgcggtcgcttcgagaatcagcatgccggcaccggacagcgcgagatgcc

SEQ ID NO: 525536 - DNA, 443 bp, Homo sapiens
cggcggggtcagtgcagagccgcggagggcacacatgaaccctggcacgcagcctcagggaggggcaggctggaaatgaccctgcctgcagctgggccatcagcctgaccacctgccccctgagcaaacgttgatgcaggtcgggcgcggtggctcatgcctgtaatcccagcactttaggagcccgaggcaggtggatcacctgaggttaggcgttcacgaccagcctggccaacatggtgaaacaccgtcgctactaaaaatacaaaaactagccaggcgatggtaatggggtgcacctgtagtccagctactcgggaggctgaggcccaagaatcgcttgaacccaggaggcggagcttgcagtgagcggagatcaccactccagcctgggtgacagagtgagactccatctcaaaaaaattaattaaagaaaaaacgct

SEQ ID NO: 525537 - DNA, 885 bp, Homo sapiens
  misc_feature (278)..(278): n is a, c, g, or t
  misc_feature (629)..(629): n is a, c, g, or t
tggtggtggcggcagctggagcccaacggggctgcgccttcttcgccgtgggcccggctcggatgcccccaccccaggcctcaccggcccagtcgctgaggctgcctcaccggaaacactgaggccgtaattccaaggcatacttgtccttgcttcgccgagcgggtcgcagcactccaagtcggtagccctactggaagtcccatgatcagtcacgacaaggctggcatgcctaagacttcacgcctgccttgtacccatggtgaaagtaaacaggnctcatgttgctgcacgacaaagcctgtttgggtggtctcttccctacctggtacgcgccgatgtacagatgcacgtgtatgctactaacattcagtaccagattactcagagcttgtggctttcgggtcagagtcataacttgtgaagtgacaggacatcctagtggagacggacgaatcattatctttgcttcatctaattagctttttgcatacaagatcagaccaattttgccttaaagttgtttgctatcagcaattgtagtaccaggatacgcactgacagtctaggtgagacacactagggacgtggttaggcgttggcgtgatcgaactaccaggctacaggcngccgtgaacaggccaagttgcaggggccagtacgacggaagtcaatttccatgtaagtcctggctttagcaaggtttgtgagtgccgctagttctcgcattgatccggacgaaaagatttgtcttaatgaaaaggacgcaatctcctaaggctttgaggtactctaattgttagtattagatactacttagaagaagaagagttgggacgcatgaacaatagaatctggttgtcttaagatatgtttctagaatat

SEQ ID NO: 525538 - DNA, 495 bp, Homo sapiens
gcaggaggactgcttgaggccaggagttagagaccagcttgggcaatatagcaagactctttctacaaaaaaaaaaaaaaaatttaacaggttaaaaaactacacctggagtaaaagattagggggaaatcattggagaattaaacgaggcaagaaagacttaagaacattggcgttctgatattataaaagaaaactatcactttttagcggccctttcttcccgatacttccacttcttgccctgtccacggggatctttggcgatcctggggggtttggctccacgattttctgcaccctcttctttttctctgatacgcgggcggggtcatctcacgcatttatatactatttgtgcggaggagaaacccgtgaggggaggacccggtgggaggcaccgtgggcgccatttgggaacctgcacctgcacggggagaataatcacagctgtgggccgaaaaaccctttacacccttgtggcgctatcacagg

SEQ ID NO: 525539 - DNA, 267 bp, Homo sapiens
gttatgagcttttttacataacacgacttgttgtgttgattattttttaaagtatgcattttatcacagtttttgattgtaattatagaatacatttgactaaacctaacaaactggtatttaaatagtattttatttaaaatgctgtttttaggcctggtgcactagttcatgcttgtaataccaacagtttgggaggccaaggcaggaagatcacttgaggtgaggagtcgagaccagcctgggcaacataacacccatctctac

SEQ ID NO: 525540 - DNA, 193 bp, Homo sapiens
tgagaccaaggagagctctgaagagcctccctaaaaagagagccaggacaccccacatttacacgtgagtttggatgatggatttcgatggaggaacccacatccccgcataggtcactgtggtggccatctaaccactattgaatgggtccagctgatgggcactactctctaatggcctgagggtagaaga

SEQ ID NO: 525541 - DNA, 197 bp, Homo sapiens
cacctatagtccaggtactcgggaggctgcgggcggcgaatggcgtgaaccttggaggcggagcttgccgtgagctgagatcgcgcgactgcactccagcctggtgtgacagagcgatcctctatgtcaaaaaaatcaatagataccctacaatagtgcacagatcatccacaaagcctcatccagacccagcattg

SEQ ID NO: 525542 - DNA, 231 bp, Homo sapiens
gcgcgagagtgttagcagcacatatcgtatacccagacttgcggtgttatggtccttcggcgatatagcagtgtaggaggctcggcgtgtgcagcaacaatctatcgtccactgggacctgacttgaagaagtgtatggggtctcggcgtgtgcatgcacacgccgagtatccaaacttcttaaggtccgatggacgaagttgttgcaggtcacagtggacgaagttgttg

SEQ ID NO: 525543 - DNA, 594 bp, Homo sapiens
aaaggccataccagggctccacaccccccctgcccaaaaaggcctggaatcggggatatcccatttatcacccagaaggtttttttcttggcaggatttttttgagctttttaccattccagctaagcccctaccccccaattaggagggcattggcccccaacaggaatcaccccgttaaatcccctagaagtcccattcttaaacacatcggtattactggcatcaggagtatcaatcccctgggctccccatagtttaatagaaaacacccgaaaccaaataattcaagcccggcttattacaattttagggggtttttattttaccctcccacaagcctcagaggatttggagtttcccttccccatttccgagggaatttaggggctaaacattttttgaagccacaggcttcccgggatttcaggtcattatggggtcaactttcctcacaatttgtttcatccgccaaataaaatttccctttacatccaaacatcactttggttttgaagcccccgcctgaaacgggcattttgtaaatggggtttgactatttttgtatgtctccatctattgatgagggtttta

SEQ ID NO: 525544 - DNA, 129 bp, Homo sapiens
gagacagggacagacgtaggccaagagaggggaacagagaggaaccagaggggagagacagagacagacaagacagtggattgataacttgaacgacgaacagacatgagactaacttactaacaacca

SEQ ID NO: 525545 - DNA, 281 bp, Homo sapiens
aggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccag

SEQ ID NO: 525546 - DNA, 315 bp, Homo sapiens
atgatgagatcaaagaaatatgtctaatgtaagtcacaacacaaagattcagagatatacatgtgaacttgatctacaagtacaccgatccatagtgtggttcaatagactattcctaggggacgtaaaaagatctgggataaaaccagactgaaaggaatgctccagaagagatgctcattgagtgtacataaacaccacccatgtcttttgtatttatttacacctttaaatcccccacagcaaatagaaaataatttatcatcacttgtacaattcaactgaagccttgactaataacctgacctgtgaacc

SEQ ID NO: 525547 - DNA, 127 bp, Homo sapiens
ttttccccggggggccccccccctttgggggcccccgggttttttttcccccccccccccccccccccccggggttttttttgggtaaggggggggggggaggaaaaaaaaaaggggttttttgcca

SEQ ID NO: 525548 - DNA, 184 bp, Homo sapiens
aggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggatgaactctttgccagcagagaggatcc

SEQ ID NO: 525549 - DNA, 146 bp, Homo sapiens
agactcacagctagcaggctcacaggagtggcaggagcattgggagagtgggaggcagcacacgggtccgctcttccacgaaaacagagaaacggggacagctctacgagcgggagtagcgggcacagacgaacagagaaggaaag

SEQ ID NO: 525550 - DNA, 1432 bp, Homo sapiens
gcattttgcgtgtgacctgagaaggttctcgatactggagtagtatgtgattatccgtcgtaacttaccggaaatacttagcagctaaatgatctctgagatactcgttaggatgtccttagctatactgtaatagtaggagtgatgataccttatagatgccattgcatcatagcaataccgatgttacgttggtcatcagagtctgtgcacttgcatatgtgcattcagatacatctatgtaactggctaccactggtgaactgtgcatcttatctgcataaatatctcacagtagagtacctaggggaagaacgtcgttactagctcggacagacttcgtgtcaagtatgttgtagcccaatatagtgataaaccacattgtatgaattggttcaggtgttaaaatattcgcgtccagagcgaaagatatctagtgtcactaggtaaggccgtggtggtgaattggaataggttttgaaggcgtagacgttggggctaatttggagaatgattgaaatttccctataatgtggtcttgggtccaggtcttgctaaattacgcttagggaaaagcttatctaattaaaatctaggaaattaaggaggcgaggacgcgtctccggggaggaaagacttaggggtaaatgcggtaatgacctgagaggatctaattgttgtgaaccccgccgaaggtgctggtggaaccctaactccgagggcagcgttcggttcccaccagaggtatgaggcccagtcctttggtaattgtctttgaaagcctgtaacacaataaactccaaattggcccgccttggtgtgcttaaacagacgaaaaaattttcttcccttcagtgtggcgcccctaattggttgcgcaacccaatttgtgcccaattcccacaaatggcaaaccaaacccaaaagggggggaaggccttcaacccttcacaagggtggaggggttcacggagcttcgttgggctgggacgttggcttttggggcttccggcggacaaacgacgttcacttgtgcggcaaatttgccggttggggcaccccagtttttcccccggtgaaaaacaccccccaatggggagagaggcgtccagtttgcactgtgaagtacatggataacgtttctttaagcagggaagaaattcccttggagggacggacttttggcccaccacagtaacaggagagcccagtggcactggccttgctcttggcagaaaaggcggcaagtgttgaccccaaactgggaagcgggaacattctcacaggggggtcaaaattgtgggccactgtgcgtccccgggcatagcccagtaactattacacgtggtgcttaacttcaagcctgtatggtgttggatcgaactggtctgtgcacggggcgtcgtataatcgagagctgtcgctccctcgg

SEQ ID NO: 525551 - DNA, 285 bp, Homo sapiens
acactgactgtatacatgacacagctgtcctcaaaaatgctctcaagagaggacagcaggttcatgttgatagtatgtctcttaatagagggcagcgtggctagtaatttcaaagatgcttcataacgattggtgacaaaatattaagtgtaaatctgtaaataatgagatggcatttcaatagtaattaacaagcattgataaaatgaatttaaaattaatctcaaacatactctatgaatgtaaaaacttttgtgatattctcaggatacagtagggagaggc

SEQ ID NO: 525552 - DNA, 1287 bp, Homo sapiens
gaatcaccatggcaggctgggaccctgatacactgtatcctgaaaactggagtggccttcaaggctctcatcgcatgctcatgtacatgctggggctcatgtgtcctgctgtgctctcctgcaccaccccacttccatttttggccaaaccaacctgcacccctgaatttctccgacaaatttcctgcctggcaatggtcccagcattatgacgtggttgattgactgtgacttcttgatgatgatatttgacgacgcaaactgccactattgccatactacttgtgacgcaccatgacgtgatgccttgcgtggggacactgtaactcacagactggacacgcacgcccagctgtgtgttgcacgttgtgtgtagatgctatttgcattgattcctagataataagattgccacccatgaccacgtacacctgtgtgatggttccccacaacctatggggcactcactgccactcacaaaacacaaccatgtgccacttgatgaaattgcaacaagggacgggaccgctcgacgggctgaacttcctaggcgagctggctgggactcgcctatacctctgacacgaccgaacggccctttcaactgcgctgcgggacgcaaccgacaatgaacatatggggattgaccactctagcacaatttgctcttggctaaccacaatgatagcaagggcatcctaattaaagccagtgtatcttaccacagccctacctttaaccatgcacaaagtggcctaacccaccaataaccaaaccaggctgggtatccctcaacactggcattaaacccaagcacccaaagattcctggggctgggtccaagcgggcgcgcacgcggacaacatggcgctgacacaacgaacaggagccccagaacgggactgcctaacaacgcttgccccacaaaacccaacccatacaaccagggaccaccgcaaccggcaaccacgacaaggcgtccaccgggaacacagaacaccccaccagccccaagacacggcgcgcacagcggacgctagcacacagcgagagaggccccaggccccgggcagccaacctggcgacacgagccaagagacagcatgcagacccacggcaagaacccaaggacacccgaccacagaccaagcgcagagcgaacaccgaaaccccacagagcaagcacctgggcagcgcaacagaggagacaagaaaaggagggccagggaccaaaactccaaggagtagacgcaacaccaatacaggcacccgagacagcacacgaac

SEQ ID NO: 525553 - DNA, 272 bp, Homo sapiens
gacagggtcttgctctgttgcccaggtagtacagctgcgaccacaactcagtgcagcctcaaactcctgggctcaaacaatcctcgtgtcagccgcccgaatgaatagctgggactacagatgcacgccaccatatttggccaatttttttttttgaaacggagttttgctcttattgcccaggccggaacgcaatggtgcggtcttggctcactacaacttctgcttcctgggttcaagcaattgtcccgcctcagcctcccaagtaggtc

SEQ ID NO: 525554 - DNA, 125 bp, Homo sapiens
gcattgagccctgtgatgcttcacgatatatcacctttagtgtcactggtctcccaacccctcgtctcctctctggtccaaaacgccatcatcttttggtccaacaggtgctagctgatcttcct

SEQ ID NO: 525555 - DNA, 207 bp, Homo sapiens
agaggcatggagatccatgagataatgacgccgagaacgatggcacacgtcactgcacatcatgaagataataggagaccaagttagtgaggtagagcagggaaccgatctctccatgtcagcttcactttgtcagtactctttgtatctggactctttcttcagagacttctccaagactctggcttcgtattcagctctaggata

SEQ ID NO: 525556 - DNA, 297 bp, Homo sapiens
  misc_feature (121)..(121): n is a, c, g, or t
gaaaaaaaatgggaccccctggggttttttggggaaatattgggttttttcccttcccaaccccatatataataaaaattttggcctaaaaaataattttctgtggttttccccgggcctnattttatttggttttccctaataaaaggcccctttccaacccgtttaaatccccccaaaataaatgggggtggggccaaaattaaactaagggtgtttcccccccccggcccccattaattttggggaataaccccttgggcccctttaagccctggccgggtttaaaccccccca

SEQ ID NO: 525557 - DNA, 239 bp, Homo sapiens
gcgtatacttaacttgccccttgagatgaaatgaaataatacattaaaaaatacattgaatctccaatatatgcttataatacaagttatgctctttgcagatcttacttttctgttacttgcatattctactttttattcataattgaactgcaaaactagtaggccatgtcggagaacagtgacatacacttgaacagttggacttatggctagcagcctcactcttcactaactgc

SEQ ID NO: 525558 - DNA, 1318 bp, Homo sapiens
ggtgggtcctttgccaccgtcgaccccgtggtggtgtagtgtccgccgcggctccacctctgttgctggggggaagatgtcttgtcgcgcatgggggtttgtggggttgttgtgggtgtgtcaccacccctgtgcaaggtgatgttgtgtgggtgaggtttgttccgtgaggggacgtcacctccggcgcccgtccgcgatgcacccacgacaccaacgtcgtggtgtgttctgataatcccgcccccgcgtggcgttgcgtgtgttcgtcgtgtgagtagttgtcacgccgcgataatgattatttgagaccttggtgggcgctacattgggtgtgtgtcgcttgttgtgtgttgtccccggctgtgtgggataatggtccaccgcagagcgtggatgcctttcggtcggggtgagagtcgcgttgtgagggtcgcctccggagtgcatgaggaggatgaataaccgcagacatgtgtgggtggataaaccacccccaagcacggtgatgatgcgcagccggagaatgaagttgttttgctccaccagcagtgggttgtctgcctccgactaaagaggactgcctctattacacagcccacaaggtgcgtgacaacattgcccaccagcgcgccctcatgtggaggtgggcaacacacagaatagtgagtagaactccccctccgtgtggtgctccactatatatgagtttgaggagtgttgtggagttgcacatagtgttgcggcacgctattttcttgtggagaggggcgtctgctcagatagtgcaccacacgtaacaagagatatacttctgtagtgtgtgtgccacgccagaggcccatataaggcgccacacgccacatggggcgtttgacacacaacgtgtttgagtgtatatatatagagggcgtgccaaatatatatgtgtgtgtatgtacccttgagactctgcgttatatatacgcactaggtgccgatatagagggaagatggcgatatagtattggctgtgctacgccaaagtggagactgtggagatcttcccaggaccagagggagaaagatgcttggatgcccaaatgagacaccagattggtgttattcgccaggtgatccaccagcccttaaagaaattgatcgttgtgttcgccaaaagaaattttataatgatttacccgtctccacgtgtgttaatgtttccaacgtgtatcataaagggtataattgtgtaaccaaatggtctaccatgaatcttttggtatttgtaaaaaaaagaaaatatctcgagcatgtactcggggcgaatagagtagag

SEQ ID NO: 525559 - DNA, 145 bp, Homo sapiens
ttgggctcgttgggggcagtgtagcagcagggtgcattgcatgtcatcaggcccatcccacgctggctgcacagcccccaagtcagtcagtgtgccatgttctatgcacagcatgttgctgcccacagcagtccctgcattttgt

SEQ ID NO: 525560 - DNA, 266 bp, Homo sapiens
  misc_feature (6)..(6): n is a, c, g, or t
gcggtnagagagagacagaggggaagggagagagagacagagaggggccgggagaaattgacagagaggggaagggcgagagagacagagaggggaagggagagagagaccgggagagatctagaaagataaagagaggggccgggcacggtggctcacacctgtaattccagcactttgagaggatgaggcaggtggatcgcctgaggtcaggagttcgagagcagcctgttttactagtgaaaacctgtctctactaaaaatac

SEQ ID NO: 525561 - DNA, 122 bp, Homo sapiens
tcctccccgactagcccgacagcactcccagcctgactcggtggcgggcttccttcagtgactttgcgcaagtcagttctgctcattgggtctcaactttccccgatcccttgtgatgggag

SEQ ID NO: 525562 - DNA, 744 bp, Homo sapiens
accactctcacttctagagaatacgtagtatatcgctcacgcctcatatcctccctactatgcctagaaggaataatactatcgctgttcattatagctactctcataaccctcaacacccactccctcttacgccatatagtttgtgcctattgcgcagtactagtctttgccgcctgcgaagcagcggtgggcctagccctactagtctcaatctccatgcacatatggcctagactgacgtacagtaagcctaaacctactccaagtgcgtaaagactagatcgtggccgaacagattatattactagccactgacatgactttccagaaaaacacagtaatttggagatcaagcagcaacgcacccacgagcctaacttattagcatcatccctctactatttgcataaccaaatcaagcaagcaacctatttagcctgttgccccaacgcttttcctccgagccgccctaacaaaccccgcctcgctaatgactaactacctgactcctaccccgtccacaatcatggcaagccaacgccgacttatccagtgaagccgactatctacgaaaaaagactcatagcctctctatactaatctccctacagaatctccttattatacattgcagggcacagaacttccccgtggactatctcttcgaaaccacattatcccacagggtattaaaccgagaggcccagcagaggctgacgagggttctcctttctccccaat

SEQ ID NO: 525563 - DNA, 444 bp, Homo sapiens
aacatcaaagcatatgcaggcaaagggcagttactgggcttctgggctgcttagtccctggctgggcaggaagggtagggaagatggatggggctcattgtttggcattgatgatgtccacgaagttcgtgacttgagaggaagcatcacgcacaagcgaagccatccacatcacggctggctggccagactccttgcacggttgccccacgtcacagagcgctccataaactgatagcgggtgctctagagccaccagcatcagagatcgttggacttcagcacatcctcaggagcttctcgctgtacttcctgggcactgttgggcgtgttgcacgtcttgccaagtaccaactggcccacacatggctcataggccagtgacgaccttgctccagtccttcacgttatctgcgatgacctttgtctgctcgaaaacaacct

SEQ ID NO: 525564 - DNA, 115 bp, Homo sapiens
cgccgtggtgcacaactactccgcggtggtgctgggcacgacggcgaactccagcaccttccggcccagcgccttggagatgcccttgcctcggaaacgtgagtccacagacatc

SEQ ID NO: 525565 - DNA, 450 bp, Homo sapiens
cttactcctgccattttcttatttgttttctggttgttctgcgggcttgtcttctttccttccttcccgtcggggattttctcttgtggtatgttttaatttctttttattttttgtgtatccgttgtatgttttttgatttgaggttaccatgaggcttgcaaataatataacccattattgtaaactgatgacaatttaacacttattgcattaaaaaacgagcaaaaactagtaaaaactctacagttccacttcatccccctgatttctctttgttgtttccatgtatatcttattgtattacatcttaagaagatatttttaattggtttgtcatttaaagaataaactacataagatatgaggactttaacagcataatacagcgttataatattctgtttttctatgtacttagtattaccagtaagttttgtaccttcagat

SEQ ID NO: 525566 - DNA, 833 bp, Homo sapiens
tgaggtggtgtgtacctgtagtcacaggtacttgggaggctgaggtgggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggctaggcacagtggtcacacctgtaatccttgcattttggaaggctgaggcaggaggatcactttaggcctggtgtgttcaagaccagcctggtcaacatagtgagacactgtctcttccttaatttggagggttaggggacagtgatctaaattgggtaggaaaattgagtaggatgtaattatgttctaagtgacttccaagttcaaaagttaattggaaatgtgacgagtgtggtaaacgaaaataccgttaggaggacaaaaggaatgtgtaagtcttttaattgccgaatatcttgcagaaaaaagctaagcaaacttacagggtcctgttgaagatggcagaagtctggagaaggaaaatcatgatataggttggcatttgtggaagatcttacatgtctaggagaacacgtgtggttctattaccattatggataaagatgagaatgttatagagaatggttctaactgggtgcaagaaattaggagcgaaggaattccggatctggttgggtaaggaatgatggcaaagattgatggatgggtttgggttgatcctcaattattgttgctggtccttttatggtgacggtttgagggaggagtgattggg

SEQ ID NO: 525567 - DNA, 104 bp, Homo sapiens
tcactctagagtgatcccctctctccacactgggggaggggtgtgtgtttgggcagtgagcaagccggcaagagaatgtgagtgggcggccagtgtggagagag

SEQ ID NO: 525568 - DNA, 388 bp, Homo sapiens
  misc_feature (111)..(112): n is a, c, g, or t
  misc_feature (115)..(115): n is a, c, g, or t
  misc_feature (126)..(126): n is a, c, g, or t
  misc_feature (255)..(255): n is a, c, g, or t
  misc_feature (329)..(329): n is a, c, g, or t
  misc_feature (383)..(383): n is a, c, g, or t
aagaactctgctaagtcagtttggcaagaagcctccatccccccatatctgatcagggtcctcagcctccgccacccccaggcgatgtctgcttaccttgcctgccttcannacncttccttttanctgggtagggtcctcagcttccaccacccccaggcgacagtctgctcaccctggctgcccgcagcaagattcctgttatctgggtagagtcctcagcctccgccacccccaaggcgatgtctgctcacnttgcatgccttaagcaagattcctgttacctgggtagaagtcctcagcctctgctacccacaggcaatgtctgntcaccctgactgccttcaagcaggttttcacttttacctgggtaagggtccttnagttt

SEQ ID NO: 525569 - DNA, 510 bp, Homo sapiens
agtcgacactgcgaacagcgaaggcacattggtagaatccaaatgtgctccctttttacgtggtgacagagatttggctctatgtagcccaggatcgagtgcgatggtgcgatctcggctcattgcaatctctgcctcccaagtacaaggcaattctcctgcctcagcctcccgagatagctgggattacaggcatgtgccaccacgcctggctaatttttttggtatttttcgtagagatggggtttcaccattgttggccagactggtctcaaactcctaacctcaggcaatccatctgccttggcctcccaaagtgctgcgattgtaggcgtgagccattgcacctggcccagatgatttatattcttagccaaattaaagaaatactgacttacgccagttaagtaaatcttacttgaccagttgtagtaattttaagcttgtgtgttacatggaatgtttccatatgaatcctagatttactctatcgcgtgccagaaggaggta

SEQ ID NO: 525570 - DNA, 760 bp, Homo sapiens
  misc_feature (524)..(524): n is a, c, g, or t
  misc_feature (564)..(564): n is a, c, g, or t
  misc_feature (580)..(580): n is a, c, g, or t
  misc_feature (621)..(621): n is a, c, g, or t
  misc_feature (631)..(631): n is a, c, g, or t
aaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgattggacccaggaagggtttggtaaaatctctttatccggctgtgcgaaacccgaaacacaatactcatcatacactattgtctaaacccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgaccncacacagcctctgcagatggatccctgcacgcctctttcngatgaagtgattgtantaggtgtctgtagctagtcttcaagaccacacctggaagantttctgggcnggctttaagtcctgtttgaaaaagcacccagtcagctgacttcctcgtgcaatgtgttaaacatgtgaacacccccccatgtgtcaggagtgctgtctctggtctcattccatttagctgacccaagac

SEQ ID NO: 525571 - DNA, 135 bp, Homo sapiens
aggatccgtgatattcagagagtactggcgctcgattgattcgacgcatcgacggccccggtcgactgctgttgtgctgctgtccggaagcgcacgatcgcacttgactgctacggagatcgcagcatgctgacg

SEQ ID NO: 525572 - DNA, 168 bp, Homo sapiens
catgggggtgggatctgctgacctagaccacttggctccctggcttcacgctactttcaggtgagtgaaaggttctatcttgctggcattccagatgccactagagtacacacacacacacacacacacacacacacacacacacacaaaacaaaacaaaacgaaacg

SEQ ID NO: 525573 - DNA, 1171 bp, Homo sapiens
cctgagtaccccgtcaaactgcaaatcgaccccagcatccagagggtgaggaccgaggagcgcgagacacgatcaggaccctcaatcaataagtttggtctccttcatcgacaaggtgcggtacctgtgagacagtcgaggatactaatggttcttggacgccaacgtgtgaccctgcgtgcatggagcaaaggtcgaccaaggacttgcttgagtgcacgaatcctgcgagcctgtctcgtgctgatgcaagtaaatcgagacaatacactgcaaggagagtcaggactcgagtacatgcctaatcggatgtgtggcgaaactgggggacctgcttggaacatcacgagtcgtgatgaaaactattgacaggacactgtggtggtagaggattgcaaggacacaagtagtgatggactgacaagtcaaacaatgacgttaacgactggactgacgaacttgagtatatggtgagttgcttgcaatgcaagagatagtacggatggctaggcggtacaatgaaacagaggtgagacccttgaggaggccgaacggtgttgattgcacctgaatgcgatgaggtaattacatcttcattgaaggatgctactttatgatgtgcgagaagcgtagatcccaatgatcgctgtgactgcaatgtcctctgatcgatccatctaagtggttcctctatctcagtggaacaagcaaatcggtataggcttgtgacctgggataagtccatcattcgtcttgaggtatacatggtcctcgaagtatgcatggaggagttgtcccaaaccgccatgcggtgattagtaacgtccggagtgctggtaatcagagccaaggtaattgaggcagctgcaggcagaacatgcgttgggccggttaatggccgagtgaactcacggaaacaccaaaggcattgagatctctgagaatgaaacccggatgaatccaggaaggctggagaagcccgagattggaccaatgtcagggaaaacagtaggcgccagatctggcaagaaacggccgattgggggttgccgaagcagcgtgggggaagctgggcctcaagggatgccaggaaacaggtgggcgaagctggaggaggccctgaaaagggcaccaagacatggccgggtgtgagtgaaaaccggagccctgg

SEQ ID NO: 525574 - DNA, 942 bp, Homo sapiens
  misc_feature (14)..(14): n is a, c, g, or t
gaagcttctactcncataattagcatctctcaggattaaaattcgttagtcgtcccgtcagaggctcctgtcaccacactttgtgacccctctcactgacaagaacatgctcttttgacacaacctctcgtgtgttaagacccccctgttaactctaggcccccctctatattttgtcgttccccttagagggttgattcatccccatccttgtagccgcgctttctcccacgtgccgggacgcgtgatctccttctacaggcagcaccgcatcccttatgtaccctccccgtactttctgtacgtgtcaactcggccggcgtaattgtgcaacagatctatcggaagaccccccgtggtgttccatcttaaagaagggtcttcagaaaaggtcattttttcttctaaaatccccttaaggccctctcggttgtccttccacaaagtagcccatgaagaggccactcactcaacagggtttttcaaaaaactgaccatttcctctttctccaaatacttctttcccatccaacagatttgtagtagatatatccccagtattttacactcctcgcctaagtattcgttatcaagggcttcactgccattccccattcatttagccacgcacacgtaacctctaccatttattttgagccacttactcacactcgtagactgtttccgaacgcctctaaagagtacctcacaaggaactctccccctcttgcgcgaacttgagaagctccaccaccggaaatttggcatatgatcaatccccacgtaaaaaaatctgcgtcattcgcggaggatgcatacaatagaatattctgttagggtaataaattctaaaataacaatagaaattcaaagatcactccttttaaaaacagacaaattttttggtttaaaaaaaacgctaccccaaccaacaacaaaaca

SEQ ID NO: 525575 - DNA, 281 bp, Homo sapiens
ggcagattgattttccctctttccggggaattcctaagtaattaaaaataaataagttccaaaaaaaattgtagctggaattttaaaaacaattgggagtggctgtttgagttgccccccccatgtccttagttttaatttgtgcccccttattaactcccagcagggttattgaaggggttcatttcaaatttagttgatttttcccccaaaggcatgtcatgtattttcaaaagggtgtattcccaccagtcaataaatgaacccccgtaaaaactcca

SEQ ID NO: 525576 - DNA, 212 bp, Homo sapiens
gcccgagcggcatgtgcgcggcggcattacctcggtcgtcggagtcgcactgctgattgagctcccgctggctgcgattgacggcgtcgtgcactgtcgacgtagtccagcccgtgacggtaggtgtgccggagatcagcctggcagggccccgtttctagagggcccgtccccagcccgggccgtccatcctcgcattgcttgttccgctg

SEQ ID NO: 525577 - DNA, 364 bp, Homo sapiens
cgtcagggagtttgagaccaccctgtgcaatgaagcgagacacccatttcttgaaaaacttaaaaaaaaaaaaaattagctatggcatgggggcatttgcctataatcccagctacttagggggctgaaaagggaaaaacccttgagccccaagaggttaaggctgcagggaactatgatcatgccactggactccaacctgggcaacaaaacaagaccctgttttttaaaaaaaaagaggaaaaacatcactggttttagatcaccctaaccgcttttattataatgatgaaaaagtttgaaatactgggtgaattaccaaaatgggaccaaaacccaaattgtgcccaggctgttggaaaaa

SEQ ID NO: 525578 - DNA, 239 bp, Homo sapiens
gttcgttgggcgggtgctgtgtttttcgctcgtcgactgcggctcttcctcgggcagcggaaggccgcggcggtgggaagaagtggcctaaaaccttccgccgttgggtgaaaagaaaatggcccgacccaggaaagacttttcgtaagtccaccggtgggaaagccccccgcaaacaatctggccaaagaaagccgccaggaaaagcgtctccctctaccgcgcggggtgagagaagc

SEQ ID NO: 525579 - DNA, 619 bp, Homo sapiens
gatgctttttcggttgggaaatataccccctacatattccacaccaacggtttttttcttcgaaaaaaatctccctcttgggtcttaaaaacaacattacgtcaatcttgtacgcttgaatattacttctaagcaactacaaatcactatgtctatcgtctctctctcaaccacactactttaattcctccctcccaaccatctcgggcctttttttatgggccctatgatattacacaactattttatttcgttccctgaaatattaagccccgagagaatggtctagagtgataactctcacggagacggccacgcactgcattctttcaaaattggttctgcattttacccacccatctcttgtataagatcctctgcatatgtgtgtgtgtgtgtgtgtgtgtgtgtctgtattattaataaagatgtaaactgcaggctgcactgaagacaaaatatatggctatgggaattattcactgaatagataagcacttccctagaattttacgaagccaaaatgccatgcaatttatgttacagaaattgtgtgaataggattttctcttttctttcttgatggcaataaataaactggaaagttgtcttttccttt

SEQ ID NO: 525580 - DNA, 294 bp, Homo sapiens
caacttcaagccaaatatctctagtaaaccacggaaactctgatatggactggttcgactaaaagcacaagaataaggaccctgctatgaattgacgcacaaccataaaacagactcagttaaccaagacacttgttcaaaaagggaaacaagtacagagactgattaactgggtgaacaaggcaagtaacaatatagttaaaaacctgctggacccaaggacagaagatacattccttataccagaatagttaagttcctgaaagtccttacccactctgctcccttactgta

SEQ ID NO: 525581 - DNA, 183 bp, Homo sapiens
agagaataggcgatatgacggctgtagaggtcaggggaggagtacatatcgactcgtatcatgtaataacacggacaataaatctcccaccatacacactgggggctgtatatgaggcaatttttgggaaggccaaaggggaggtatacgccgcgagatacaaagcctgggaaggtggagaga

SEQ ID NO: 525582 - DNA, 223 bp, Homo sapiens
  misc_feature (141)..(141): n is a, c, g, or t
tacttaagaccagctccacagagattatatcaataggctattctattaagatatgcatcagtagcgtaacttcaaacagaaacacaggccaatgagtctgctgaggtggtgattgctgaggtcagaatcacgacagctgancacatggtgaacccgtctctactaaaaatacaaaattagctgggcatgtggcggaagcctgtaatcccagcactttggaagg

SEQ ID NO: 525583 - DNA, 372 bp, Homo sapiens
  misc_feature (118)..(118): n is a, c, g, or t
  misc_feature (121)..(121): n is a, c, g, or t
taccggggccgacgtgatgtcgcttttttggggccccgcccccctcctggttttagaataactttggggggggggggggccccccccccctgctcccgctcccccctgcccggggtgntgntttgggccttctgtcaaaaccctggtgggggaggtgtgggccccccttaaccccgaggaacaggggggtttccctgggttttcggaaaaccccttatgggggggggccgccccccccccctgtttcaaggggggggggggggggggggccagcaaagcctccccccccctgggcaaaaacttttttttgttttttaacccccccggccccctttccccttgggaaaaagggggttttttaaacccgcggga

SEQ ID NO: 525584 - DNA, 450 bp, Homo sapiens
agtattaatgagagtgtcaatgccgtgttccctctgacacctgcttgtcttcccagctgcacatgggctcatgggagtcctgtgatcacttggacagtgaagataaaataaggtcctgttcacagatggtcctgcaccatatgcaggcaccaccggcaagtgcacagctgcagcactaccgtccctttctaggacatccctgaagaacagcagtgaaggaacatcttctcagtgggcagaacttggagcagtgcatcaggctgtgtgctttgcttagaaagagaaatggctagatgtgtgattatatagattcatgagctgtagccaatggtttggttggatggtcagggacttggaagaagcatcattacaaaattggtgacaaagaaatttggggaagagctctgggcatggacctctttaagtggtcaaaaactgtgaaggcatttg

SEQ ID NO: 525585 - DNA, 1330 bp, Homo sapiens
gcttaggcgcagacggggaagcggagcctacatgccagtggcccggatgactgggtttgtctgcacaacttatgtgaccccgcggaggacccttcgagaatactctcgtctcgacacaagagctgaagctgatctggcagagttatgggctcgggaatcaagacgtgaggtctggagggtcaatatttaccgcgatgtgccaaagatcactgcgaaggaccgtacacaggtgaatctgattgacggctttgaatgagaagggacactcaataggtgtctgttacgatatggcaaggcgccttggtgctagacgtgtcgttggtaccgacataggaggatgctggaatgagaggcaagatgacagctgggattacatacgcttggggactgaaggatagacggatttccttacgagagaacgccatgcaggaaccgcaggctcctctcacagacatgagagccttggagaccaaggttcacaaataccaacacgacagccatcgcatgtgacatagaatcgccggacaagacacgcgcacatattcaaggggttcccagacaaagaccatgtggtgaatggaaaacaattcccggatcgcgttccaatagcggtacacggagcctgggaacttctcccgcaagaaaaagacacagcattatggaagcgttgtactacgttgcgtgacgggccttccttcacaccgataaaacgggggggcacagatcgcgggcccggccacccccgggggaagacgagccagcttcgacaaaggacaggggacaggcacaagtttggacccacgaggaacaaggggcgacccaatgcggggatttggacggagggacaattgtgggaggagcatttagggggagaggaaaacgtagaacagggaaaggcggaacgaggaaaatggagaaactaaaaaaggatttgcgcgaaaacgtttggattaccacagatacatcttgggagttaatttgtgctttggaagaaattatgggttcaggtcaaggatagagaaaacgaacatggggagccaaaaagtcggcagaacacaccaggggcacatccaggggcggacggctaacgaaagaccaacgaagcagcaaaaaacaaaaacacgaagtcaagcaacaacaaaggcagaccaccacaacagaagcaaaagccacaagcacgcaaaaaaaagaaagcagcaacaaacaaacacagaagacagcaggaagcaacgaaggccacacaaacacagaagaacagcatgacaagacgagagggaggagacgcacgcaaaacataaaacacaccgcagcacaagaatcgaaacagcta

SEQ ID NO: 525586 - DNA, 126 bp, Homo sapiens
aaacgagcaaattataaagaatcagttttctaattaaatacaaatagaaagctgtgaggctcctaattcgtggagtatcttattgtaaaaacagttgagatcatcctgaagtgcaatctattaaca

SEQ ID NO: 525587 - DNA, 864 bp, Homo sapiens
ttgggttatttcctagtccacctgatcacgtggcttatgtgcatgtccttttagccgtcatcaatgctcgaacagccaagtctctcacaaatccgcaattgttccagggacaagcccgggcactggagcgctttgttggccatgaaaccgtgggcatctaatcgagggcggggacctgcctgaggagtctgctcaggaacctgtgacgacagcaatccgaaatggagcccttcaagattcctgaggatgacgggaatgacctgacccacagccttcgttcaaccctggaccgggaggagctggctacctgaatgctggggcgagccgcggatgaagacgtggaagcggcgacttgctttatcctcacagacaactgcctgctactacttcgagtacaccacggaacaaggagccccgaggaatgcatccgcactggagaatctgagcatccgagaggtggacgagcccccggtaaacgcgaacatgcgttgaactctgacatcccctacaacaaggggcagctcatcaaagcactgcaaaacagagagcggacggccgaagatggtggagcggaaagccacaatggtgtaccggatctcggcccgcacgcaaggagtgagaaggacgaagtcggatcaagtccatcgcaggtcgcgctagtagatgagtggagccccttgatatgagagtagctggcagtcgagataagaagcggatttcagtgcaagaagaagcaggagcagtcctgaccacagtgccctcaactccattatttattacggaggtgccccgcatgggtggccggactcatgggcataggggctgtggatcatggttacctgttaacaactggcaccttagctc

SEQ ID NO: 525588 - DNA, 324 bp, Homo sapiens
aatgagattagccggcaccagctctgattcctctgttgtttgctgttttattgcctgccctggtcctgacttcctgttacttattaaagctcggtggcgtctgcaatgaatcatagcttctttgatgaaatggacatactccccatcatcaggccgaggttgcgaggaactgtgagtgccgtcctgcattctatacgtccgagaggaacacattgcctttaggccttccctacacatgtgtctaggatactggcattgcactttcgcatttaacacagaaggcgaacgccactttcatcgcaaattgctcaccgtaatttattc

SEQ ID NO: 525589 - DNA, 409 bp, Homo sapiens
agtgctggcagtcttcttctagtcccctcgatcttctccctccttgtgggtggtcgtgatagcgagcagccggtccacggagggcgccttcgctggggcctggtaccggttgggtccagaagccctttggggagaggctggtccttgctgcttgcagacccgctgacgctagcgcaactcggacagaagctgcctcatgctggtggtaatctcagagctcaggagccacaaaaatatgcaaatgtccccagacacagagatgagctgtatacaatcattactaaatttcatgccagtaacaatctctgagtggacaaaaatggtggccaagcaatcgcctgaggagcagtcaaacatggagagatcttgtcagaacagctggtggcaatgtaaatccctaaggggtctt

SEQ ID NO: 525590 - DNA, 920 bp, Homo sapiens
  misc_feature (1)..(1): n is a, c, g, or t
ngctgtacttagttagtgtggtgttggcccaataaatcgccgtgttgttggcgttgccgccaatatctccccaggagtggtgtggccccaacgttttgacccacagggcgtcgtgagaaaacctcgtggtctccccccctctgaatgatgccacgccccgcgggtctgaccagttagggaggtcagctcttgttgttgaaaccccagaagttggttggcagacagggtcgtggtttaacaaacaatgtcttccaacgactgttctcagcccgagatacaccacgcactctactacattgtcgactctcaaaaatattcaacgcgaaatcaattttatgactcgtgcaagaatacttctcctcctcatacgagtcttaacaccacaatggttggttctctataagaatttctctctattcaacaagaatagaggtaattttgtatggtaccattactgtctatacagaacgagtaacaccaccgccgccccaattaatcctccccaagcaatctggcgcgccaaccacgcaatgaaacctagtcatatacgcgcgcgctggtcaacatcctcgctactcgtgtatatgttattaatcaacaaaccagattatttctctccgagtgattcactctctacacaccccaattcttttttggtgcggtctagatcccgctttcctcttgccgtggctctgcaacccgtgctgcccggcttgtctgctatacaagtacaaaacattcgggacgcggggaactttgttaaaacaagagatcattggcgccgaatcgccggtcaaaggcagaagtgcaggtacgcaaaaccgaagcaccgggcgttatatacagcgcgcccggcgagatgtcgagggcagaccagcccgcgtagccacaactccccaaaatcaaacccccacaaaaca

SEQ ID NO: 525591 - DNA, 357 bp, Homo sapiens
  misc_feature (14)..(14): n is a, c, g, or t
  misc_feature (275)..(275): n is a, c, g, or t
  misc_feature (337)..(337): n is a, c, g, or t
tgtggagagtccangagattctacgatggtgcgttggagtaccgcaacacttgctcaacaccgatttcctcaggtgctggattggggcctgacttatccagtcacactctccttcggcaccgaataccgctatgaacagtggaaccagtccctggcattccggcttcgtataacggcatgaccggcggcgcgcagggatttgcagggttttcacctctgaataccgtgcatgccaaccgtaataattacgcactgtatgctgggctagaatggcnatcttagtgagcatctgttctgcaggaattggccgggcggtccaagcactactcctaatttngggcaatcaaacttcaggca

SEQ ID NO: 525592 - DNA, 322 bp, Homo sapiens
tacatgagcagacaaggtcatctgcagataactgtgaaggaatggagcaaggtcgtcctggatcatatgagcctgtgtgggccattggtacttggcaagactgcaacaacaccaacaggcccaggagagtacacgacgaagctccagaggatggattgaagtccacacgtctcatgatgcgtgtggctcagatgcaccctgtatcatttcatggatgtgctcttgtgacttgtgtggcaaacttgcaagggatgcttggccatgccaagcacttgatgttggatgtgcttcacttgatggtgtggttgcttaccctacaatg

SEQ ID NO: 525593 - DNA, 974 bp, Homo sapiens
ggagagaactagtctcgagttttggagttgttgtgtctacagtatacaaagagagtgaatgggctcatccaacggataagtccaggggtaaacctagtttccaggcatgtcgggatctcggggtcaaccagggtcaccaggactggggctctcggtcttcccagcttaccgttcttaaccttcaatgatccagacaatcgctccgatgtgggttggcaagggtgggccggtctggcgtcggtagtcctggttatggtcctgtgacccacaatgactctggttgtccttgggacagccgaaacttctgggaaaagaatggtcttccactatgctggtggtcccacttcatcctggtcttgttcaattcacattttctaaaaggaggcgagaacaactagagaagcgacggtgaggagccaggggccacacttcatttgcacctttaagaacggactgcagagaaaaccaggagggtacgactcagatccccggggccagcagcagggccgcggggccacgaggggataaccgctggtgaggaaaatttaagagagccgctcaggaccttgtagcacgatcctaaaagacctcggaataactcggcctctcccggtaaggggtcccaagcgagatacgggcagcgcctccggtgggccctgggtaaacagcccagaaacccaaaccttggctccgtagatcctcgagagaaacctaggtctcgaagttaccgaacgtgacatgagtcgacatgagacctggagaagacatgacattgatggaggaacaacgcgcgcttttaggaccacaccaagggagagacccccccgggtggtaaaacacacacacgcgggggtctccacacaagccggaggggggaaccccggacggccccgcgggggacaaccttacaaaggggagccggggtacgacaccccaaaggaagaggccgcccggctgcccgggcaagtccacca

SEQ ID NO: 525594 - DNA, 761 bp, Homo sapiens
  misc_feature (3)..(3): n is a, c, g, or t
  misc_feature (72)..(72): n is a, c, g, or t
  misc_feature (88)..(88): n is a, c, g, or t
  misc_feature (137)..(137): n is a, c, g, or t
  misc_feature (142)..(142): n is a, c, g, or t
  misc_feature (183)..(183): n is a, c, g, or t
  misc_feature (188)..(188): n is a, c, g, or t
  misc_feature (199)..(199): n is a, c, g, or t
  misc_feature (201)..(201): n is a, c, g, or t
  misc_feature (212)..(213): n is a, c, g, or t
  misc_feature (237)..(237): n is a, c, g, or t
  misc_feature (241)..(241): n is a, c, g, or t
  misc_feature (249)..(249): n is a, c, g, or t
  misc_feature (258)..(258): n is a, c, g, or t
  misc_feature (263)..(263): n is a, c, g, or t
  misc_feature (273)..(273): n is a, c, g, or t
  misc_feature (284)..(284): n is a, c, g, or t
  misc_feature (288)..(288): n is a, c, g, or t
  misc_feature (297)..(297): n is a, c, g, or t
  misc_feature (306)..(306): n is a, c, g, or t
  misc_feature (311)..(311): n is a, c, g, or t
  misc_feature (321)..(321): n is a, c, g, or t
  misc_feature (328)..(328): n is a, c, g, or t
  misc_feature (332)..(332): n is a, c, g, or t
  misc_feature (335)..(335): n is a, c, g, or t
  misc_feature (359)..(359): n is a, c, g, or t
  misc_feature (428)..(428): n is a, c, g, or t
  misc_feature (433)..(434): n is a, c, g, or t
  misc_feature (449)..(449): n is a, c, g, or t
  misc_feature (453)..(453): n is a, c, g, or t
  misc_feature (737)..(737): n is a, c, g, or t
atntcagtatgctttttgtgtgttgtttcaaaatttgggaagataattagagaatatgatactgatcatggngaaggtaagagtatcnggatgtaaaaattcagtacatggtaataataaataatctaaaattttantaganattaaatatattaataaactgtgaaaatattagggattcanaattnatttaaaattnanagtctaaaatnncttctatgattacaggcttctgtnaaantgattggnatgaaattnaaggntaagtttgtnggtgatttatntatngtttccatntggtgtgtnatttnattttttttnttctttntttnttnttacattgttgggttttggtttantgtaccatcacattcaatattgacagaaaacaacattactagcttatttccaacatgtggcccagcctntttanngataaatcaaatgtntaantttgggcatattttaagaccgagttaaagctcttgggcccaatttatttcgaaagtcactctgagaacattgcactgtgttttgctggaacaaaatcaggaccttttgcattgatgtgacgaggcaatgacgtacgttaggcttagaatgggaatctgttccccatgggtttcctccaaccccacctcatttcctctctcttccgttttctcttgtacatactttcacacacatctcatcccaagctatcctaaggcactttgcttagaagatataaaaattangcaggaacgcacaaagctaagagg

SEQ ID NO: 525595 - DNA, 830 bp, Homo sapiens
  misc_feature (756)..(756): n is a, c, g, or t
gaacattaattacaattaacaataattttaggtatggaatgttatgattacctaagagagatgtctctacctaatgagctcaagtgatcctcccacctcagcctaccaagtagccaggaccacaggcaagtgcaccaccatgtactggctagttttgtttacaggtttttggtttttgggtttttgggtttattttttctctgggtgaggtgggttgtttttcacaggcggggtctcactattttgtccaggctagaagaatttctaatggtctattacacctcccgtttgggcaacgtaaattcagaataatttaaggtcctttggttatccagtagtttggcagcatcttaaacagtgtccaatttcagacattcagaagatgaagctatagtagtcaagaatctcaagctgaagggcttgggggagccaaagcagctttttagagcataggcttgaacttaaatctcagctcagtcacctgcaggactttaggcaccagtgatttcacccttctgagcctgttcttaatccgtaaaatgattataataattctttcacagcgttgtgaggattacgctgaaagtgggttccatgcctactacagtagggtgctccagaatattcattcaatctctactttatcgcccatttgttttccctggctcttataaatggactgctctaaaagtcctaggggaaacaggcgaagcactgggttcaatgatggcagtcgaaaaaccattttgtcagcgntaaatcattccattgaccttattttccctcccatttacggggtattacaacatttcgccacacccaaggacacc

SEQ ID NO: 525596 - DNA, 983 bp, Homo sapiens
  misc_feature (10)..(10): n is a, c, g, or t
  misc_feature (982)..(982): n is a, c, g, or t
cccacgcgtncggaacagaattaaagaagaggaaggacctaaagttcaaaaaaaaaaaaaaaaaaaaaaaaaaaaaaaaaaaaaaaaaaaaaaaaaaaaaagaagaagaaacaaaaaattactacaaataaagaggagaaagacaaagagaaaataaaagacacacaaatgtaaatgatgaaaaagtagtgggcacataaatgagagaggtattattatatagtgctaatagacagtgaatacatatacaatgacgtttagtttgttggttctactactgtggcgtaaaatgtgagagagaaacgtgagtgaagaagaggacaagcattgaagatatctaagagtgagtgagtggcacaatgaatcatgtggagacaacaaatatactcactaaagagaaagatttatagaaaagattatgaaagagagagaaaaaaatatccaagcaatcattcagaacacacgagaacgatacaacagagcagagagctgacaagaccacgcagcacacgagccacgactaataatagacacgacgactagaacaatacgacaagagcgcaaacaaagcgacagctaagcgcgcggccatataacaacagagggagaactatacaaacgcaccatcgctaagcacacacacaatatcattcgtacaaccacaaccgggccaaacgcacataggaggtcaaagaaatcaagacaaaggaaaagttatacaaacaaccatataagagcacttgatcaatgttagatagatattagatttgagtgtacaaaacgcagatttgctatatcaagataaaccgatcacaacagagaagcacgtaacagtggccgtagagacgggagaacagtatagataagagcagaagtaagaagtcattgacaagacaattaagctcaagtagccgagtcgagcgtcacacctgtcgtatagcacacgcttacttctactactgacgtccggttggaccagccna

SEQ ID NO: 525597 - DNA, 207 bp, Homo sapiens
gaactcatcaccttccactcaacatttcagtgctgtggaccaagaaagctccgcgaacaggtccaactacatgcccaaaggagcctttctaagcggaaaccaacccaaaaaagggcaaccaactttgtggccccaaatttttcgcgggaaaattttggcgaaaccacaccaaattttttctctgggcaacagggggaaaacccccaa

SEQ ID NO: 525598 - DNA, 385 bp, Homo sapiens
atgtcagcagataaacaagtgatgcaaaggtctctgtgtttcctatgcagatgaccctgcgttcttccgcagcgtttgtgtccctggttacttgagattagggagtggtgatgactcttaaggagcatgctgccttcaagcatctgtttaacaaagcacatcttgcaccgcccttaatccatctaaccctgagtggacacagcacatgtttcagagagcacggggttgggtactacgctttggctgccaaagcgtagtacccaatagctaggactacaggtatgcaccaccacacctggctaatctttgtatttttagcagagatggggttttgccatgttggccatgctggtcttgaacccctggcatcaggtgatccacccgc

SEQ ID NO: 525599 - DNA, 253 bp, Homo sapiens
tcactcgaggttgcgtagtgtccagtttgggtcagagcaagtagatttatccgtgtgaatgtaaaacactctgaaatgtacatgctccaattttatagttctcattacagtatttgagtagtcaaatgaatggtggtcaagataagccttaccaccaaaagtcacatttcggatctgaaagtgttccactgatgtatgccaaacaaatggtaagataaggaaaaggtcgtcccagggaactcggtcagaggtg

SEQ ID NO: 525600 - DNA, 659 bp, Homo sapiens
ccgaagtctgaaatgtgtatgtatatagctatatatataattaacatattaatacacaaggcacacatactatgagcatcctgcaaatttgtacagcattaatacttgattacatataattggaactgcgtagacatcacaggaagcaaatttatatatttatagcatatgtaatcatagcattaacacttatggcagcaattttgaaaaggttaattaaagactacagactagcagttatttatcctttctttagtttgccttattatagcatataaattgtccatgttgagtcttttgagattaagataatttccatattgaatatatgattaagctgcactattcacaaacatgtttgatttcttattacttcttaattcattcatatgacttgagttccaggtttcattattgtgtacccaactttgagataccaatagataaaacgtaataagatgaaagccaggggactggccttggttttccaacacgctcagtatttgtctgcagtatgtttctgacccttaatttctcagaagtacaaattttaggcaaacttcttaaatttatactggattatcttgatgtctctacatatatgtataaaccatagtaacttagattttgtactagaaaatctctaactcttacaagca

SEQ ID NO: 525601 - DNA, 705 bp, Homo sapiens
gcggatcatgaggtcaggagatcgagaccatcctggctaacacggtgaaaacccatgtctacgtaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaaactcattttttccattttactttttttctcaaatgataaaattatattactgattacttataactttcttctttatggtactcagtttctctttatattttctctttgaattaaaatttactttcttacctttcatttgggctcttttataatctccacttgtccacagcattcttctccttttaaaccaattagtcccagaaaaagacccttctgtgaaatttctaggactggatttttaaaattgccttgaaccttgtttattctaaattccttttttaagaaaaccttaatgtcccagctcgttgaaactacactgtggaacacgtattttgtgcccaatttcgtggaagataatgaggctcactgtaaacactactttgtcctgcaaagtattctgatgagagttactgacttctagagccattctctttaccgtctgacagtctaggattactt

SEQ ID NO: 525602 - DNA, 232 bp, Homo sapiens
acagcctgtgaatgaggtggagcaccgcatcatagcctgcgatggaggcggtggtccctgggccaccccaaggtgtacataaacttggacaaagaaacaaaaacggggacatgtggctactgcggcctgcagttcaagcagcaccatcactagtgtggctgtgtcctggtcctctgactcctatggaacatctccacgctgggtgttctgtgtgaggccactgctctgtgaa

SEQ ID NO: 525603 - DNA, 258 bp, Homo sapiens
  misc_feature (141)..(141): n is a, c, g, or t
  misc_feature (192)..(192): n is a, c, g, or t
atagcgagttttgcacgatgacgtaagactaccagcatctgaattctcaataaaaataaaaagaaacctattagttttcagttcctacaataagaaagcaaattcatggattatacaagcttatctatcaatagtaaagtntgatttacaaactacaaaaaattttttaaacttaatagtctcaggctctangtttggtttatttacttgtatttacgaaatacacaactacatttcaacaaataaatttcaatctaa

SEQ ID NO: 525604 - DNA, 674 bp, Homo sapiens
  misc_feature (475)..(475): n is a, c, g, or t
  misc_feature (587)..(587): n is a, c, g, or t
  misc_feature (627)..(627): n is a, c, g, or t
atgaggtagtactgatagggttggtggacacgagtgcgtagagatatgataccttgcagacccttgcgataatgatgtttaatattcttataataataaccggtcgcgaagattcttaccatacattttttattcagacttgataatgatgcgaggtaaacgctggatgactcttcccattttacagacctgcacaccaagccccaggacttaagccggttgcccagaatcgcactgcttaaggccaatcgcctaagccaacatcgtcttctagatgaaagtccaggctctgcacgcaccttattagacagactacgtgccctactattgcctgaccatctcagagactgactcttgtcttgagctattatatgcctgctcaagaacctacctgacaacagatattcttgtgatggatttgtatccctaggacacattagagtacttgccgatctgaacaaggagatatacgggngatcaatattcttgtacctgaacagtaacattccaatcgtacaatggctctttatttatgacaacatacagcagccttagatgaaggcttgaatagacaaggctatacatangttaactgtgctgacacaattctttggtggcatgaaacgngccaacgctttgttgtgggtttactctgccatgttcgggattccttt

SEQ ID NO: 525605 - DNA, 622 bp, Homo sapiens
ggaggcaatggacagtatagtatagcactaaggtaggcactagcctccctgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggtacatagtaaatgctaaataaatagtggtattcttactgttta

SEQ ID NO: 525606 - DNA, 916 bp, Homo sapiens
ggaggcaatggacagtatagtatagcactaaggtaggcactagcctccctgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggtacatagtaaatgctaaataaatagtggtattcttactgtttaaaaaacaccacccccaccacgcaaggcgcaacaccccaacaacaacaacacttttgggggccccttgccccaagaaacttttagaacaactcgggaggacgcgaggccacagagtattaaaacatggtccaaacgggtgcacgagaacatccgggcaaaaacagcgcggcggagtctcccccaataagaaaacgccccggggacaacccgggtctttgacaaactccacgaggcagtcacgaacgcaacacgcggggtctacagaggggcccacgagcctcatacaaattaccg

SEQ ID NO: 525607 - DNA, 304 bp, Homo sapiens
  misc_feature (42)..(42): n is a, c, g, or t
atccgagcatacaccatgctctgtagtatctctgagttctgnatatttcttagactttttggatgtgcagcagtacatgtcttgaagttacttgaaggcctcacttttaagaaagcttacaggtggggcctgtaccatccccagttctttgtagctcctcttggacatgtttggcctacttttaaaagggtagttgaataaatagcatcaccattctttgctgtggcacaggttataaacttaagtggagtttaccggcagcatcaaatgtttcagctttaaaaaataaaagtagggtaccagt

SEQ ID NO: 525608 - DNA, 1476 bp, Homo sapiens
  misc_feature (544)..(544): n is a, c, g, or t
  misc_feature (737)..(737): n is a, c, g, or t
tctttaaaagcaattttaatttctggattcacaaaatacgggtgaggagctaggggcgatgccggtacccccttgggtgtggtgcattcttctcccagtctctatattttctgtgctttctataaaaatataccctgtgtgtgttacaaacagacaagcctcatgtgcgtgctcccacaagtgtgcttgtgcaccattctcataaacagctgtgacaaagtatattatgtgtacccagggtgtgagaacagtctcacaacacaagatgtcgcccacactctcacacccaagaatatagggcgccctctcacaatctcaggtctcttctctgtggcctctcacctttattcactctcatatagaataaagcgtggtgtgtgctctcttctcctcttgtgtggcctcatatgagactatcacaagtgacacacacgctgtgtcccacaaaattctctctcgcgagaggtgtgtgtttctcaagagcacaaaaacttctcgggagaagagagcccacagtgtgaacactaatagagacacaccctantgtctctctgatgtgtgctcctccccccagaggcttctcgctatatgtgtcttcccacgagggggcttgtgccctgtgtgatggccaccctgtgtgcactgtggctgtgtctgtagccccctgtgggtgtctctcgcgtgatcacatatctcacgagggggacaaaccatatgtggggaggtaggagcggcgncagaagagccaaacaacacgccaatgttgagagagacatatattaccacagagtctcttttataagtggtgggggctctcagagacacccagagagagagtctccggggaggggtctccttgtggagagaggaaccctctctgtgggctgcatatatctgtggctcacaaatatgtttcgtcttttttctcgctccacaagcggtggtcttctattatactcttgcagaggaccgcctgtgtgtttctccccctgatattaaagcccctctactatgtgagacgcgcggtgtgtctccctttattctgctctccgcggggaattacggtgtggcgaaactccgttggggggcattatgtccctcctttatgtccccattcttattcagttccccttctacccgaggaggggaggtggagcacgtaggctccacctgttgccctgtgagtatactctctttcccaaggaccccaagaaccctccttcgtcgtgaaggccgccgagggggctgggcccccccccgaagaatattgtgtggcgacaaaagcatttcacgacatcgggaatagggaggccttctacaagagaacgcgggcacatgaaaaaccccttttgtaagaggggagcccgacagcgcacgcaggtgagtaaatcctcccaacccaaatagtcgcagcgagtatttctactactgtttgggggtccccgacaaagaaggaggcgcggcgctaggtgagta

SEQ ID NO: 525609 - DNA, 789 bp, Homo sapiens
gactcatttaactggtattgcggagccacgaggcttctgcttactgaactcgctcggcgctgggcgtactggatcggggagtcccgggggcgtcttgttctaaccgggcgccatgaccgtcgcgcggcgagtgccggggctgccctcctcggggagctgccggtgctgctgtggtgctgttgtgcctgccggcgtgtggggtgactgtggcttcccccagatgtaacctaatgccagccagctttgggaaggcgtacaagttttcccgaggatactgtaataacgtacaaatgtgaagaaagctttgtgaaaaattcctggcgagaaggactcagtggatctgccttaagggcagtcaatggtcagatcttgaagagttctgcaatcgtagctgcgaggtgccaaacaaggctaaattctgcatcctcaaacagcttatatcactcagaattatttttccagtcggtactgtgtggactatgagtgccgtccaggttacagaagagaaccttctctctcacaaaataactgccttcagaattacaatggtccacagcagtcgcactttgtacacgccgaaatcatggcctaatcgggagaaatccgaatggtcagatggatgtaccagggggctattatttggtgcaccaatctccttcctcatgtaccaccggtaccaactattttggtcgactctagtttggctatccaggcagttctgtcagggagtgacccgttgcgagtgccgagaaattattgggccagccacccaaatgccagggcatactc

SEQ ID NO: 525610 - DNA, 352 bp, Homo sapiens
gtcctttcagctcctccctcctgagcccctactgtctccccggccctgaatggcagatggtccctcctgtcaggagcttggcatcgccgagtccgttcttcaggcaggcccagggcctgtcaggtgaggataattggcagagacaggctggggaggggacagagaagttccatttggcatacgggtatgatcatggccacccccgccattcaggcttggaacagggttggatcgatcatcaactttgtcttcctgtcccagccttagaagctgtgtcaattgccagcgcgtgagtcattcgttccagtcccgtccccattccgggatgttggaaaccataaccatgcggccg

SEQ ID NO: 525611 - DNA, 558 bp, Homo sapiens
gtacatgtgatacccacgtttgtggtgggaggccagcagtacctgtgagtattcagaagcaacactcagggctggtgaccgtgacatcagtgttggaggaatatccgataccagagatcaggcaaggctcattaatcgagaactggtacatgtaaggtgacccatatgtttagccagtttggaagccagagcaacctagacacttactagaaccactcaagagatctgaatgggaaaagtgtttgggtttagtggttgtgtgttagtttacggtgttggtgtttcttataaccttggagtcagaggttaacatacagggaactttaccatgcaatcatggtcagaatcctagggctctaagagccacagaaaccactaaagctttcatgggtcttttgacccatcaaacaggggaagagtggtaattattgtctagttgagctaaatgctcgattctacacttattcataatccctaaaaataatatttatgatccacacagttccagagggaggtgggcctggccacagtcctcccaccacaaacgtgggatccgtg

SEQ ID NO: 525612 - DNA, 103 bp, Homo sapiens
gtgaattctaaggaactcagggggcacgtgggtcaggctccaccgccacagaggagccacagtctaccagactcatgggcgtttcccctcccagatatccccc

SEQ ID NO: 525613 - DNA, 1030 bp, Homo sapiens
  misc_feature (1030)..(1030): n is a, c, g, or t
cttggtggctcacgcatgcaatcccccagcacttcgggaggccgagatgggcagatcacccgaggtcagggattccagaccagcctggccaacatggtgaaaccccatccccacaaaaaatacaaaaactagccaggcatggtggctcatgcctgcaatcccagccacctgggaggctgagacaagagaatcacttgaacccaggaggcagaggttgcagtgagcagagatcgtgccactgcactccagcctgggcgacaagagtgaaactatgtctcaaaaaaaaaaaaaagggaaaaaaaggtccttatctttaagagatttttccggaaattttccctagttgacaataggctatcggaaattggctccagggtcatgtacgaggattgtccagaagtttggctgaaccactgttgcccatgagcgggtaatggctgaagatgactgatgagtacattgggcataccttaaatactcttctactacggcttaggaaggtatttaacattctccattgacaaacaggtttaaaccagggctggggcacgcaatgggtacagcttgaattcccagaaccctgggaggccagagccagggagatcacttgaggtggcgacgtctgaaaccagcgtggccacattggaacaccccggttccaccaagcttcaaagagaagacaaaaaacactttggggagcatgcgcctcagaaagtttttacaccctcgtggagcgggcccttgtaatgcgacacgggcaacgggtccacacggaacccgggaagacacgcgcgttcccccaaatacaacgcgggcggcaaggagtcttgaaacaccaggggagtgaggggcatagggactcacaggggccaggcgctaaatccccgggcgagagtcaccgcatacgaagagcaggcagacagaagcaggagagcaaagagacgtgctaagcatcatcacagacagaactaactatgagaatcgtataagtagtacgctcctcgctgctcatccacgtcctctcgcgctn

SEQ ID NO: 525614 - DNA, 1245 bp, Homo sapiens
ggagcctgcgcactgggactgggaagggggacccaccgcgatgggtccagccaccagccccctcactaatagctgtgccaccccggcaaagctggctggcatgcatgcatgcatgctgacgcaagcgtgcgacagatcacgagcagtggatggccgcagccacctgcgtggcctggcctggatgctggtgcatgcccctagtgcccccctcccctgtgtgcaccctgcgttctatgcaacgccattgtttgcctggggacccagcatgtctccacccttgcctgccgagctgactgcctgcctattaaatccatggaacggtggccaacttctactacgagtgcggactgcttgcgcctgcttgcagtacggcaggcaatggcgggtcatagccagacgggagccacgctctgtggtggccagaacgccgagggaacggtggaaacgatacgcacgatacgaagcgcaatactagttgccaagacggatcgaagcgaaagccaaggaagatcaccgcccggtcagaagtatatcagtcccatgaaaaccctgagtaccatggagtggtgccaccgcaccgcaaaggctgcacgggcagtgccagcggacagtcggggccagcgggaccaaccccattgcggagagggccgagattcccagcacactacagcccgcctgcaaccagccagcgaccacagtccctcaccatccggggacccagacacgccccacgacgagtataccccaccattcacgcacacataacattagtacaaaaaggaactaccacagagacgaaaggggacacgagtgacacgagaaagcgccaggacccgcctgctacatgcacaacctctagaaccacatggtagcccggcaactggctggcagttcgcccatatggtcacagggcattgatccacgacccgaggcgaagtagaagtcccggtgcttcacacgggcttacacataacaggtctaccgcaaaccagagctaagcacaactcataccacacaacaccaccactcgcaaagacaccggaacacaccacacacattcaaacacacactcaaacacccgcctcaacctaccaacagcgagacaaacaccctgacacacggacccaccctgatatcatcattccatacacccactacccccccacacacacatcaaccattaacaaccaacctcctcctatacatcacctctcatctctcctcacctattcccgcaacctcaca

SEQ ID NO: 525615 - DNA, 265 bp, Homo sapiens
caggatccccaggagtgatgccccagaccgtagttttactccagaggaaatggtagatgccatttcacacatggactccaccgttcgattttagaagttggagactgtgtgtggttccgcagaaagtctgggatttctacagagctgaactgcgtactccactcgatgttccagtgccagcatcacgccagaacgcaagtcatccattcgctgtctgagatttcgattgcatggtgagagaacaagactccccagggatttcaaa

SEQ ID NO: 525616 - DNA, 166 bp, Homo sapiens
ttgttaccttcactaccacacatactttgctcacctccagaataagatcatatgtgggagcaaatgcagagataagatgaacacagctcataatcacggcacgttgaccaacatccaatcaaattcagttcccaaaccacagcaaacactctcaggagtctccaaa

SEQ ID NO: 525617 - DNA, 109 bp, Homo sapiens
atttcagatcgcctctgcccggacagcccgtctgagaggtgaggatcgcctctgccgggcaggcgtcccgtgtgggaagtgaggagtgtatctgcaccagcatgcccca

SEQ ID NO: 525618 - DNA, 585 bp, Homo sapiens
agcggaggggggtcttgtgatgctataaagaaataactgagatggccgggcgcggtggctcacgcctgtaatcccagcactttgggaggccgaggggggtggatcacgaggtcaggagattgaggccatcctggccaacatggtgaaagggggggggtactaaaaatacaaaaattagctgggcatggtggtgggcgcctatagtcccagctactcaggaggctaacgcgtaagaatcgcttgaacccgggaggcggaggttgcagtgagccaagataacgccactgtactccagcctggcaacagagcaagactgtctcaaaaaaaagaaaaagcaaaaaacaaagaaaaaaaaaagttgagaggggtatttctacttaaggaaatagggatagtggttaaggaaaagaggttaacatgtgggcatcacagttccgcaggtttgcaccaggcatggcacgcaatagtctgcttagcatccagtggagagggccttaggaaggctgacaactcattgctggaaaagcaaaggggacgccaagggtatcaccggtggcaagaccagaacaaggtgcggtgtgagga

SEQ ID NO: 525619 - DNA, 784 bp, Homo sapiens
  misc_feature (10)..(10): n is a, c, g, or t
  misc_feature (76)..(77): n is a, c, g, or t
  misc_feature (79)..(79): n is a, c, g, or t
  misc_feature (105)..(105): n is a, c, g, or t
  misc_feature (107)..(108): n is a, c, g, or t
  misc_feature (111)..(111): n is a, c, g, or t
  misc_feature (113)..(113): n is a, c, g, or t
  misc_feature (117)..(117): n is a, c, g, or t
  misc_feature (120)..(120): n is a, c, g, or t
  misc_feature (176)..(176): n is a, c, g, or t
  misc_feature (188)..(188): n is a, c, g, or t
  misc_feature (202)..(202): n is a, c, g, or t
  misc_feature (213)..(213): n is a, c, g, or t
  misc_feature (236)..(236): n is a, c, g, or t
  misc_feature (254)..(254): n is a, c, g, or t
  misc_feature (289)..(289): n is a, c, g, or t
  misc_feature (330)..(331): n is a, c, g, or t
  misc_feature (397)..(397): n is a, c, g, or t
  misc_feature (403)..(404): n is a, c, g, or t
  misc_feature (413)..(413): n is a, c, g, or t
  misc_feature (446)..(446): n is a, c, g, or t
  misc_feature (456)..(456): n is a, c, g, or t
  misc_feature (684)..(684): n is a, c, g, or t
  misc_feature (700)..(700): n is a, c, g, or t
  misc_feature (706)..(706): n is a, c, g, or t
  misc_feature (735)..(735): n is a, c, g, or t
cgcaccaaanagatatccaataatacaaattagcttcaagttacacatactgaacaaaagaggttgagcgaaccanncncgggaggagtaacgggaaccaggaancnncangngganggngaagaaacaaaaaaattaaacaggcatgcaggctttcccataccaccttcaacgcnaacctgcttcantgggagagtaaagnaggcaagaatnagcagccacggattgttgaactnttaccagcaccatgcccnccagcaacatttcagcggagttggaaacatttttnacagcaaaaccattacaacgaagtccctccccaaaccaccnntaaccatcccaagccaacacccaattacttgcaaacactggtataaaacacagtttaaacaattanaaaaannaaaactganaccacttatgcctctatagtgtgattaacctcnctcttagatncccgaccacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaactttttgaaaactgtttaaaaaaaaaaaaaaaaaaccaacnggggggggaacctaanattctngagaccaaatgtaaaaagtcaaatttggntggttctcaatagacaatgggggagtttccaaagggtggggatggggag

SEQ ID NO: 525620 - DNA, 382 bp, Homo sapiens
aggagattcacactcattcacacactaacccgactcattcacacactaacccactcattcacacacacacccattgattgacactaactcacccactgattgacacactagctcacccactcgttcacacaccctttcacacactaacctactcattcacacactaacccattcattcacacactcacccactcattcacacactaactcacccactcgttcacaaccgattcacacactaacccacccattcatgcactaacccactctttcacacaccagctgacccactcgttcacacacccactcatttacacactaacccactcgttgagacaccctctcattcacacactaactcacccactcattcacacactaa

SEQ ID NO: 525621 - DNA, 166 bp, Homo sapiens
attgctcccggcttgatagatgcccacctgccttacgccagaccactggtcgtgcctcaagtgatggacataaccctctcgtaggacatacatgtaaatgcacaatgtgactcattgtcatacgtttttgttcagctatgagcctcaaaaaaaacgttggcggccg

SEQ ID NO: 525622 - DNA, 245 bp, Homo sapiens
cctcgatagccgacgacatgagatctggttggaggatggcgggtctgcagcacgcggagtaaggtggagcacacatggccagaaactgtagcaggactgcaggcagtgtacaagcgctacatctgagtgtagaatgactgagctgacaagctggggagcaagggcaatggttaaaacacaagctcaggggctaggggtatatccctgatgtcacatgggcagccatgtagggtggatttggcatg

SEQ ID NO: 525623 - DNA, 165 bp, Homo sapiens
catcgagccggccctacttatgaggctctgaggactgggggctggatggtctgaagcctctgggtttccttctagaaaaggtgagtctgaggtcccttggaatggaggatatggtggcttgtggttctgaagtccctagaaactgggaacatggggtctgagacg

SEQ ID NO: 525624 - DNA, 233 bp, Homo sapiens
agatccccgctgtcaaacaggtggagacgagtgaggatgtttacagttgtgctatctttgcctctcatgccggaatgtgtcagggccatgcatcaaaaaatgggcgtatggtcctagcattactagatgcagttgctacctttcgcatacgtcatcgagcccgtgatcagctgaagcgacgcataagggtgcatactggtgaggctgactgtcactcgctagtgcctagttta

SEQ ID NO: 525625 - DNA, 208 bp, Homo sapiens
acttcaccaatctcatgaggagagggcacatgctgagaaacatgataagctgcagaaccaacgaggctggccaaatcttccttcaggatatctaacgaaaccagactgtgagtcactgggagagcgggctgaatgcaatggagtgtgcattacattcggaaacaactgtgaatcagtcactactgcaattgcactatctggtcactga

SEQ ID NO: 525626 - DNA, 254 bp, Homo sapiens
tctccccgaaatgcatttaagtgcagcgttgcgtgtttcttgttggaggtagagcgactggatggtttagcgggactatcatcttatcgacatcagccaaactcccaatgccaacaaggtgagagcgcggcagtgagactgccggggataagctccctgggtcgagagggaaacagcccaaatcgccggctaagggccctaagtgtgtactaagtggaaaaggatgtgggatcgcgaagacaaccaagaggttg

SEQ ID NO: 525627 - DNA, 345 bp, Homo sapiens
accgattagcaggactacaggaggaaggcgatgaatgtatatcatgcaacatagatacaacagtaataaatccccattcaacgggctggcctgtcggcctgatggtgacacacattacgcttgccatgcacggagactcatagttcaaatttcaactctagcttctctcatgccccagatcagaaaagaagtgaagaaacactgctacgcacttttagccattcaaactcacaggaagggaatacatcatgtctacaaccactagctactttctgctgaaaacctgtgaacacaagagctctagagaacaaagtctggactcccatccatgcaaactgtcggggc

SEQ ID NO: 525628 - DNA, 399 bp, Homo sapiens
ccattatggccgggaggtcaggtcagggttaaacagagttgattgtttctgcaaaactggagcactgtggaatgtatatctagctgaattaggaaaagaaatggaaaaaggaaagaaaatcaccggtgtagtttataactctgtgtgggctgaacccagccatccctctgtctctattcactttaagaggtcaatctgctttctttttaacatctcttctttttttaacatgaacaaataacaattttaaatctccaatatctggattatgggactgaatctttgttattttccttggacttacaatcatggaatattatgtctaagattatttttaaatagttcttttgagaagggtgctattcaatatttgatttttattcacatccaatgtgtgcc

SEQ ID NO: 525629 - DNA, 440 bp, Homo sapiens
gcaggagccatggtgcgggatctataccactgcacagagttctgcctcggtgcgtggctaagtcatgtgcgtgcggctgcatgtctggaggattgagaagctggagctggtgcccgtgccccagaagcgctcacggcgatttctacgtcggggatgcctacctggtgctgcactcggccaatgacgagccgaggtcgttcacctagcgcctgcaacttctggctcggaaaggagtgttcccaggatcaaagcacagtctgctgcctatcttcactgttcagatggatgactatttagggtggcaacgccagtgcagaatagagaacttcaaggatatgagtctaatgactttgttagctatttcaaagtgcggtctgaaatacaaggctggaggcgtggcatctggattaaatcatgttcttacgaatcgacctgacagc

SEQ ID NO: 525630 - DNA, 419 bp, Homo sapiens
tttccttttctgcactttaggtcttttaatttctttttccttttttgtttttgccttatcatactagccctatactaagtatctaatataccatcatctcatctttacaacaatccaatgttattccaatttaacaaataagaaaatgtggctcagaaaggttcagtaacttgtccaatcaagattgcacagctattagtagatctagaattcaaacccaggtagtcttattccatacctgtatgtacgactactagactagcttataaatttggaaaactcaagggcacaagaacaaaaaatgttatcaaattaaaaataggaaaaaaattccattactggcaaagaatatgaagagttcacagaagaaaaaggcatttattttaaatatgaaaagatgctcaacccctctcataatg

SEQ ID NO: 525631 - DNA, 162 bp, Homo sapiens
gtacaaagaggcacagtgaggtgaagtagcagcccacactagtgcctcctcgctcactacaccaccccctgcaccacagtgcagcctgcttctcccaccagctggggttccttgtgaaccccaagcctgggaagggggaggtgagtttacaaacatggcaag

SEQ ID NO: 525632 - DNA, 660 bp, Homo sapiens
cccttccctgccttattacaagaagtatcgtactagcccccctttgtacctcttaaaggggattctccccccctttccctccccgctaattacccagcgttctctccccggtaagtgacttttttatccacccccttctacccgactatgacttttggtaatttttatgaattcattcgtgagtataaaactctctcctgcgccacatatccacttcccttctccacaggggtttttaatcccgcgcgcagagaaattttaataatccacccagtgtttattagccccccctttattcacacagtgtcttgctgacagtatgtaggcccgcacgtgtattatgatattgtgctccctgcacttgcctcccctcttattaaatattccctctggggccaccacgtgtggattacctacccccccccccatattgtcttcacccgcgcagtgtccctcacacaagggacttgcgtgaccctcttctctctttgtgaaatattttccctaccacatcaatcaccccaaaaaagagaggtgacttctctcttctctcttccacccgccttttcttttgaaggccaccaccctctctttctcctctgattgatctcttacccctgcctccaatgagagaccccaccccatcaataaaaccaaaat

SEQ ID NO: 525633 - DNA, 510 bp, Homo sapiens
gctgtccctgcactctggctttaaaaaataacgaagttggtgagacagtggctcagcttgtaatctcagaactttcagagctcacgagtgatccagctgcccaccctcccaaatgtgctggggttatagggtgtaagccacctgtgccgtacttacgctgcacgttcagactgagaaaacccagacacagagaggacaggtcacttgcttggtgtcaggacaggcctgttctgagacagccattcctacaggacgctcccactgtgtgggccctgggctcctccccagcattcccagaggcagtggtcatgcaccaggccttgctattgggggctgctgttgagggctgcgtcctgggctgtggggtgtaccctctcctggggcgatggctgtcacccacctcttgtctaccagttacaaaagagggagcaaaagtaccttattcacaggtgttggtataacttagtcataacgttcttgcgtaggtgctcatccctcacatggttcctg

SEQ ID NO: 525634 - DNA, 158 bp, Homo sapiens
taatatagctcagaacaggctttggtcgatggaccttgcactcaagtatagagagacaggcatgcctttcaagtgcatgcagatcactgatttcatcctcaagttatccgcacagtgcccaccataagtatgtccgacaagcctggtagaaggcagac

SEQ ID NO: 525635 - DNA, 460 bp, Homo sapiens
  misc_feature (145)..(145): n is a, c, g, or t
ggaaattctccttaatatttatcagcacacagtatgctcgaccttaagtgaatttgagcgcagcccgagcccattcttggtcctgagagtggacagggttcacagaagaacgagtctggtttctgagcctgtagaagagacccgnaagcccctcatcttgatcgcggtgagaacacagggagcctttggaaacgctattcagccacggtagttaagagctcctgttctgatccagggagacctgggttcaagtcttgactcagccacttccaaggtgtgtgagtcacagaaaaaaaatcacttcacctcttagaacgcaatttcagcttgtgtaacaatctctaggttagaaggaagtggggcgggtgagggcgggagagggaggaggagaataaaacacaaacactctctctaggttaatagggagaaagggaggattaaatgagatgatgcatgtcag

SEQ ID NO: 525636 - DNA, 100 bp, Homo sapiens
agctgccgcacaagtaacagttccagaagttctgaggctgtacatcggcccgctccccacaatgtaaatataaagttatttggctcattcccaggtccaa

SEQ ID NO: 525637 - DNA, 728 bp, Homo sapiens
  misc_feature (359)..(359): n is a, c, g, or t
  misc_feature (655)..(655): n is a, c, g, or t
  misc_feature (663)..(663): n is a, c, g, or t
  misc_feature (726)..(726): n is a, c, g, or t
ggacaacaaggcaccaatccttatttgactcttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtntggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatgggcccacgcgcctccagggcaccacttcagtcattggtagaccgagcgtcaatgggctggcatatgctggaatatgttcatcttacagaggagaacaggcttacccagagtattnttattcantttaccagatccttgaaagccagaagccctttccccagaaccgcaacagccgcagagcaggangg

SEQ ID NO: 525638 - DNA, 314 bp, Homo sapiens
  misc_feature (4)..(4): n is a, c, g, or t
  misc_feature (124)..(124): n is a, c, g, or t
  misc_feature (134)..(134): n is a, c, g, or t
  misc_feature (172)..(172): n is a, c, g, or t
  misc_feature (189)..(189): n is a, c, g, or t
  misc_feature (237)..(237): n is a, c, g, or t
  misc_feature (271)..(271): n is a, c, g, or t
gggntgatgggcgtccgccgccgtgcctgggtaaatttctcgcatttttagtccagatggggtttcaccatgttgggcaggctggtcttgaactcctgacctcaggtgatgcggctgccttggnctcccaaagngctgggattacaggcgtgagcaccgcgcctggccccanatgtcatgtttttaaanaaaaacatagaaaatggtagtaaaggttcacagcatcaccaagaaaanagggccccagtgtcgcggaggcggagatgtccangccagtcctacaccctctggggctcagggaattcccttcacgg

SEQ ID NO: 525639 - DNA, 253 bp, Homo sapiens
ttttcccgggggggggggggcccccccccctttttttttttgtttcccaagggggggggggggggggttcccctttttttttccccttctgggggggtggggggggggtttttccccccccttttaaatttagcccccgggggaaattttttttttcccatttttccccccgggggggggtggggttttttaaggggggggtttctttattttttggggcccaataaatggggggccttgggcccccccccga

SEQ ID NO: 525640 - DNA, 332 bp, Homo sapiens
  misc_feature (155)..(155): n is a, c, g, or t
  misc_feature (234)..(234): n is a, c, g, or t
gagctagcgatagaaatgcgaatggacgcttgtagacagtaaggactcaatacgtgggtttgttcaagttatatcgtgcagacaggcatatgcagttagaaaatctgtctagggtagggagagataaaaccagccacttcagccctgctattttnatcctgaagattttttttttactctgtttatgaataaaacattttaatcagtgctgtatcaacactgatcaattttttncatggaagtgtaatacagggtgaattccattaagtcaattaaatacttagatccagtttttaaacagtgcggaggtagttaagctcttcttttattga

SEQ ID NO: 525641 - DNA, 899 bp, Homo sapiens
ggccggtgacaagtgcgccggcggccgaggcgtgttcctgctcctggcggtgaatgtcgtgctgcctgagcactactgatgctgatgcgatgctcatcctgtgcgcacgtgggggcaatgagctgcagcttacggctggtgctgtgccatgtgcgccgcctctttctattggtgcacccctggtgccccgaggacgaggcgcgcgcggagcggctggcggagctggtggcgctggagtgcgcgcgagcacggcgacgtgctgcagtgggccttcacttgacaccttcctcaacctcacgctcaagcacctgcacttgctcgactggctggctgccacgctgtccgcacgcgcgctttctgctcagcggcgacgacgacgtgtacgtgcacaccgccaacgtagtccgcttcctgcaggctgcagtcaaccctgtgccggcacctgttctccgtgccaggtcatggagggctccgttgcccatcctgcgaccaggtggagcaagtacttcgtgcctgcctgcagctcttccccgggttccgctttaccctggtgtactgcagctgtgcggctggctttcctcctgtccggcaccactggcccgggccctgcgcgctgtgtcgcccggtcacaccccgctcttccccatcgacgacgcctacatgggcatgtgtctggaggcgcgcctggccttgcggccagccgtccacgacgggcactccgtgccttacgggcgtgcagcttgctggccgcacagaaggtcatccttcgacccctgcatgtaccgcgagttgctggctggtgcaccggttacgcgcccctacgagatgctggttcatgtggaaaggcgcttgccaggccccgggctcagttgtaaccggggacacggggtcacctcagg

SEQ ID NO: 525642 - DNA, 221 bp, Homo sapiens
gccaaaactgacttcaaagtgtggggagggttcctcttcccgggacgcagccttcccgggcgatggcagacggtgccccggttagacatgagccgctgaccaccccgcgcagcccgtagggtgggtcacggatgcacacctggtcctgggagagacggcgcccgttctttccgatcccgcggccctctcggttgcggtccatgcgcgcattcctggggggt

SEQ ID NO: 525643 - DNA, 719 bp, Homo sapiens
  misc_feature (660)..(660): n is a, c, g, or t
taagcgcgaggagccgccgcaccaccagcgcagcagtcctggagctgtgaggagattccgggccgtcaccctgcctccccgtgcgtcccgccaccggccgcttctgtcctcggaccccattccaacaatctcgtaaaacatgctggattactatgaagttctaggcgtgctgagacatgcctcacccgaggatacttcaaaacggcatatcggaaactggcactgaagtggcatccagataaaaatcctgagaataacgaagacgcagagagaacattcaagcaacgtagcggaggccttatgactgtgctgtcggatgctaagaaacgggacatctatgacaaatatggcacagacggattacaatggtggaggaggaggtggaagtcatttcgacagtccatttgaactgggcttcacattccgtaacccagatgactgtcttcagggaactctttcggctcgcgaagggacccaattttccatttgacgttcgttcgggcaacttcagtacttcctaaggacattactacagctgccgtgtgaccgcttgtctcacttttccagtggtcgtagcaggaacagcgtcttgacctcccttcagtgacgtgcaccggagctgagtttggcagtgcctatcggtcctccatttcgcatacngaccttttgagggcttctttgggactccgccgggtcccgtggatctgtacccctgccgg

SEQ ID NO: 525644 - DNA, 661 bp, Homo sapiens
tgctaccgtgactaaaatggaagcgttttgggggtcgcggcccgaactctgggcggggggttccggccccaggacagttttaccgatttccgtccactcccgatctccttcatggatccggcgttcttgcacttttacagaggctccaattcacgcggacccagaaccccagtggtgaccgggacctcagtcctcggcgtttaagtttcgagggcggagtggtgattgccgcagacttgctgggactcctacggcctccttggctcgtttccgcaacatctctcgcatttatgcgagttcaacaacgagtaccagtgcgtggggtgcctcttggcgactacgctgatttctccagtatttttgaagcaagtttctcggccaaagtggtgatttgatgaggagcttcgtgggaaatggacacagttatagtcctaaagctattcattcatggctgaccagggccatgtacagccggcgctcgaagatgaaccctttgtggacacaccatggtcatcggaggctatgctgatggagagagcttcctcggttatgtggacatgcttggtgtacctatgaagccctttcgtggccactggttatgggcatacttggtacacctctgtgcgaaaatctggaaaagcgcagtgttagcagacgagct

SEQ ID NO: 525645 - DNA, 179 bp, Homo sapiens
tccccgcctcatccgtacaccaccatggtgacccgccctcagtctccttctttattattaggaaaacaacaacaacaacaaacaaaaaaatggcgtccatgaatatgaacagcattgtcagatgaattagttgaagtggtttttttttttttttttttttttttttttttatatttttt

SEQ ID NO: 525646 - DNA, 430 bp, Homo sapiens
  misc_feature (312)..(312): n is a, c, g, or t
gtgtttgtttaacctggttttttttccttcaatatcctttaaaagaatagtaactgtgtgaataaaactttttagttactcttgatactatggtttagcaagaactgtagacttaattggttgagaaaagaacatttaaagtaaatgaatgctttagtaagttaattatttcttagcatatcacaaatatatgtagaaagaataagatctcattctatagctttattcctaggttattaaaagcaaacttctatggaagttagttctcattaggctatatatatatagtgtgtgtgtgtgtgtgtgtgtatntatctatacatatatacatacatacatacatacagactatgtattgtaatccattggttattgtgttggggatgtgggatcaaaagaatgaaagcaaaagatgacttatgtaaatagc

SEQ ID NO: 525647 - DNA, 295 bp, Homo sapiens
ggaaaaaacacccttttgcccgtgggccctgggtgggccctgggggaccatgtggccccaaatgttggggccccctgtccccaaaacatttccccttgtttcccggggggccttttttgccccttgtcctgaagcccagcgacccaaaaggggggggggggggtttatggggaaaaagggagcgaggtcaaaggagggcatgggttggcagggggggggtttggggccccctatgcgggcttttcccccccaaggacccaggcggcttcccaaaaaaatttttttttttcccgga

SEQ ID NO: 525648 - DNA, 181 bp, Homo sapiens
actaacggaactaacgttaccctaggtataacagcgcaatcctattctagatttcatatcaacaatagggtttaccagctctatgttggatcaggacatcccgatggtgcagtccgctattcaaggttcgttttgttccatcgattaaagtcgctacagatcttgaattgatcacggggat

SEQ ID NO: 525649 - DNA, 449 bp, Homo sapiens
cgcatgcgtacactaaatagaaatcagaatattagctaggcgtgatggtgtgcccctacagtcgcagtcactcgggaggctgaagtggtagcattgcttgagcccaggaggttgaggctggagtgagccatgatcaagccactgcactccagccgaggagatggagattgaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacattatggag

SEQ ID NO: 525650 - DNA, 164 bp, Homo sapiens
ccgctacggacgccagctcctttcatccaggcctgtggtgggggcaaaaagaccatgggtttgagggggcctccacttcccctgaagacgagtaccctggcagtaacccccagccagatgccaccccgttccacgaaggtttgaggaccttctaccagctggac

SEQ ID NO: 525651 - DNA, 112 bp, Homo sapiens
gccttgtcccgaatcggcacggggaatagtttccgcctagggctataaggtaggaaattttttttcaaccaaaaaggggtggccaaaagtttgaggccccaaagatgggggg

SEQ ID NO: 525652 - DNA, 4105 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggat

SEQ ID NO: 525653 - DNA, 137 bp, Homo sapiens
aacgagcagggcgagtcatattctttattctgcctcttcctacatattggtacgaggcgcttatattactgatcatttctctactcagaaaccttaaacatcgatcattatcctcctgcttgcaattatagcaactg

SEQ ID NO: 525654 - DNA, 4282 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaggcggcggggcggccgacgagaaacaccaccctcatccggaggagccctaaaaaacagagacgacacaccacatgtgttattatgagaacacaacgggtgggccacaaaaagaaggacaactactaacaattaaacaaggaagacgaggccacgaccagagtaaaagaaagaagctgcgaccaacgagagacaaacatacgcacaaccagaaggaccactgcaaggaaaaaaccaaccatccacgccagggggaggaacacacagaggagagcagcacccaaccaggaagaaaaatacacacccaagagcaaacaacacaacacaagacagcaatcgctggacaaaaaaacaaagtaaacacgcaacgaacaaaactcgccaca

SEQ ID NO: 525655 - DNA, 3750 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525656 - DNA, 145 bp, Homo sapiens
cacgaactcggttgctgcacggggtctgagtgtctgtattctatggagaattctataattgatcatgtgacgcaatagtgctacgggaatgcaatattactgagacatagtctattttaaagctcagagcgagttctccggactg

SEQ ID NO: 525657 - DNA, 361 bp, Homo sapiens
ttcttgaaagactatcacaacgcttggcagctgtcctctggcattcccagaattcctctttgatctgtacggacatatggactagttggttatatcgaggatcagttatcagaagaactattcagtaatatgaatctcatccagattatgcattagaggatctacgactagataatgccattgcctgaactgagagaccattttcagtcctatgatttggatcatatggaaacaaaggtaccacagtcatactccatggattgtgatcctcgctaaaatatttcgcacagaggtataatgaaacaaatggaccgaattcctaaaacgtataaagaacaagaggactacagagattagatta

SEQ ID NO: 525658 - DNA, 3654 bp, Homo sapiens
  misc_feature (106)..(106): n is a, c, g, or t
  misc_feature (113)..(113): n is a, c, g, or t
  misc_feature (115)..(116): n is a, c, g, or t
  misc_feature (3645)..(3645): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatcccgcttagcctgcctcacccacacccgtgtggtaccttcagccctgtgncaagctaat

SEQ ID NO: 525659 - DNA, 1651 bp, Homo sapiens
gtgaggtgccctagattattcccgtagcagcgcagccaatcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525660 - DNA, 132 bp, Homo sapiens
aacgacagctccctaacgatttgtaacgacgctcctaacgacgcctcgtaactagcgcttcctaactgagccctccgtacagcgcctccctaacaccccctgtactcctgcatgcggcgctcgttacaggag

SEQ ID NO: 525661 - DNA, 250 bp, Homo sapiens
gtttgtgtcagttttttgatgacctaatcccataggagaaggcatgactccttttttacttggaggaaagagaatggtctaaatggcaatagcagtggttttatttatggaaggtacattggaaaatatgcttttaaatcccatgttaggttggcattcattaagggggctaggggccaggtgcggtggctacgcctttaatcccagcactttgggaggccgaggtagtggatcagtgaggtcagtattc

SEQ ID NO: 525662 - DNA, 3750 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525663 - DNA, 282 bp, Homo sapiens
tcttttcacccccttaatatcacattggtaaaggaaaactccacgctactggctcaacatgagagggaacaaaacatgacactcacggcctgggccacgttacccgaagaagacagatagtgatcatcattacccgtaataggagccatttttcatggagtagcctagttgaagacagtcgtaggaagcaaggagggacaacctcaaattgagattctgaatgggcgagatacacttccctggccatcagtgctagccaatcttgataaagaccagataagc

SEQ ID NO: 525664 - DNA, 146 bp, Homo sapiens
aggtgcgtaagtcttcaacgccagaggaggtgacgaagcgcaaggcaggcggtgctcttctgcctgagtgagtgcacaagaagaaccatcatcctggaggaagggcaaggaagatcctggtgggcgatgtgggccagactgtcgac

SEQ ID NO: 525665 - DNA, 3601 bp, Homo sapiens
  misc_feature (106)..(106): n is a, c, g, or t
  misc_feature (113)..(113): n is a, c, g, or t
  misc_feature (115)..(116): n is a, c, g, or t
  misc_feature (3564)..(3564): n is a, c, g, or t
  misc_feature (3589)..(3589): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttcctactngaacgtgatcccccttttccagatnagcgatgggcta

SEQ ID NO: 525666 - DNA, 1607 bp, Homo sapiens
  misc_feature (14)..(14): n is a, c, g, or t
  misc_feature (22)..(22): n is a, c, g, or t
ctacgtcgaggccnggtgttantcggccgaggcaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525667 - DNA, 476 bp, Homo sapiens
  misc_feature (7)..(7): n is a, c, g, or t
  misc_feature (105)..(105): n is a, c, g, or t
  misc_feature (107)..(107): n is a, c, g, or t
  misc_feature (167)..(167): n is a, c, g, or t
  misc_feature (194)..(194): n is a, c, g, or t
  misc_feature (210)..(210): n is a, c, g, or t
  misc_feature (232)..(232): n is a, c, g, or t
  misc_feature (267)..(267): n is a, c, g, or t
  misc_feature (286)..(286): n is a, c, g, or t
  misc_feature (289)..(289): n is a, c, g, or t
  misc_feature (292)..(293): n is a, c, g, or t
  misc_feature (444)..(444): n is a, c, g, or t
ggcacgngggcacgcacacgtgaagtgtggaagtggaacaagtggcgtcgtcgtcgtgtcaggcgggccgtggacgtggaaagtgtgtggaaacgtgggaaaagngngtgtggtgagaagagggtcaaggtaaggaccgaggtccaggcaggaccgaaggcggccgntagaggaaggcacaggcaggcggcggngaagggaaagagcggnaaggaagcggggcggccaggcnagaaaaagggcaccaacagggggcggaggcagggngagggggcaggaagaaacnacnagnnagagaggaagagaaggggagcagaagggacggggcaacaggggcaagagaagcaaaagccgggagagggaaagcaaggaaaacaggcacaagaggagtgcggaggaagaggcacaaggagggcagggggaaaaggaacagaaggaaggaanccaaggagcaagggaggggcggcttgagtgac

SEQ ID NO: 525668 - DNA, 263 bp, Homo sapiens
tggaccttattaacactttatggacagacacaacacgtactgtttgtgctcgcacaaggccgggcaaccgagcctgatcccggtaaaatctgtcggagcggcagggccggcaggggagtgcgcttcccagggcacacattcgctataaagggtgtaaatgactggtccagcaagtttctttaccttcccacacccctcttctcaaggtccccccagagtcctcgggggggccttcgacctgcaaaagcctcacgaggagtgcg

SEQ ID NO: 525669 - DNA, 666 bp, Homo sapiens
  misc_feature (239)..(239): n is a, c, g, or t
  misc_feature (298)..(298): n is a, c, g, or t
taaggaaccagaatctcttattttttctcgggcgcccctcccaaggataaggttttttaaaattaccccgggccaaaacaaaccctgtcgcgcccacgcccccaggttcaaggcatttgttctattcggggcacccaacgccccctctgttgggggttaaggctcccaagaagggggccccccccatccgtggggccattattttggccaagttttccattgtccccgtggccaaaggntattgggggaacaaaattggcaagcccccccctgtcccttcaagagggacaggcccctncggttttttgttggtacgccttatccctgcacccagggggaatgggtttgtttccccccccgggcctaaaaaaagtgtccaaattggtgggatttaattatttgttaccccccagcccgggggtgccctgcccccctggggaattttgccaaggcccccttttatgccatttttaaaacctacaggtccctgcccccccccctttggaaggagacggtattccccaagtttccccatcaggggttccctgccccccttgtcaaaaccccccccaaagtttctcgggcaggggactcaaggccccaccttgggtggtcccacaaaaggcgtttttttcccacaaaaaaaaaaggtgaattaacgggtga

SEQ ID NO: 525670 - DNA, 1705 bp, Homo sapiens
cagccacagtgtcatagtccaggaggctggcctgtagtgacccatcgggggtaggtatcatcagcaaagatgataagcttggttttcaatttacgcttgtagcggaacccaggatgaaacttttcttggacatcagatacaattaccctatgtccgatagtctggatcccagagatataattggcaatatgcttattctcacattttcggagtaacttcttctttcccaggtcatagacacgcaacagcttccccacaccaatcaacaccctcccctggaatggggcaatagcagcaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525671 - DNA, 244 bp, Homo sapiens
ctgagtcggcggcggctgcgggaactttcccagcggatctaatggctgcgcgcgggccggctgtgaggcgcggcggcgagcgacgggcgcggggccgcggagcagcgagcgagcgagcgagcgcgaggccggagccccggcaggcccggcgacccgccgagcccgcgatgcgccccggggccgccccccggcgcagctgacgccccgcggcccgcgaagaccccggccggcggtcccggaggaa

SEQ ID NO: 525672 - DNA, 1426 bp, Homo sapiens
atggtcatagcgtatttcagccgggccggcttcccctcctggcaataccaacgcattcatttcttcctggctctgtgaggaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525673 - DNA, 245 bp, Homo sapiens
tcgtgcgtgcccacgatacacgatatctccctcgtaggaggtgaaaaatgcaaatatcatacgctggcatacgaactcgcttcagcttatacttagaactcataggctcttgattggcccccaaaaatatttttccttgtccttatttcaatgcccaactcaccacacaccacacaacagggcaaacacataaacaggcttgaacatgtacatgtctcaagtcagtgtcttgttcaaccaacaaa

SEQ ID NO: 525674 - DNA, 367 bp, Homo sapiens
ttttaaaaaaagttttttttatccccccccatcctggggaaggtaacaatccccccttaacacatttcagttttaaaaccggggtgatttggaaaaaaactttgtcccaattaaattgtaaaaatgctatggattcaaaagtaaacccggttgattaatcaaacaagctggaaaaccccggttaatttttttgttggaaattgacccccggaattttcccctacacgtcatttaaattttggaaaaaaaaaaacattttaatttccaaagcttttaacagggtgacaaaaaacttttccacgcagtaaggcagtcattttttccccttggaacggtaattcaaaaaaatttaatccggtttgggcca

SEQ ID NO: 525675 - DNA, 183 bp, Homo sapiens
  misc_feature (66)..(66): n is a, c, g, or t
gacttctttgtgtgttgccacgttgtagtacagtggtgtgatctcagactggcaacctcctcctgnagagcagccccgtggcagaactccacccccatgacccaatcagatctcacatggagagcactcactatcctgagagcagcccctgggggaactccacacaccaacacaccaaggaag

SEQ ID NO: 525676 - DNA, 132 bp, Homo sapiens
ggagcaaaatgcaatgaaaacatattttaatgggatgaaatttctatgcccatctctatcatcacatgtaaaaaaaaaaggaaggggggctttcaaatttaatggagaattctaatgttttaatgtgaactt

SEQ ID NO: 525677 - DNA, 291 bp, Homo sapiens
gcgcttactctggttactgctgctgctgccaggagtcctcggctcccttcaggcgccgttcaaaccaggccttggctccatccatggtatgtacctgacctggaagcgctgccactggctgcaggagagtcttcaactaccgggtgcgcaccttgtgcttcgggatctgcctacagagctgctcctgctgacgctgcttggcttcacacacctatcgtagctaacactcatagcgggcacgcaccgccagcatctccttctaatgccgtagacgaactgctcccagctcta

SEQ ID NO: 525678 - DNA, 367 bp, Homo sapiens
gcccagccctaagtgtgaatagttcttggcgtgtataaatgacaaaggagtttttcctctcctaagggcttgatgttaacactaaatagaatctgattttgactcctaatgcagcacattgctgtacacatttacagaatgtttgcagaatctctcctgatatttttcatgctggtcatgacctgaaggaaatttcttagcacgaatattgtgtcaggtatttttaacttgatcatggtcagctctgaggtgcaactgtgtcttcccgtgctgcacccctgtgaccactctggggtgtgcagcctgaatcatgctgttagaactgttgtggtacaagctccaaataaaatttattaataggatctat

SEQ ID NO: 525679 - DNA, 498 bp, Homo sapiens
tcgacagccgcaccagcgccgccaccgtggcggcggccgaggcccaacgcattggcctggcgcacgtgtcgcgggatgtattcctggacgacgtgcgcacgcccgaggcgatcacgactcagttgcagcaaggcgtggccctggcccacaagcagggctccgccgtgctgatcggccacccttacccgcaaaccttgcaagtgctggagcgtgagataccccggctcaagggccaaggtatcgaattgatcccgctgcgccagatgatcgccgaacgtggcaaccaggccatgcctgcccatggcgggcacgggctttaccataaccgctgacccctgccagcgcctattcaagcgaacgggatgatgtccttcacctgctcataggtgagcgggccccggtgaatacgctcaccttgcctggccagctggacggcttcggcacgaccgtagaaacgctgttgccaggttttcaggtgcgcccgagcgaactcatggg

SEQ ID NO: 525680 - DNA, 550 bp, Homo sapiens
ggtgggccactggggttgggcccaagaggatttccacatggaggtggtgggggtgggagaaacacacagattggtgtttggaggtgcccctacccccccgggagaaaaataacttttctttggaggaatgaatcaccccagtgtagggcccctcacccaaatggcccaggagggggccagtgggttctcccatgggggggaaccacggggaatatttttttggtggcaaagagggctattattaagggggcccccggggcccggggggggcccttgggggtttccaagggggccggggggggggggaaaaagggggctttgcccccgccaaaatggtttccaggggggggcccaaccaggttcccgggggggggccgtttttattaggcgggccccccaggttttgggaacagctttttttccgggccccagggttcccccggtttttttggaccctcccaattcctgttcccccaagggtttttttggggggggatagggaattggaacaaacccttggggtccccttaaaagggcccctttttgttta

SEQ ID NO: 525681 - DNA, 381 bp, Homo sapiens
  misc_feature (114)..(114): n is a, c, g, or t
gctcgacttctgttctcgcaaaatccccagttcgcgggcgctggaaaaataggtcagtgaacccagcgcgatggccgccacgactccctggcacgcggtgatgataatacggtncgagttccgcgggttgtcggtcatacagggatcgtcccagatagagggcgataagaatcaggccggcgataatcgaataagaggtctgttccagtgtcatggcacccttccttgggttggtagtgtcaggtgggtgttgtgacccataatccggccagggcgcccagcagcaagcccgccagcagtgcaccccccatgttgggaagagcatgccagccagctcgccccccagcgtcgtggcgatcatctggatgtccatcgtcgacg

SEQ ID NO: 525682 - DNA, 316 bp, Homo sapiens
ttgaaatgcagtccaaggaacacagttaaacagtccaagggttgaaagatgacatagccattttaggaaagaaccaaacagaacttctggaaatgaaaaattcaccacaggaatttcagaacacagtggaagtattaatagcagaaaagaccaagctgaagaaagaatctcatagcttgaagaccactcctttgaatcagtgcagacagacagaaataaaagagatagaattttaaataatgaacaaaacctccaaaaaatatgcctacatcaagaacttagaatgatcaccaatttacaacctaacatcaccatg

SEQ ID NO: 525683 - DNA, 1243 bp, Homo sapiens
  misc_feature (757)..(757): n is a, c, g, or t
ggattcaatccctccttgctgagctggctgagtgctatgatgtgcgtactgacgtgctctcacggtggtacatggcagcacatgcctgtacgcgccctgatgccattctcagatacgttgcgcagcgggttgcgtgatcccacgccgccagacttcggacttggcgttgagagagccatatggtcagttcaagcgtgcatcagagaagagcgttcctcgctgaagcactcaagcgggtagaatgcttcccccaggacctcctggcaacgatcatggcgagcaaggaggccactgtcccgagggtccagctcactagtctaccgttgcaggcgtggagcgtccccgcgtggtactgtagagcatggggactggaaggactctgcagcattggatgaacaagaacagtctttgttggcagtgtggcacgttcgcgcccccgcacgaaatggtggttccctgattaattccaggcagtccacattcatgagcgcagtgcggcgaggtttgaaaccctgcatccctctccgtccttgcaagttgagtagcctgactcgtgcaggcctggtattcgtctttgcctagatcgaggatggtcaaaagcatcgcaaggttcatcgaataatagccataaagataccgtagcgttggcattgggagacgaaccccacaggggttatccacgattcgcgccgagtcttgcgtttcccccaaaattgacccaggttggtgccacttttggggtcgactcgaatccctntaggccttcttttcttgcatcttaattgggaccctttgcctcattccacgtgggcacctgtttatcccgcctccctctatcccttcacaagatactcctaaacgacaaactaacaatgtccgcgatttttatcttggagcttgcacttttcttcttcgtgcaccaatataacccacacaattaacaacacctttgcatagaggataggtcccataagatattccaagccgatttgggaccatgccaaagggacccggcttcagtctctacgatacgttggggcacccagtgagggatcctttacccacctgtttattccccatgaatcccccatcccggttgtttggttgaccacaagagcaggaacacagcatttgttcgccgagtgctcgcctataatagaggtaaagctcggaattagacaactaccggcacattatcaacgccacggtataaacccgtgcatatatgacacgcgggggcaaa

SEQ ID NO: 525684 - DNA, 133 bp, Homo sapiens
taacatgataaatcgagctcggtaccgcagtatgcgccctttcctccagcgatgagtgcccgctgccacgtagcgcgtcgggtcatggatccggcgtgcagtcgtggcagcggctggcgcgttgcggccaggc

SEQ ID NO: 525685 - DNA, 392 bp, Homo sapiens
gagtctgttagctgttgaatggataattatgtgcagtattgaggataactaagaatatgtggtaccgggtaggcaagagttacataggaggtgactgaggaagaaagactgcagctgtgtctcactcagtacccaggcctcttggtcaaaagtctgaaaagcatttaagcccaaggctcattgcccctgtagtaccaatggctaagccatcagggcattttcccatacacatgtactgaggaaggctctgtatcctcaaaagagctggacttcaacttaatatcatgtgcaccgtgatcctagcacctcctttacctttagcggtttttctacacaatcattcggagtctgtaaactcaatgtgacccagccctgttaagtccgtcgacgcg

SEQ ID NO: 525686 - DNA, 234 bp, Homo sapiens
attctctgggtctgccctcaccagctcactgaactggggcttcaggaaatggagcctgttcagggtatactccattttaattttctgtagtcctggccacagaagagctaaacgtgccttatgcagagcaaagctagccttttcagccttgttttagagcaagcttgtccaacctgtggcctgtggaccacatgcagtctaggatggctttgaatgtgacctatatacaaattc

SEQ ID NO: 525687 - DNA, 224 bp, Homo sapiens
gtacttgctttgtcactgccccccgtttacatggggggggggtttaatttggtttctgagcgcataagctaaggagtgggaaaaaaaaaacaaaaaaaaaaaaaaaaggaaaaattcccccagaaaaaaagggggggaaaaagataattgacattaaatttgggggtctccaaatttccctcttatatatttcttgaaaccaaggacaaaccaaaaggcatgga

SEQ ID NO: 525688 - DNA, 272 bp, Homo sapiens
ctacaggacaatccttcgtctcaggtagtaaatgcccttgctcctgagtaactggggtgttggctgtaagagacagctaatgacaaatcctcaggctgagagggaggctgggactggagtacgggtggagactggcgatgatgctgaagctggggctgagactgaggctgaggttgagccacaggctcaggttggggctcagattctttttcttctttttcctcagactccttttccatgtctaaagcactgacattctctttcccaggaga

SEQ ID NO: 525689 - DNA, 116 bp, Homo sapiens
caaccctagcggagatagccaaagtggagctggacaatatgccactccgtgaaacgcagctgcgtgtgcgctttgcctgccaatagtgccatccctatacagttctgaaacctatc

SEQ ID NO: 525690 - DNA, 255 bp, Homo sapiens
cccgtccacgtctgaatataatgttctactaagttcactcagtatatggtactaaaaggaaactgtaagaagacccacaagtgacgtggaccaagactattatttaattgctcaacttgcaacttcgctgccagcaagagtgcagctccattcctttgactccagtgttgggctgttaactgctgcacctcattgcctttaattgttaatgtttgtgttttgtatgagggtaggcactgttgggccatatgcacg

SEQ ID NO: 525691 - DNA, 261 bp, Homo sapiens
  misc_feature (228)..(228): n is a, c, g, or t
ttctactttgggggcttttccccagtgcattaccaggcccagggcagctgctggtgtgtcatggacagcggagaagaggtgcctgggacgcgcgttaccgggggccagcccgcctgtgagtagccctgcggtgtccgctgcgcattcaactgcgtcggacggtggttggctggaacaatcctcgtgtgagacaatctctgggccccacatggctcggccatgcagcangtgccaatgtgcttgtgcgcgccatgggctccg

SEQ ID NO: 525692 - DNA, 355 bp, Homo sapiens
ctcgacaggagcacaacacacatgaattcctatattctatttatatatgttgtagagaccaagtcccgtcctgtcatccaggctgcaatagcagtggtgcacatctatggctcactgaaatctcaccctcccaggttcaagcgattctctgcttcaccctcctcagtagctgggatagcaggtgtacacaaccatgcccagctaagttttgtattatttagtgaagacagtatttcaccatttaggccaggctggtctcgaactcctgacctcaggtgatccaaccgcctcagtctcccaaagtgctgagaatacaggcgtgagccaccatgcccggctgtcagctctattttct

SEQ ID NO: 525693 - DNA, 734 bp, Homo sapiens
  misc_feature (53)..(53): n is a, c, g, or t
  misc_feature (128)..(129): n is a, c, g, or t
  misc_feature (131)..(132): n is a, c, g, or t
  misc_feature (165)..(165): n is a, c, g, or t
  misc_feature (225)..(225): n is a, c, g, or t
  misc_feature (231)..(231): n is a, c, g, or t
  misc_feature (289)..(289): n is a, c, g, or t
  misc_feature (293)..(293): n is a, c, g, or t
  misc_feature (386)..(386): n is a, c, g, or t
  misc_feature (404)..(404): n is a, c, g, or t
tttacatatatggaagtaatccaagtctcctctataggtctgttaaagttaanatgataagtaagctaaagagacttaccaagtaaccaataaggttgatagagcttgtggtagatttcacacagatnnannaccaatagagagaaagggaatgtggcactaatntaggaagcacatagttaagtaagcaaaagttaagaaactaccatcttaaaggtgtgttcncagganaagcaagatccacaatggatcttaagttaagtattggcaggctggcatacaagagtgngatnagatgaagtccaaaaggcagataccaagagagagtggactctgctggcaattaagactcagcaccagggctgcagaggagaggatacttctcnccgtatcttgaggaagcnccttagcacggaagaacgagcagaactagcaccagtgtgtgttaggaagccattcagcaagcaccagggggtctcccatctctttggttcaccaggaatccaggaagaggagaaacggaatatcttgttagatggtctcaaagcaccgggagatttggtgcccttaaatttagcaggtggggccgagcgcggtggcttacccctgtaatcctaaaacactgggagaccaaggcaggtggattgcctgagctcaggactttgaaaccagcctggacaacatggtgaaaactcatctctactaaaatacaaaaaattagccagctcgtgccg

SEQ ID NO: 525694 - DNA, 342 bp, Homo sapiens
  misc_feature (100)..(100): n is a, c, g, or t
tgcaaaataatcaactgcccccaaatggccacacagggccctgtcattgcacttatactctcagactcccttagaagcatttgaggtttatattctttcnaaagtctgtcctgaggagggttttaaaaacaaggactatttcctttgggtcatcccagaaaacctttagacatttagacaaaacaggcctgtttgccagctggacccccccccccttttcatactaagatcctggtattatataaaactgaaggattaaaaactggatagctcatacctcctttcttggtgaacttcaataaaattttaagcctttaataaaattagacttctcgttttgga

SEQ ID NO: 525695 - DNA, 168 bp, Homo sapiens
tggacagatcacaaggtcaggagtttgagaccagtctgggcgacagagcaagactgtctcaaatcagaaaaaaaaagagcccattcccattgaacaaccaaacgaacgcattcccccagaatttcttcccaaagaacagagccagagaatatactcccaactttatcc

SEQ ID NO: 525696 - DNA, 104 bp, Homo sapiens
gcaaacgccagggagccacatcaactccaggagacactgccaactccaggagccacatgccaactccaggagccacccctgacaccaggagccactgccaaatc

SEQ ID NO: 525697 - DNA, 943 bp, Homo sapiens
gacccacgcgtccgcggacgcgtgggaggctagtcccatcggtgtggacaactgctctccagatacccttttgccgtagagtacttgcctgatctacagagctgccactcctgaaaagctaacactttccatgccatgctgcctttggaaggaggtgccagccaggcagcattagctaaggccctactttgtaggctctcctcacaactagtgctggccgtctgtgctttcatcggtcatcatctcatgaagtcagaaatgtagctgcttttctatggtttccatggtttagccacactctaggggatattagttttggcactttcccaagcaggcctcgtgtacagggtggtgaagctccccttcctctttctggatgcagctgtagtgtgtgtcattgagccgttgaactcacagttcgcagcactagaacccagcacctgaagaccaagcttggctaacaaggcgtcctctctgtaaggcgcattacagccttcttgctcataaggacagctagacagcgcttcagcattatgcttggaggccgttctcacacagtgaaatgcaaccaacaagaagctcaaaactgcaaaagaagtggtactatagagaccatgagaagactggtagcaggtgcgagtaggaacaagaaggcagcgtggggccctgcatggcctcagctgcgaggcgagtggcttcaatgtggccctactctgcacatgttcctgtgacgtgacagcaccacgagtatgatccgggggttacaatacttcacccagcaggaaagtcaccaatatgcacaagtggccagggggacccccccatgtggaggaaacgaggaggagtgcaagtcgcccaaccggagcatggtgcccatcctgtagccggcgtggcccgccgggacaaccatccaggagaccgcacaaacagacggcgcgacgag

SEQ ID NO: 525698 - DNA, 1111 bp, Homo sapiens
gaatgaaagtcatgcccagagggaacgaaactcgagcatggcggcagtggagctcgtgagactatgctgctcacagtgaggtaggataggatgagacgcggcgtaacgatcgcgtggtgggtgcttcgagaacctcgtgttcctgatccctgatgtctctgttgtttattgccaaactgttcgctccagtaatatggcatgcgtttatttgcagagatttaattctagtgggaaacgtagatgtccgtatctagaaaggtttttcacctcaaagcggcttggcatgtgtagaagagacatgctagaaggaacgtttgacggaccgatggaacattggggaacaggtgcacgcaagaactagggaacgacacgtggtaattccaaccttgcgccacgaggtaggtgcatccggtagtaagctttatgtggcgatttagttatggaggcgtaggggtaattactcgcacatagtgccatgttctagggtatgcacattgatgcgtgctggtactttgagcaggatctaacacaaccttctaaactatacttgaaagttcaagtctaggggtaatcaattaagacttgggcaggcctagcctagtaagccctacgactttcaatgtagtgagctggtttacgtcgcttgataatcctgaccctgtggactaatgtactatacgaatgggtgctgcctgcacgttctctagacagacttgtgggtgtgccaagccatgcaccaatcaatgcgcatccatggaaataccgtaggagcgactgagtccggtgtcgtctatcacgctgcctgatcttgtgaccgcagggcatgtttctcgtttgcgtgcaagcggtcgtttgagcccttgttgggctagggttccttgattggctcgcggggatctgtgctagcaggtgcggtggggtagcgcattgccggtgcggagacgggatgttactgcagggttggactgaaatcctccctcatgtttttgattgtcgtgcctttccaagtctgggatggtccgacgatttgggcctctacagttgcttctgggggggaacatatccaggtggggcccgtccaaacacagttgcttaggggctgggggagaca

SEQ ID NO: 525699 - DNA, 1368 bp, Homo sapiens
acagcgtctggctggcattctataatagctgtatttacctgcttttcctctatagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525700 - DNA, 913 bp, Homo sapiens
tcagcgcgatctctctttatttatttacttattttgagatggagtctcactctgtcacccaggctggagtgcagtgggacgatctgagctcgctgcaacttctgcccctcctccctccaggttcaagcaattctcctgcctcagcctcccaagtagctaggattacaggcacacgccaccttgcccagctaatttttgtatttttagtacagacagggttttgccatgttggccaggctggtctcaaattcctgacctcaggtgatccacctgccttggcctcccaaagtgctgggattacaggcatgaaccaccacacctggtcttgttgaggattcttgcatctatgttcatcagggatactggcctatagattttttttcttgtgtccatatctagttttggtatcagggtaatgctgccctcacaggatgagtttgagaactggtatgagttcttctttaactgttcagtagaattcagcagtgaagccatcagggcctggacttttctttgatgggagactctatataactgatttaatctcattactcatagttggtcttttcaggtttctatttcttcttggccaatattgtaagtggatctggtcagaattatccatttcattttggtttccaattgtggctatagtggtcataaaggcttaatgaccttggattttggggatagttaatgtctctaagcctgctgtttaacacctgggcgggggtattaacaagtcctgcgcttattcagaaggggggcaaagcctgactgttacaattactgataaggctatggcaataactatgatcctgaaacaaaggggcccggcccatccctttggaggtttccgcgtcggcggttagggggggcgatattgagggagtgagttagagcgaaaggatgg

SEQ ID NO: 525701 - DNA, 3222 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttctcacctttcctaacactaacattctgtccaagccactattagtttatgcctac

SEQ ID NO: 525702 - DNA, 273 bp, Homo sapiens
tgggctcattcagtgaaccaatatggtggttctgcaatgggctggtctagactactctccagaaaaggataaaaagggcttgagcaattgcctagaagaggcaatctccgaggggctagggtggctgcactgtggaaggcagtgactggcagcaggttcttagctcttgaagctcttccgggaggaggaggtggtgggagacaaattggacgcgggagctggctagctcctcgccaaggactaagcctagccccagccctcggccagggcttg

SEQ ID NO: 525703 - DNA, 455 bp, Homo sapiens
aggggcacaggcttgccgggtaacaggatgctcgaacaggcaatcagcccgacaggggtacagagatgcgcgtcgatcaacccattcgctagcaagagttcggccatatcaggcgaactgacgttcgagtactacataaggcgccatgagcaccgaacaatgccagcggctggtcgcagcgttgcgctgggccaaggcgcagagatacccaggtgttgctgatcaagggcggatgtggcaagctataccaaatggcgttcacctcaacgtcatccaggccagccgacgtgccggggctggaagcctgggccaacattcaaagccatcgacgatgtgtgcctggagctgctcaccgccaggcaactggtgatcagcggcctgacctggcagtgcaggcgcaggcggcgtgatgctggagctggacgccgacattgtattggctcacgaaggtgtgg

SEQ ID NO: 525704 - DNA, 1261 bp, Homo sapiens
tggccacactgcgatataagtgattctgagcctccggatcagcgtgtcttctgcaaggacagcaccgtctccccgacatggtagttcatgatcacctctgccttctgggaggccccattgagcaagccacggtcccacagggctttgtttcctgtaggatcctcatctacttcatcattggtgttaggtgggagcctcaccacacatatgttgccaaacttgtctgcgccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525705 - DNA, 470 bp, Homo sapiens
  misc_feature (48)..(49): n is a, c, g, or t
  misc_feature (333)..(334): n is a, c, g, or t
  misc_feature (339)..(339): n is a, c, g, or t
  misc_feature (428)..(428): n is a, c, g, or t
  misc_feature (454)..(454): n is a, c, g, or t
  misc_feature (464)..(464): n is a, c, g, or t
attctcctgccttagcctcctgaaaagctgggattacagggccctgcnnccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattgggcgcctagaacagttaggtcgctcgtcacatagggcagttaagtgggagaaccaggtttcaaaatcaggtaagaaaaccatcattcatttaactgaggcaccagctgtnnttaangccttgccacgggcgttttccttggcagcttcacaacagtgggggagggtttgttattcctggaatgttccttcattttttacagatgnagggacattttaggggagaaggaganttttaccccngggttt

SEQ ID NO: 525706 - DNA, 3197 bp, Homo sapiens
  misc_feature (106)..(106): n is a, c, g, or t
  misc_feature (113)..(113): n is a, c, g, or t
  misc_feature (115)..(116): n is a, c, g, or t
  misc_feature (3145)..(3145): n is a, c, g, or t
  misc_feature (3181)..(3181): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgagttgatgttgttaacttgggttacagtgatgtgtaggaaagctggctcagtttcttgtgggtaaagccaaggaggaatcaaatctgagaagtaaaaatggatataaaattccatcctactaaagctaactctacaagcaatctgttctttaagccttcttactagtcttttggatttttctctgtggtttatctccctcctccctattgaacgtgatttaatgataggtttagtttgagctaatggctaatactcttctttttacattttataagaactttggaatgtctgtatctatgttgtgtggtttngctttacctattacgcctgtgtaaactcattgctcnttggtaaagatgggga

SEQ ID NO: 525707 - DNA, 328 bp, Homo sapiens
  misc_feature (306)..(306): n is a, c, g, or t
aaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctgggatctgtcattccttttgattgttctcagagattacctacacaaggggcttaggtcctccagcttngggagtcttctctttgggcttt

SEQ ID NO: 525708 - DNA, 1598 bp, Homo sapiens
  misc_feature (224)..(224): n is a, c, g, or t
  misc_feature (354)..(354): n is a, c, g, or t
  misc_feature (466)..(466): n is a, c, g, or t
  misc_feature (584)..(584): n is a, c, g, or t
gtccggcgaggctggcgacgccgggcgttgactcgatgcggcctagcagaagtggggcatcacttacctcaagcctcgtgcgtgaaacactgtactatggtctgattcgacgagagcccactgtgattactactacttactgtttatcctttatactaaccaggaaggaggatagagaaccagacaacgcataaatttcttgacagtaatagagatagatagtngctctccagagtgaggagccttgcgtatggggagattctggcgcctcgcctacagagcctgtcatatgtgtgcatgtagtagacgtagtttggtcgcatgacatatgaagatcatagacttgaatgctcncagctggtcggtgcctatatgtaggtgagtgcgcgaaggctgtgtgtctataggcgtgtgataccgtgaacccgagcagtcaaagacggtgtgacgtatgatcacacgtttntatgcggtagagcagaccaccacagagatacagtatcgttgcacaaaagtgggtacgggcacaagcgcaacggatatgcgacccagacatggctggagaacacagcatgccaaaggtncagggagacataatggcacacacttgtgtggggcaggcagctcacactaacagggaccatgaaataacaggaccggctttgttcataggatacatacacacaacacaaagaaaccaaagaaattagcgccaggggcgaatctcctcattgggtcgtgcgcgttcgtgagtgtaacatcccaagggggggtaccaatttgcacaatggcgcgttagggacgtgtgtcaccaactacaaatagcgttaattcgttgtacatcccttcagtggtcatttctcttagtggtctacaccatacagtggacggagaccctgggccgcaggacagcacgctagaaaataagggggcctctcgtcccagttgaatatccctagcatggtacgcctaaggttttggcccgttggcatttgaacaagtcaccttgaagaccaatgggttaccctaactatccttaacccccttccacggagggacctggatcagaaacggcttgggctttccccaggaccaaggagcaaatgctaaaacgagaccaaggagggcgcacccaggaaaggcggcgtggacgtgcaacggggcaacccgggagaggagccaacactggcgcgcaacagaacagtgagccgacaggggcaaccccggacgccacaacagacaaggaaagaacggacgacacgcaaaggaagagataaagaaagaggcacaaacacaaaattgcagcacaaaatgagcagaagaaaacaacagggaccaacacaagaaagacagcaaccagggacacgagtggacggcgaccacaaacagacagacgtgagagaaacccaagaagaacaacgcacagacagagaaacgagaaacacatggacaaggaggaccacagagagagcggccaacaccgggcaccataagacgagacgactcgacaacgagacacctggtactctccgccctgcggcacggcggaaggacagaaaacagacgagcgacaaacagacaaaagacgaggaaagagc

SEQ ID NO: 525709 - DNA, 135 bp, Homo sapiens
agcctgaccattactgggttacagtcctaactgcttttaatttaggaggtccagcgaagttacttgggtaccagggactaatcgtattcattgttcgtcactctacccctgttgaaaattgcttccccaaaactg

SEQ ID NO: 525710 - DNA, 1011 bp, Homo sapiens
gaatgggccccagggagaacactgcttagcacttttcctgttgccctcactgaagaaattgcctttggtgaattattcatagtgcacacgactgtgctgagtgctgtccgtccacagtcctttcttaccaatctgcaaaaaatctccttggagagtagcgagttccttagagagagtccattcccagtcctctgctctgaggtgtgtcctgggctttactttctcctgtaggcatgtgctgctttaatagagcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525711 - DNA, 817 bp, Homo sapiens
  misc_feature (8)..(9): n is a, c, g, or t
  misc_feature (12)..(12): n is a, c, g, or t
  misc_feature (15)..(15): n is a, c, g, or t
  misc_feature (19)..(20): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (32)..(32): n is a, c, g, or t
  misc_feature (40)..(40): n is a, c, g, or t
  misc_feature (45)..(45): n is a, c, g, or t
  misc_feature (145)..(145): n is a, c, g, or t
  misc_feature (156)..(156): n is a, c, g, or t
  misc_feature (179)..(179): n is a, c, g, or t
  misc_feature (244)..(244): n is a, c, g, or t
  misc_feature (252)..(252): n is a, c, g, or t
  misc_feature (299)..(299): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (337)..(337): n is a, c, g, or t
  misc_feature (343)..(344): n is a, c, g, or t
  misc_feature (359)..(359): n is a, c, g, or t
  misc_feature (379)..(379): n is a, c, g, or t
  misc_feature (400)..(400): n is a, c, g, or t
  misc_feature (423)..(425): n is a, c, g, or t
  misc_feature (444)..(444): n is a, c, g, or t
  misc_feature (466)..(466): n is a, c, g, or t
  misc_feature (514)..(516): n is a, c, g, or t
  misc_feature (560)..(560): n is a, c, g, or t
  misc_feature (579)..(579): n is a, c, g, or t
  misc_feature (606)..(607): n is a, c, g, or t
  misc_feature (610)..(610): n is a, c, g, or t
  misc_feature (624)..(625): n is a, c, g, or t
  misc_feature (634)..(634): n is a, c, g, or t
ggagagannganagnactnntntnganttttntttttttnttttnggggataaaagtctttattgaacaaccttatctcactcagtaacaaaagagcaggaggcgacaattcccccaaaagtctgcagccgtgtccacccttggnagcaggatgcntggcctgctgataacatcagctncagttcaaagccccgtggtggtcacttagagatcataatgggggttcttccgaaggataacaaanccttccanaaggggggtaacaggaagaaactcctcaggggccaattctgcccgtnccccgtgggccaacaacantggngntgtatgcgtctgnaacccnngtgatagtcttcggnttgccagccgtggcccaccnaatccactgcctggcccacanggacagacacgggcaagggccgnnngctcctcatcaaagcgtanccagcattcggggctgcatggnagccaccagcccatacaatacatagggtgattggcctaaaataaggtnnncgaacatccaggaaagagacaagcacagtgagcagtccagccanggcacctggctcataagcngccggtcgctgtggtaggggcagaggnntangggtgcccttcccnnaaatgtgtnaggccctgtgccaagcgcccccatgaaagaagggatgaaaggggaccatagggaagtgaaaatggacgcatacaggagggcaaaacatgaacgccaaacggggcataaaatgggcaccaatgcccacccagtgccatggcaaacagtgggtaataggaaacttgtggaacagaacacgagaga

SEQ ID NO: 525712 - DNA, 2679 bp, Homo sapiens
  misc_feature (106)..(106): n is a, c, g, or t
  misc_feature (113)..(113): n is a, c, g, or t
  misc_feature (115)..(116): n is a, c, g, or t
  misc_feature (2557)..(2557): n is a, c, g, or t
  misc_feature (2567)..(2567): n is a, c, g, or t
  misc_feature (2585)..(2585): n is a, c, g, or t
  misc_feature (2640)..(2640): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaaggtaggaatctgccagtggttctcctagattttaagtcccattgaattctctcacttttgcttatgntatggatcantcttttggggaccagctncttgattccaatctctctcttaccagcacatggtgctggggccttctagctgcantgatgttcttgggcctgtgcattccacggggctttgtgc

SEQ ID NO: 525713 - DNA, 157 bp, Homo sapiens
  misc_feature (8)..(9): n is a, c, g, or t
  misc_feature (12)..(12): n is a, c, g, or t
  misc_feature (15)..(15): n is a, c, g, or t
  misc_feature (19)..(20): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (32)..(32): n is a, c, g, or t
  misc_feature (40)..(40): n is a, c, g, or t
  misc_feature (45)..(45): n is a, c, g, or t
  misc_feature (121)..(121): n is a, c, g, or t
ggagagannganagnactnntntnganttttntttttttnttttnggggataaaagtctttattgaacaaccttatctcactcagtaacaaaagagcaggaggcgacaattcccttctgtngtcttctcgcagcggtatagtagtagaggcggccgc

SEQ ID NO: 525714 - DNA, 1074 bp, Homo sapiens
  misc_feature (25)..(25): n is a, c, g, or t
  misc_feature (47)..(47): n is a, c, g, or t
  misc_feature (127)..(127): n is a, c, g, or t
  misc_feature (145)..(145): n is a, c, g, or t
  misc_feature (158)..(158): n is a, c, g, or t
  misc_feature (172)..(172): n is a, c, g, or t
ggaattggattgatgggaattagtnccccaggaggtgcttccccttnagggcaagacccacagcccagagcaaaggcttcacctgcttcctgcccaatcctgaacttctgaagtacccaaagagtcnaacttaaagataagtgtncccctggatcctnacaagtggggttcnaagtatcgaagtggagaataaaaagttttccccggtctgggcgtggtggcacacatttgtggtccccagccaatcgggaggctgagcccccagattttgagagtgcagtgagctaagattatcccactgcactgcaacccggatgatagggtgagaccctgtctcaaaaactaaaaaataaaaacagctttccctacaagtgctgctttagcatgtgccattttctttaggcatctcaccattttttttctttctgctttctccatacctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525715 - DNA, 121 bp, Homo sapiens
cttgtagacagcttggatcctttctctgaaggaatcatgttcagtgttcgaccaactaagaaaagttggaaaaagttcttcaacctttcgggaggagagaaaacatttagttcaatggctt

SEQ ID NO: 525716 - DNA, 1204 bp, Homo sapiens
tgataagattattagtataaaaggggagataggtaggagtaggggggtaggggggatgagtgtggggaggaagtgggggtgggtttgggtatgttcaaacgtgcgtccattttatttttcacgtgtgtaagaatatggggagtaggtggtgatggcagggtggcagtagacattaggcgtaggtagcaagtagcaggttaaggcagggatgagtgggtggacatagtgagtgggtggggcatgagtgaggactaatgggtattttgtggtgaattatctatgagaataagtggcgccatttggggggacaaaagagcgcggttataggcgggggacagggctatccttagaggaagaaggaagggtgtggatggacattaagggggtgtaagctcatgctacagctgtgtgtttcaggtgtgcgaaactaagtacgaataggggatcagggggtgcttggacgattaaagttggagttagataggcaatgcggcaaatagataggatacatataaataggttcaactttcaggaatgggtctagtgtacgggttgtcagggtaaaactgctattatacatccatatagtggggaaattgacggcagtatgataagatttagggcgaaagcgtggagcatagggtagaaatcacaccatcaacgtgcctgcatatagcagtggcctaacgattgcagagacgtgagagagacaggactataagataaccagagggcaaaacatgcgaacactgcaacgcacaaggaggacaaatatagccattgaagacaaaaagaaacacaggcaccgaacacgcacaccagagggagttgccatgggagaaacacctcggggaaactaaacatgtgaaagagggggccacaaccacagcacaaaagtgacagacccaaagagagtacaacacagaacaaaccgcgacgggaaacacagtgaaagatgttaacatccgcgaacaaattagggacgaagagacagagctagaagaagggaagcaggaggacagagagcgaacaaactgcagatgtgagacacgggcactgggggagtcggaaaaaaacgggacagtgaaccggagaaaacggcagccgcagcaactatgcaagcagcaaataaacgcgggcatacaaagaaaagtgactggcgaatcagtaggggtaactgaagaccctgagccaattagcgcag

SEQ ID NO: 525717 - DNA, 177 bp, Homo sapiens
ttttgggggggggggaaaaaaaaaattgcccctttttaaaaccgggtaaaaaccctgggttggggggggggttcccccccaaaattttttttttacccccggggtcttgggcctttggggtaggaagtttttttcccccaaagtcccccccaaaaattttttttttttccccgggta

SEQ ID NO: 525718 - DNA, 2364 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggacgtatatatggcaatactgttccttaatgtctcttgcatccccttctgcaatatcctttttggggactccactttccctatcctccttctacgaacgcttcctttttttatagatattatcttgtttctatccctttacttgcgcgtgactctccccctggcccgtgtctcgcctctccgcctcccctctcctct

SEQ ID NO: 525719 - DNA, 2189 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 525720 - DNA, 1518 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaaggtggctggtgaaggtgctgatcaccacagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgaggtcccgaacgggggttcccatgtgggtgctgttctggccgttccccggtagaagggccgtccgggggggggtggccgcgggaattccgggcccgtg

SEQ ID NO: 525721 - DNA, 212 bp, Homo sapiens
ctagaggatcccggcaccactgtgctggcatctggggacgcggaccccactcccctcacattccacaggcccatggtactcactttgtaacaaagtcctaccaacacgaccaataaaaaaaaatgtgggttttttgttttttttttttttttttttttttttttttttttttttttttttttgtgggggggggctgtttttttttttttttt

SEQ ID NO: 525722 - DNA, 105 bp, Homo sapiens
acaatttccatgttattgttctccagagagtagcctgtcttcagtcttttggaacgcagctccggacatgggcctgggtgggggacgtggggcagcacccgcagg

SEQ ID NO: 525723 - DNA, 199 bp, Homo sapiens
gctggtgtccatgctagatcagatgtggctctctcattggaaaatggtggatgcaagatcaaggaagtagagagagtacaggggctcaggtccaggtggcaggggatacgctacccaactcaactgagcgggccatcactattgctggcattccacaatccatcattgagtgtgtcaaacagatctgcgtggtcatgtt

SEQ ID NO: 525724 - DNA, 281 bp, Homo sapiens
tcagatcagaaaagtattcactaaaacaattcacagcaacaatctgccagctccatcatcacctcaacccaaaaaggcataatgagggtttacttcctctctttcttcttcccagctcatcctaaccctactcctaactcacataacctacttcccccagagcactctcaagttacaatatatacaccaaccaaacactgttcaaccagataactactcactaatcaacgcccagtaatcatagaaagcccccgcaaccagataggatacagtagggagca

SEQ ID NO: 525725 - DNA, 718 bp, Homo sapiens
gggttggcgcgcgccgggcggcggggggaggagctcgagacggagcctagttatgtctgggaggcgaacgcggtccgtaggagccgtcagcgctccgggcaagggcccatctcctactaagcctctgcgtgaggtcccagggaaatcaggctctgaactcccgagcatcctccctgaaatctggccgaagacacccagtggggtgagtcagaaaagcccatcgtcttaaagaggatcgtggccatgctgaagaggtcccactgtccaatcacctcgcaggagccctaggatttcctttttcttggagaaagaaaaccgagccccctggcagggagctttactaaggaggacctttcaagacacacagcgtcactggcagccccaacagcattctgtggccgaacctgaggacgagtcaagctccaaggaaggagagctggacgcagagacttggacatgtctaacgaaagtcaggcgttacctaaggcggctggaggaccattgggctctggcctttactccaccccaggctggccggtactgctttggattcgaggggctgtgggggcagaagacttgttcaggagttctcgccagtggtggtgctcacaactaaaccaagggccccaggtttgggcaaagccctgggcacccagaacttgatctcctgcatttccccaccaacgagaaacagaaacgctagagaagaaatgcgaca

SEQ ID NO: 525726 - DNA, 117 bp, Homo sapiens
gtgcatcatgttgtgctcagcagctccgtcctcctccatgcaccttgcacaagcttgtctgagattcgggagatcctcatagagtctgatgcgtgccatggtcatgcaatgcttggc

SEQ ID NO: 525727 - DNA, 125 bp, Homo sapiens
acggccgtgtattactgtgcgagacatcaggtttcgatgcattactatgatagtagtggttattactggcctacatcatactactactactacggtatggacgtctggggccaagggaccacggt

SEQ ID NO: 525728 - DNA, 1309 bp, Homo sapiens
tggtctgggagaaatgggtgacaccaaaattcatttgggcaccagagtgtggaaacagaatgtcttcacaaaaagatgtgtctaaggcaacatgccaactcagttaataattccaagaaacaccgggctatgtgggactttgcaaacctccccaatcaatgttccccgcgaaaatatcgatgtgaaacaaagcgggtttggggattcccacccctgtggatgtgggtggctcgggggaaaactcgagggcttcatgaggacaaaactcgaacctcttctattaacacgagccccttatattcctaaacacgtgaaactcgtggtcacgccccagaacaaggagaagcatcaataccgtgggaagcccagccagacacacaacatattgtgcacacagacacactgtgtctccccagaattggggagggcctctcaacctgtggtgtggccacaattgtggacagaacgccagaaaggggggtgctcaaagagctataccgtcgccctttagaccaagtgtgggataagaatatcacccctcgtgtggagcgatcatgggggcgagaccccgcttatcttcaacatgtggcagaaagaaaagaatttgggttctaccacccagcacccataaatataactctcctccccattattttattagagaagattagaagacacacatcttttgagacaagagcgtgataacccctgttgacatatgtagaccaagaaaagaaacagcggagtatttttagaaaacacaagtggtgggcagaggagaaacatatcacaaattgagagaaataaaatataagggcggtggtagcactattgggtgagcgccatattaaaaacattataaatatttcacccccctttttttgggggcgcgcttgttgtgccttttaaaacgcccccctttataaagaagtttgagggggcaggataccaatattagaccggtggcaaatatacacaccaaaaaaaaagggggggttcaagacctcgctgggtggcgcccagtgtcacacattgtgcccaaaaaaacgtcgtttgaacaacattctcacaacccccgtagaaaggggcaaccgctggacacactcggccttgtgacaccacacagcggcgcgttcctcgtgcctatacaaccttctcacccgaacctctttaagcattcccaaaattctttatctcctataccctgtgattcgccgaaaactcctctgtgccacgctataccgagatcttatacagcacacacccgagccctacgagcaactttcctcacagaatggcagagccatcc

SEQ ID NO: 525729 - DNA, 441 bp, Homo sapiens
tggagaacgaagtcttgctctgtcacccaggcagaggtgccggtgacccgatctgtggctccactgcagcctccatcttctcgggtctcgaggtgatttcctcctgtgcgctcggccctctctcagggtagcgtgggatttaagggcgttgcaccaccgcgacccggcttagtttcggagacttttggggtagaagattggggtttcacgcgagttttggccgagagctttgttcttcgaaaactctcccgagagaggtgggaagaggatccaccgtggagggggctcccggaaagcttgtggaacaccacgctctgtgggcccacattatggcggttgagaaccccccgcgtcctctctaggttatacacaattctccgggggacattgtggtctcaggcgcgtgtgggtgtgtgtgcccacccccgttgttatttcccg

SEQ ID NO: 525730 - DNA, 423 bp, Homo sapiens
cattggataagggatgaggggctaggttgtgtgttccttatgagaatctaatgcctgatgatcggaagtggaagtttcattctgagaccatccccacaccccgtccgtggaaaacttgtcttccacaaaaccagtccctggtggcaaaaaggttggggactgctggtttaaaggaactggcacctccccctctctctcttgctctgaccatgtgacatgcctgcccctcctttgcctcctgtgttgagtggaagcttcctgaggtctccccagaagctgagcagatgcgggcaccatgcttgtacagcctgcagaacggggagccacataaacctcttttctttataaataccccagtgccaggtattcttttatagcaatgccaaacagactaacacaggaaccttcccccccaccctcatc

SEQ ID NO: 525731 - DNA, 383 bp, Homo sapiens
ggattttgagaccagcctgggcaacatggcaaaaccctgtttttacaaaaaagaattctctgggtgttatgatacacgcctgtaaagacagggtctcgggccgggcgcagtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccggctactcgggaggctgaggcaggagaatggcgtgaacccgggaggcggagcttgcagtgagccgagattgcgccactgcattccagcctgggagacagagcgagactccatctcaaa

SEQ ID NO: 525732 - DNA, 165 bp, Homo sapiens
  misc_feature (10)..(10): n is a, c, g, or t
  misc_feature (57)..(57): n is a, c, g, or t
gtgactctgnaggatcccggcacacccgctagggaaaagcagtgattaccttagcantaaacgaaagttactaagctatactaaccccaggtggtcaatttcgtgcagccaccgggtcacacgattaacccaagtcaatagaagccgccgtagcggtggtgtttg

SEQ ID NO: 525733 - DNA, 252 bp, Homo sapiens
ttcagcgcacacaacagttgcctttcctttctcactgttcatgcctcgtgttaccctcaattcccagatgcttagatgccctgtccaaactgggcaatgtcagtccgctgctccagcacctccgcctcctccggctcctggaatgaaattcagcccaaggccctgacatgcaggggtgactcttggattcggccacagtgccctccctcgctcctggaatcgctacgtcagttcttgcctcgaggtctttga

SEQ ID NO: 525734 - DNA, 1112 bp, Homo sapiens
  misc_feature (161)..(161): n is a, c, g, or t
  misc_feature (189)..(189): n is a, c, g, or t
  misc_feature (229)..(229): n is a, c, g, or t
  misc_feature (258)..(259): n is a, c, g, or t
caagaggtctcagatctatgcgagtcgtcagattatcctgtagaaagaggaactcaagcagctatatgcggttcgatgatccaggtttgatgctcatgggttgcacgccgttggtactgctgaaggcacgtcattacctgagtccctccctgttcgtgtanccagaggagtcgctggtgattgggagcncaacctgttcagtgctctgctcatcaagtgtctggagaangaggttgcagcattgtgcagatacacacnncgcaggaacatcccatccttattttgtggctatggtgccacaggaagaagagtaggatgaccagaaaatatcaggctgactcctccaggcttccagacttggctctttttacccttatgctgatgataaagaggacgatgcccgtttactgaagaacaatcatggcaaatccagagcaggctgggcacaggactgaaggctatcgtctgagaagcttcgcgttcacatacagaagtgacagcttccgagaaccccgtgctgcagcagaacttcaggaacctggcaggcttggaccttgggcatttggcatggagccggaacaatgcagtggaccgtgacattgcccaaagggttgaagcacatgaagtaaaagactgggtctccttggtggagtgacgtctacaggagcttggtaacccaccaagattacaagtcctgaaagtggacagttaccaagacgaaaacacgactactgacacggtacctggagagcaacagagggcccaagggtaggagtacttccaccaagaaggagctcgaagacccaccatccagcacacgggtaccgctgggcccaggttcacagctcgcccatgaattcaaccacgagggccctagcccggaggcatcaccgggcctgaaagaagtgggtccaaagaacacaagcaacgggcagacatggagaggcaaagagaccgggtacaaacccaaagcacgaacacaacaggaacctggctaccacggagaggccgagaacggatacaacagctaggacacattatcccgcacacaagcggcaaggaaaggcccagggaccctgggcacccacaagacggaccacaccgcggaacac

SEQ ID NO: 525735 - DNA, 162 bp, Homo sapiens
tgcatctatcctccacatagaagctggctctcagttataaaacacagagtccaggcgccctgtatgccctgatgagctagtaagagaaattcttgcacactgtttggttgacagggaagtaaacaaaggccaggccaccagaacccaaaggactatgagtga

SEQ ID NO: 525736 - DNA, 401 bp, Homo sapiens
aggatcccttattcagcacgctggagtcagggaattgggagttacttgtttaagggtacagagtttcaattttgcaagatgaaacagctgcacaacagtgtgaatatacttgatgccactgaactgtatgcttaaaagtggttaaaatgggctgggtgcagtgtctcatgcctataataacaacactttgggaggtcaaggtgggaggattgcctgaggcccagaattctagaccagcttgggtaacaaagcaaaaatttttaaaaattagcagagtatggtgctgcatgcctatagttccagccacttgggagactgaggcaggaagatcccttaagcctgggagttgaaggctacagtgagccaagatcacaccacagcactccagcgtgctgatacaa

SEQ ID NO: 525737 - DNA, 312 bp, Homo sapiens
ccgtagtcgctcttggtggcactgctgtgctgcatgccaataggctgaggcctgggagccacttcccaatctgcgtgcaccattaagaaaatggggttggtctgggcgcagtggctcactgcctgtaatgccagcactttgggaggccgagatgggtggatcacgaggtcaggagatcgagaccatcctggctaacatggtgaaaccccgtctctactcaaaatacaaaaaaattagccgggtgtggtggcgggcgcctgtagtcccagctactcgggaagctgatgcaggagactggcgtgaacctgggag

SEQ ID NO: 525738 - DNA, 1086 bp, Homo sapiens
  misc_feature (1080)..(1080): n is a, c, g, or t
  misc_feature (1086)..(1086): n is a, c, g, or t
ccgacgctgtagccgcggattggtatatgcttaaaatggcgccgtgtagacctggacaagtatgtggaaatagcgcggctgtgcaaggtacctgccagagaacgacctgaagcggctatgtgactacggtctgtgacctccatcttagaagagtcaaatgttcagccaggtatcaaaaccagtaacagtgtgtggggatatccatggacaaggattgatgaactttgtgaactgttcagaactggaggtcaggtacctgacacaaactacatatttatgggtagatagagaagacagaggttcactcataagtaaggagaccttcacttaccttcttgcattaaaggctaactggcctgatcgtataacactattgcgaggcaacatcatgagagtagacagatcaacacaggtctatggcataaatgatgagtgacaaaccaaatatggacaatgctaatgcctggagatactgtaccaaagtataagacatgctcacagaagccagctatcaatagatgagcagattaagagtgtccatggtggtcatctcctggatatcaaaaacatggctccacatacgagccatcgaacggaatcaagaaagatgcgcaacacagtgaagcaactcaggagaccacagagaagagcacacgaacctggcagacgcgaaacaccaagagaacaagacaccagagaaaaacagagagaaaaagaggagacaccggcaacacaagacacagacaacgtcgaagagtacaaaacaacattagaagagcaccaaaaacaggcagacacgacgttacagactgtctagcacgccacatacgataacaatctactcaccaatataaaaccactcaacgaaaaaaataataaaaacacacaatcactatctaaatacgccaacacatcatgcacaaagaacaaagttacatcaaataactgaaaccataccagaacaactcgtcaatcaaccttaaacaaagagaagacacaaaaaagaacgacaaaaggtacaaacaaaacactcaataacacaatccctctacacttgtcctcttctctctctatccttgnaggagn

SEQ ID NO: 525739 - DNA, 1142 bp, Homo sapiens
ggcgcggcggccagatgggctcgtgcaaatatcccccaagaggacgttgtcgctgatggcatcttcatatctgaatctgacagtgcagttgtctctactcggagtaccgtggctgatagatggctactcgtggcagtttgaggtgctgagttgacgagccgagacctaggacagaagatccttatcttagctcacgcagaaacgacgaggagtgtgactttggtggagagggggccgtgcggattcggcgagactgcactggcgttgtaagttccgagaacgtaggtcttgggcatattgccgatgatgcggccaagttgtgatgatgcttctctatgcttggacaaatacgtgttggcaccacatcagaaagtgtcttgtgttgccacttatgcaccaggagcgcacgacgtcgtcattgccgtgtaacaaatacttacctaaggggaggtgctatttgcctcagtggccagcgaatgcggtgcctgggctaagtagtgtgtgtgcgctgggcccggtggtaccaatgccaatgcgggagcgatgtgttgggtgtgcgccaaaagaggtgctctggcacagacgccggtagtggtatgacgtagtccctcagggagggtacagaagcgtccacggaaaggcgggagccaaacaggcgtgctgtaacccatttccctagttggccaatatgactctaatcggtccggggcaattggtggccccttagagaatcggaattcctcacaaataaaggctgccgaaagaagctcccattggtttgaaacacttgaaggcatttagcgcctattgtgaacagccttcggccttcgcttgaccagccccaccggttaggtttacggcatcaatgcaacgagagagcgtttgttggcctaggggggcaaattccacgaggggttcgaataggacatccaattcaggcctgaggccccactgggggggtacatccccaaaacctccgtggttcaaagccaatgttagaggcccccttaaaagatgcaacacgggacccccccttggtcccgtttgggaagcgccaaacatgtgaggaaccggccccaatcttgcgtgttgggggacatagccccacaaagcgcatgggaaagtctgagcggatatcaacc

SEQ ID NO: 525740 - DNA, 399 bp, Homo sapiens
acctcatgcatggtaacggtgcacacagtcccatcactcgtgtcgacggcctcacctgctgttacacttgttatccgtaaagcgtcctagagggataagcatgccacattcttcagcctccgcctcctgtattatatggatctcaaggacgatagaccttatcaccatcttcgtgccgcatcgcaggatctaatgagcaacctgtctcaggatgatctggaccagagttcgtgcggcattcgccattctggtagtatcgctaaccacgctcgtagtgctgtcgtgcgtgctgcgtgaccgatggacctgttttgaacttgggtgttcccccaaagtccgtctcagggcaacccagtagcgcttcaacagaagaggggaagggcagcacatctaccatca

SEQ ID NO: 525741 - DNA, 363 bp, Homo sapiens
gcgtcgacctgcaaaactggatacgatctaattcctcttggggtagaaatgttgagaaggacatatgccctggtattataatatttttttctagaagaatacattaaaatctgtgatcagttatttgtgggaagaaatacttgggggtaggggagagacagttctggtttttatttcagctttttctgttctatttgcattttaaacacgaacatgtgttactttcgtgctttcaaatgtcagcagggattatccgggcatggggattacatgccagtttcttttctctatgtgctttttgtattatgaaaatcaatttttaaaaattcactgggcgtggtggctcatgtctgtaatcccagc

SEQ ID NO: 525742 - DNA, 141 bp, Homo sapiens
agcgcgtaccgtctgagcagctgggaacgaggagtcagacagtggtcagtcacatgctgagactgctcctggctagataaccacgatggagcccgtgctttgtcctgccatctgttagtgcagatagaatgtgtggcacag

SEQ ID NO: 525743 - DNA, 851 bp, Homo sapiens
  misc_feature (653)..(653): n is a, c, g, or t
attccttaaatggttcctgccatctgtatgcaaatatgtagtaggtataagtaggactctcttactgacatctattaatatatacctatgtatgtataaccttttaaaggacaccctcttcagaaaaaggagctggggaatgggatcagcatatgcagaagaatgaaatggtcccctatctcttatcatatacaaaaatcaatcaagatggaataaagattaaagataagacctgaaactataaaaaaatactcaaagtaaacctgaggaaaatcttctgacattgtctaggtgaagaattcatgataagacctcaaaagcacaggtaaaacaaaaacaatctagacagtgggatttatttaaattaaaaagtttcttgttgcaaaaggacttaggatagtggacaggaggctgaggcaggagattttgtcttgaaccaaggaggggaggtgggagtaagtgagattaccagtgatccagctgttcacaagggagatctgttcaaaaaaaaaaaaaaaaaaaaaaatttttgggggggggaaaaaaatctataaaccacttgtgggggcgcgcgcccaatattaatgagaactgggccaaaggtggcgaaagaacccgggcaacaacgggtgggtttcaccaaaaaaaggggnggggaacgtgttggacaaccaaggggtcggggcctcgggtccccagggtcacggcataaccccccccgcgcgcggaggaacaagacagaagacgaaacaaagcaagaacaaacgcgccaaaaacaaaacacagcaaacaacgacacgacccaccacaacacacagcaaagaaacgaacaacacaaggcacaacctcaa

SEQ ID NO: 525744 - DNA, 394 bp, Homo sapiens
atacatacccggctaccagtagaaatatagagagcgagtataggactagataaatgatgagcggagcgggcatagatgtgcctaaataaatatagtagaatacactatgtaaggacctaaaataatgacacgcatctgtaatttactagaaaaaaacacaaaatatcaggtcctagtacctgccatttaaccacctgcaaggcttagggacatccatttaagtatcacagcttaaatatctgcacctgtcaagtcaggatgcgataaagtactgaggacgtgtaaagtgaaccagagaatatgacaggtatgtaacgtatatacttcattctgcatcattcatacataattgaattattcagtccttcgttgagaacatactacaatgaccaca

SEQ ID NO: 525745 - DNA, 1422 bp, Homo sapiens
aaggatcgcaggcgagattacgaggcgaggctcgcgcgcccgcaccccgacctggaccccacagtgcccacaccggatacggccggcacagacatgtatcaaggcgatccataatcttcaacaaccacgggaagccgcggctctccaagattctaccagccctacagatgaagatacacaacagcaaatcatcagggagaatttaccatttggtatctaacgcgagactgaaaactgtcttgtaactctaccatacaaacgcgccgcactcactcaccctctgcgacgcgactctgaccaacacaacctgcactccacctacgacccacttacatgacaaccgcatcactacctctcgctacatctactgtgatgagaattcattcaaagacaaccatgacccctctcgcgccactacactaagcaatcataaactctacaacgataatccatgctcgcgacaacacaagtctaaccacacacaatcgtctctcgacaaaaatgtcatgtcagccctgagactacctgactatatacacacagctaaccacccaacccgctatcaacacacatactccctacgacagacaacaccggccgacccgccgagcgcgaaacagagaaactacggcaaccacccaaccctcatgaccccttgcaccacaccgacaacacccccaccaaacagaacacgcccacacacaactaaacgaccgcgcaacaacaatccagcacgcgacacggcacaataacaacaaagcacacatccaaagacaccgacgaccgcaccctacagcccgacacacaccacaccctgccaacccccacccgaagaaatacccacaacaaaaataataaacaccccgcccgaacccaccaagaatacaaacgcagcacaaaacaagaacaccaccaataacacaactacccacaccagacaccccacgagccaaaacaacaagataaaaaaacaaaaacaccaacacaaataaaccacaaaaacaaaccaacgcccaagacaaaccaaaacacagcagaaccacaacccctacccaaacgccccagcccaataacaacaacgccaaacaaacacaagctatcacaaaaaacaaataaaaacgacagacaccggtcacgtaccaacaaatcccaccaccccacaacacccccctcaaccaaacccaccctacacgcactcacgcaccccccaccccaccaactcaacgcccacaccaccacaaacgacacaaaacaccacctcaacaacccaagacacaccaaagcacccacaccacacaacaccacaatcccacccaacaccacacgacaccacaaaaacacacacgcacacgacacgacacacagaaaacacacacacatacagagtcacacaaacaaacacaccaccacaccaacacccac

SEQ ID NO: 525746 - DNA, 456 bp, Homo sapiens
  misc_feature (155)..(155): n is a, c, g, or t
  misc_feature (202)..(202): n is a, c, g, or t
  misc_feature (208)..(208): n is a, c, g, or t
  misc_feature (210)..(210): n is a, c, g, or t
  misc_feature (214)..(214): n is a, c, g, or t
  misc_feature (223)..(223): n is a, c, g, or t
  misc_feature (234)..(234): n is a, c, g, or t
  misc_feature (254)..(254): n is a, c, g, or t
  misc_feature (278)..(278): n is a, c, g, or t
  misc_feature (295)..(295): n is a, c, g, or t
  misc_feature (298)..(298): n is a, c, g, or t
  misc_feature (305)..(305): n is a, c, g, or t
  misc_feature (312)..(312): n is a, c, g, or t
  misc_feature (316)..(316): n is a, c, g, or t
  misc_feature (321)..(321): n is a, c, g, or t
  misc_feature (323)..(324): n is a, c, g, or t
  misc_feature (336)..(336): n is a, c, g, or t
  misc_feature (346)..(346): n is a, c, g, or t
  misc_feature (356)..(356): n is a, c, g, or t
  misc_feature (359)..(359): n is a, c, g, or t
  misc_feature (370)..(370): n is a, c, g, or t
  misc_feature (385)..(385): n is a, c, g, or t
  misc_feature (400)..(400): n is a, c, g, or t
  misc_feature (409)..(409): n is a, c, g, or t
  misc_feature (412)..(412): n is a, c, g, or t
  misc_feature (428)..(428): n is a, c, g, or t
tacaaagaattgccaatctttttccaattttgtagtagtctctacacattcagaaattctgctgttaaacaggatttataaaatatttctttcagaaagcatcacaatgctaattttaggcaaataatgttttaaaactgaagtctttgcatggnggtgagctcaaacacccttattctttattgcagtgatgaaataatgngaaacntnaccnttaaactgncttactaaganaacaatgaataagtaattcngtaaacttctcaaattctcctaanattttttattactttcngangcagtantattgcnaggnatcancnnccacactatgtncccaaataanatggtttgtnagntatttaaattntgtttctttgttgcnccccttattgggtgntgtattgcnggngtcttattactctgtnattttttggcacagatcataaactcaga

SEQ ID NO: 525747 - DNA, 654 bp, Homo sapiens
ttgggcgacgcaatgggggacccgcctgtgttctataatagcgcggactcagttgggttgtgcccccgctggcttgtcctccctccgcgacacgcgggggatttcctcgtgtctattaacggctgcagagaaaatttggtgccccgcgatgtgggtgactcaacacgagtccctggctgtcaagcctcactgttcggcggtcggggtgtctctccccacgcagggacaacacatacttgtgcgtagccccgcgagttcttccctctctcaagagcgctcttctcaaggtggtcttctcagtagaccgcagcccacccgccgccccctggtcctcctgatgggtgtcctccttaaaccgtaagtcgtttttcttccctgtctgtgtttacacacctctgccacgactcctcgtaacacaaaatctcttctgtgtcactgttaggccccctgaatcgcctttttgcccaaacacagaattatttgcgaacgcccatctcttctgtgggcgaatgatccaaacgctgtgtgtgaacgcccactccctgtgggcgccaccacccccaaaagggaacaaccactatgacactttttttttctcatattattaaaaatactgcccaaaattttaaaaaaaaaaaggttttttaaaaaaaa

SEQ ID NO: 525748 - DNA, 218 bp, Homo sapiens
  misc_feature (86)..(86): n is a, c, g, or t
tctgcggatctgtagagtcgaccaggctcagcttaatatttggaggtcagcacggtgctcactgtgtcgacggaacttgtacagtnagtgcatgcaccgtggtggtgaatacacgtctgaccaggctccatgcttaacgatatttggaggtcagcacggtgctcacgtgtcgacggaacttgtccagggaggcgatgcagcgatagtggtaaatacac

SEQ ID NO: 525749 - DNA, 1270 bp, Homo sapiens
agacgcaacgacgccgggacctacagcgggagcgtgaggaaagccgatgcgttgcgtttccaaggacatctgtgagcccgcggagtataccacacatgacgcaaagctcaacctacccgagttgacaacacaatttactggaccaacgaccgttactcacttgacacacttacacactggtggcaagacatgtccaacggacactacttgcggggactttgactccctttactgacccctagtgactacgactgcacttggtgtcggaacgactggacgaccctacgctggaccacaccagacaccacctactgcggacctggggggtacctaccgaacgggacaccctacgtacctcctcactgtttacgcaccgaccttggaacccggagtatacacctacactggggctggttacacgacagaagacacaacccaatggatcactcttcgtccactacggggcactgataataacactcttggactggtcaaacattacgggatcattgttaccactttatacaactacttaacgaccttaaaggaataacacttacaacctcataggtacactacgttcacaacacacctcgcttttcttcagcactggttccatggcacatactcggcacctacttcaggactcttccgtatcccaagatatatgtaccttcacgattgcacttttatcacatgggattggacaactcggcattgccacaaggggggtcgtaacttggccatcacacacagggggcacaccggcactccgtccactgcaacacgggcggacacgaaaacaaccacaccatacacacaacacaacagaaccacacccacaccaccgaacgcgcacagacgacgccaacgacaaaagagaatcagcgaccaccatcacacgattgaggacaccacagaacccacccaccgaaggacacggcccaccacggacgcacaaaacaagaaaccaaaaagaaaccctatggcacaacgccaccagcgctcggagcacacaccccacatacaaacaacccacgcgacacaaacaaagaagtagagaaaaacaaaaacacagagaacaggagcaggaacacaaggggcacactacacaacggaaccacagaccccatgcctacatcccagccgcgggagcacaaacaaaccaccaagaggacagaaacgaacacccaatacaagacaggacacgtgcgcacacacagaccacaagagaccgcaccaccacccaccacggcaagacaaaaaacaa

SEQ ID NO: 525750 - DNA, 265 bp, Homo sapiens
tagtgcagacctgtgtcacaatacgttggaggctacttctgttcctgccgtccaggctatgagcttcaggaagacaggcattcctgccaggctgagtgcagcagcgagctgtacactggaggcatcaggcgtatatctccagccgtggagtacccgtcggtcctacgcccacctgagcgtgcgctgcaactactgcatccgggtggagcggggcctcaccctgcacctcaggttcctggagccttttgttctggatcaccagcag

SEQ ID NO: 525751 - DNA, 488 bp, Homo sapiens
  misc_feature (49)..(49): n is a, c, g, or t
  misc_feature (62)..(62): n is a, c, g, or t
  misc_feature (195)..(195): n is a, c, g, or t
  misc_feature (211)..(211): n is a, c, g, or t
  misc_feature (276)..(276): n is a, c, g, or t
  misc_feature (313)..(313): n is a, c, g, or t
  misc_feature (335)..(335): n is a, c, g, or t
  misc_feature (349)..(349): n is a, c, g, or t
  misc_feature (358)..(358): n is a, c, g, or t
  misc_feature (386)..(386): n is a, c, g, or t
  misc_feature (398)..(398): n is a, c, g, or t
  misc_feature (400)..(400): n is a, c, g, or t
  misc_feature (404)..(405): n is a, c, g, or t
  misc_feature (412)..(412): n is a, c, g, or t
  misc_feature (425)..(425): n is a, c, g, or t
  misc_feature (483)..(483): n is a, c, g, or t
ggagactccaggagcgtggggggtggtggtgctgggcaggtgctctgcntcccctttcctcngcacagcgccatcttcaccctcctcgggaaagccgctttggatgcctacacccgcttggtgcttttgctcaccatgcgagtcatatgaaatgcagagctattctgcagtagggtgcagtggagtttggaaggngggcatgagcacagcnacgcgagtcaagacttaaggtgaacttgtggcgaagagtaactagtgggagacctacctaatgcngctcttcgacgcgccaaacgtccaccactatagcccnctacagctgtagcgatctcgtnctcactccctcggnggacttcangaaatgaaagctgacttgaactcgcganaggatgcgtgtngnactnnaaagcgncataaaagcgagnaaggggctcgaccttcactcgggggctccctcccaaatgcgccgctcgacttggcagnagtct

SEQ ID NO: 525752 - DNA, 102 bp, Homo sapiens
gaaagcgctgctgtacgcggatgtggtggagatgactggaagcccgacacggccggagcgtccagaaagggtgctcaccatgcttccaggctaacagtgtct

SEQ ID NO: 525753 - DNA, 93 bp, Homo sapiens
gggggcccccggggttcccccaattttttgggggcccttgccccttttttttttttaaaaaaaagggcctttttccccctttttgttggggga

SEQ ID NO: 525754 - DNA, 744 bp, Homo sapiens
gaggttacctcccttccacacctccctcctggaggcagagagctacaacagactgagacagaaaagaggtaaggaagtgttgggggctggtgacaaccagctccccaacaactcctaggtgtttaaagaaggagggcaggaagacttgtgaagatgggaactatacaagaggcaggaaaaaagacagatgtggtggtcagggagtatgcagaagcaccaggaactaggagctagcccatgagacatggggagttggagctgaaggaggaatggcaggatgaagaattccctagattgcgttcctgaggaggctggcgacttcgtgaagatcctgaagacgcctaaaggagattcagccaggctagctgctaggtacccccaggcactttagcccgtgtgtggccatgcgccccgagtgctgctaagcgtcttgtctgccccgagagttgcggctgagatctgactaaggggcctggagatgatggagcttcagcctaaccagtctgcaccttcctctcctgatggcagttctgacctggagatagaccgaattggagacgaccttcaggactcggagcagctggtagcagtggacatgaattcgaactgggaagatgaactaccccgggcagagggtctgggcaccatgtgagacagctgagaaggctgggccgaggttgtatgtgggatgtgactggagaacgcatggacatcactggaagggtgttccgaatgggaccacgg

SEQ ID NO: 525755 - DNA, 238 bp, Homo sapiens
cccaaacccactccaccttactaccagacaactttaggctaaaccattttacccaattaaaggtatagggcgttagggaatgaaaaccttcggcgcattaggttattaggtacccgcaaggggaaaagatgaaaaatttattatccaaggcataattataggcaaggactaaacccctataccttcctgcataatgaattaactagagataacttcgcaaggagagccaaagctaaga

SEQ ID NO: 525756 - DNA, 221 bp, Homo sapiens
ttcaatttctacactatgtggagtacaattgacagtacctccgaaccattcgaagctgtcatcattggcataagaaacctgtacataatctacagtcgtcccgcttccaacacctccgaaagtaagtccattgatctctttatccggcagaaaagcgtaacccgcatattctattcttacgtatttgaaaaccccgctattatctgcgtgtagaaattgaa

SEQ ID NO: 525757 - DNA, 373 bp, Homo sapiens
gaacgggtatgctggttgggggcatcagagtatcccattgaggtgcccataatccatgcatgaggccctgtgcgatcacggcattggctggactgaagacttgccccctatggtgggaccagcaattttgcccagaacaccatgccctacccaggtgggcagggtgaggcggagcgattcatgactccccgggtccgtgaggagctggtgcgggaccagctgctggagaagcggtcgatgggcatgcagcgccccctgggcatggcaggcagtggcatgggacagagcattggagatggagcggatgatgcaggcgcagcgacagatggatactgccatgtttcccggggagatggctggtggtgagggcctg

SEQ ID NO: 525758 - DNA, 651 bp, Homo sapiens
cactatcaccctggaacagatcgagactccatctcaacaacaacaacaacaaacaaacaaacaaaaacccccacaaacatggcaaagaaagaatgagatttaattgagaaagcaaaagctaacaaatagatgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagatagttgagcttagccgctgctggccaggcctgtgtgtacttgttccaggctgtctagggcctggactatctaggatttatagcaattctagaatttaagtgtcctgaccttgaaaggggacttgctttacacccaaatatttcgaatatgttatcttgtctcttttctttttgttatatagacgagattgatgcataaaatctgtgtttgtatgactgtaattccaagtttagcgaaaattgtcctaggacaacacaccaacggacatgagcttgctcggtcctgcaagcttagtctccgatgctgcccacctgacacagatgtgcttagcttgttgcctctgccaggaactc

SEQ ID NO: 525759 - DNA, 298 bp, Homo sapiens
cgaaaatccgggatcctcccccggcccggtacctaacctcctggtctaattccccatggcacccgcaaggctcaaaaaatgcacttgaaaaacgggtgaaatttaaaaattccctggaaaccccccgtttacccggccccgatttggagccccccctaggccttttccaactaacttgggttccaaaaaaaagggaaaattttttttagggttccccccttcctccccaacacaaaatccaaggggtcaggggcccatcggcctttttcccccttttgtaacagcccccccccccttt

SEQ ID NO: 525760 - DNA, 1007 bp, Homo sapiens
tttcgcgcgaccagaagtggtttgaccgacacgcggatgcttttgccccctgttttatggaagggtcctttttcccgcgccttttgagtgggtcacccctctcttctttgtcatccgatgggtgccccgtattttgggcggtttcttaggtccccgggtggtggcccgccgtgtttgcggagacaaagcgcttccgcgcccgtgatgcgttgacgtgtgagtaggtgctaccactttgctcaggacaccctctcctgggagaatatgtgccccccgctttggtgacacgatattcgtggcgccgcccgcgttttattcccttatgtctcctcttttgtgccccctctccgcgatctctcttttcagcgcgtcccccttgtgacaaatagtacacacacgaccgcgagagatctcccaccagagtccgcctcctcccctttgtcaccctccgccagataccccgatttgtgcgcccccgccccagaggggttacttgaggacacctcttggggtatctccccgtgatttcggcgcgggcatatatttttctccacagtctcttcacaaataattttctccccccttattttctctcttgagaccccggcggagccctgtggagcctccctttgacacggtgtcgccacctctgggtatggactctccccccgttgtaagcccccccctcttgttatataataaattgaccatccccccaaacagttttgccacatccattgaacgtgtcccccacacatttagagcgttttaaaacacacaatagcccatattcccgagcattttttaacacccaacccacattttcacccgcgacaaccgacccgggggtatacataccggtctcatgccttttaaatcttttggagcccaacaccacacgtgttctcatccccctctgtctcctagagaataattctccccttaaaattttttaaatagggccccttttttcccctttgcccccccttttcccccttttgggccca

SEQ ID NO: 525761 - DNA, 597 bp, Homo sapiens
  misc_feature (26)..(26): n is a, c, g, or t
  misc_feature (62)..(62): n is a, c, g, or t
ttgtgcctccttccagacacttactntgataaagaaaggggacattcatgtaccaatcatcntcaagatgtttcttcttaaggcatcaccggtcagcctttcctgagcttccttcatcccctgaacaacttgctcgccactgacataaaatactttgtagctggggtttccattctcattgatgattcaagaatgcacctgcccactgggatccagtcaacgaattccgtgactatcatcatacgtcagggctaccatgcatcctcaggggcttcacattcatcatcactcctctacatcacggagtcatcagaacaaagtaagaactcagccaggctcagtggttcaccagtgtaattgcagcactttgcaaggtcaagtcggcgagatcatctgaggtcagtagttccagaccagcctggccaacatagcttatgtccatctctcctaataatacaagcattagccatgatgtgttggcaagcgcctgtattcacagctactcaggagcgctcaggtagtagaatggcttgaacctgggagctgaaggttgcaatgagcagagtttgtgctgctgcactacagagtgggcagcag

SEQ ID NO: 525762 - DNA, 805 bp, Homo sapiens
  misc_feature (152)..(152): n is a, c, g, or t
  misc_feature (155)..(155): n is a, c, g, or t
  misc_feature (159)..(160): n is a, c, g, or t
  misc_feature (163)..(163): n is a, c, g, or t
  misc_feature (171)..(171): n is a, c, g, or t
  misc_feature (183)..(184): n is a, c, g, or t
  misc_feature (203)..(203): n is a, c, g, or t
  misc_feature (214)..(215): n is a, c, g, or t
  misc_feature (230)..(231): n is a, c, g, or t
  misc_feature (251)..(251): n is a, c, g, or t
  misc_feature (255)..(255): n is a, c, g, or t
  misc_feature (260)..(260): n is a, c, g, or t
  misc_feature (271)..(271): n is a, c, g, or t
  misc_feature (283)..(283): n is a, c, g, or t
  misc_feature (291)..(291): n is a, c, g, or t
  misc_feature (295)..(295): n is a, c, g, or t
  misc_feature (300)..(300): n is a, c, g, or t
  misc_feature (311)..(311): n is a, c, g, or t
  misc_feature (336)..(337): n is a, c, g, or t
  misc_feature (380)..(380): n is a, c, g, or t
  misc_feature (402)..(403): n is a, c, g, or t
  misc_feature (444)..(444): n is a, c, g, or t
  misc_feature (448)..(448): n is a, c, g, or t
  misc_feature (452)..(452): n is a, c, g, or t
  misc_feature (536)..(536): n is a, c, g, or t
  misc_feature (578)..(578): n is a, c, g, or t
  misc_feature (601)..(601): n is a, c, g, or t
  misc_feature (640)..(640): n is a, c, g, or t
  misc_feature (678)..(678): n is a, c, g, or t
  misc_feature (731)..(732): n is a, c, g, or t
  misc_feature (787)..(787): n is a, c, g, or t
gaggactggagcttcccttagattttctcaagttcaaggcaagtatgcgcagctttgcctccctgtcctgggcaggggccacttgttatcctatctactgtgaattcataattcattcaggattggagttgcataggtaacctcccacaccnganaatnngcnatcactcntccccgcttccnnactctcagatattgctccnacctcaggagnngaagaggcttatgcnngtgggggcaggaggagaacngctnttccntcagctgaggnaagaggggctanttccagangganctgantcagtagccanagactcagcttcccctgtccttccnncagtcccttcacttcccctaccctctgaccgtatctctgaaanccaagttatgcgtatgtgtgtnntgcacaagcttgtctttagtgtggtatgtgtatgtgagtgngcangtangcacacacacaggggttaaccacccctcacctagggctccagactccagttgtccctctcctcctacctgtgtctccttgtttnggggtcctgactgaagaaggtgtccagggggcagagtcaggnccaagcactggggtgcctcctcncacctggccagagctctgacccacctactctcagctggngtgaggggcacccctcaaactcagtcatgtggttccanactaccccattccccactccagactctgacccagcctcagtcctaactcctgnngctgggctgaggggaacaagcatttgctgaaacttgaagaaacaaagcaaatcanaaacaggaataactcgca

SEQ ID NO: 525763 - DNA, 900 bp, Homo sapiens
tcctcagcgtgctgttgcgtacgcccattctgccacaaaggttcttcggcccgacaagccggttcgccctaccgccggtttttctgcgctctgggcgttccgtttcccaaaggggcgccattccctctcccccccgggcgcccagaatcctgactgggcggtgacccccaccttgcgacttttcttagaccgtttgcccccaaagtggccgcctcacctctttgcgtgcacaatagcgaacggtcatattctccggaatccatctggtggaggaacgacccacccaaggggttcccgcccctaagccccgggggcttttcagacccacggcgcccggtttctcccccgtctactgcaagaaaagggccacttttcctccggtacagcgcacccagagggacgccgtgtggaaaaacaatgaggaaaatcccactttcgctgggttgcacacctgctggagatgcacacaattctgccagcccgttgttctcaccactgtggttctattggacaaaaaagccgaggaaggagggacttatttcctcgcgggacgtgcaggcagtacatcacaacaggcgctcgccctccgccaccgggggccccctcacatagctttcccagaaaccccccactcttcaccctactgtctttcaaaaacacaattatctcccccaccccatagcttcatcaaagacatccccccttacaaacataactacagttaaataacaccttgtgcattccccagccccccacagtttcacgcgtccttcttacaccccaacgattggtcctctccgcaccaccacagcgccgccgtattatggtgcataaacagcctccctctccccagcaaattaaaaagaggggccaaaaattaaacttttgccccacaaaaca

SEQ ID NO: 525764 - DNA, 989 bp, Homo sapiens
gctgtgaagccggactacgacggcagcggactctatcaaagtcggagccgttgagtttctgctacagttcttcgccaccatgatgtctgcacgccatataagtgatgacgctgcagattcttgggatgaatgcatcagatgaaaaactgcattggagtgatcaagtaacgggcgtatcgtgcccaacgatgcaaggttgaaaggctgattcttctatggtgaacttgaatgactcgtggacgagcagttgcatggtagtcgagggacactgtaactgcgacatggcgctagttcagcagagttggagatgcgctgctaggcgttgggccttatcatggctcacgctccatgcaacaccgcagtgggcgattcgtaggcaacgttcgctaggaccctagggaagatctacgtagctatacccggattccatgagttcccgggtgtcttgcagctcgatatgtccccataatcacacccagagtaaataaagcgttttgtagggctacatttggggtgcgaacaccctttgagcgagcggactgttttagcctaaatcttgagattccgacaacacattggacaagcctaagcaaacgatagatagccccccagagcggtaagggattgttcttgggggttatcgtagctcatccatagccattgtgttggcggtgctccccgagcattgtgaggtgaacaggaaaggccgacattgttaaagcaattgacccttggtcgaaatgacttcccacgtgccatggtaagaacagagaaagcacctgctttgtcccgccagaagccatcagtggctctggcaagccaaccatgttgcccacggattgagcaatgtatgagagaggatccacaaaactcggtgtggtcaagttcccactaaagagaaccatgtggccgcacatcaaactttaggaataagcgcagtggcccttgtacgcacgaaactcgagttgcgatcgcgggacatgggtgtt

SEQ ID NO: 525765 - DNA, 894 bp, Homo sapiens
gaagcagaacaaatactggcaacaggtgtttaccaggcgaaggagatactcaagtcactagaacacgcaagaactacggtgctatctcctctgaagaaataattaagtatgcacataggatcaggtgcaagtaatgctgtatgtgctcgcactgcaacctgggttccagggaccccggagaccctatccaatgatttagagatgagaagtgggttaactgggtcacgatgaacgaatccttccactaagtggcgtgaatggccactttaccaggagatgctacttgcagcgaggaaagattggcagatgtccttgttccaaagtatccatggctacgtcaaatgacagtgtcgatgacttatgttacccacaaatagatagtagtgacttttgttggaatctccctgggacataataggacgaacagtgaagatgatgtagagattatgtcacggggaatcctgcaagaagtagtagtgagtctgattgaaagaccttaaaagaaatatagcagacttgaatactgtacgaattctgtttctttaacagtacgcaggaaatgtaactaacaggtgatcaaaataataaccaaggtaaacactggtgttgctagaactgggcaggtccttaacccgttcaaactgttaggctctctcttttactgccagagacctagttttaggtttaaggcaactaggtaggactttaggggacctaatcacatttactggtgacaatgaggggcatgttgcttctacctgtcgttcacgtgcggctgcgtaccatcgcactagtgcggattcgcgtcctatctcaagtggacatctacgcttaacgctgtacgtcaagaatttgtgagaaaacaacgctgaacactcgtgggactgattcatt

SEQ ID NO: 525766 - DNA, 132 bp, Homo sapiens
tctagaggatcccttcgcggtatataaactccaaccccctcctaatactaactacctgactcctacccctcacaatcatggcaagccaacgccacttatccagtgaggggttggagtttatgataccgcgaa

SEQ ID NO: 525767 - DNA, 981 bp, Homo sapiens
gacgaacccgagccatgttacactactccaatagatgatccccaccatgggactgaagaaccgctcagaaggatcgagagcatagaggacgtcaggtagctgatcgtgctcgtgagtgaggcaaggcactcgagtggatactctcgtgttcctatgcccagatgtgccggagcggctgtgacgattcgctcgttcagtgccccagactcatgactgcggtaggtaggcgaagatgagacaccgcgatccagcgagggttacttgcgctcgtttccctgcattcactacgacacgtgataggaaccagtgagaacacttgatgtgcgtgacagcgtcgttcttgctactaaagcattccgttgccattcttacacggggaagcgcttcctgacctcgcatggctacctaaacacgcggtattacagtgcttggatccaaggcgcatgcgcattgttaggagtggaagacgattgcaaagagaaacagcacttgagggctccacagacaccaggaactgggtcgtacactctaaatccgagggcggaagtcagtacggtgggtacagcccgtcccacacgaggtacgcaggaccatgggtccactttacgcccattgggattggcgcaagttcttggtgtgggcggcgtcgcacactgctcctggtggaccgcctacccccgttgaaggaagctatcccctttttgggacgtaacacgtcagctgggatgcacagtacacgtacgcccagaccacgacagttgagccaccgtaattggagggcgaacagaaacgagggggacggagacgcgtacaaattatccccagtgacccaaagaaattaacgagacgataatccaccctccccggtagcagtaggctaggtagggggaagggatttgcgaatggcggtaattcgaacgcccttacggtccattgcgttttaggacggagtgtctacaacagcaattacccacatccgtg

SEQ ID NO: 525768 - DNA, 375 bp, Homo sapiens
gcagatttacttgagcccaaggagttccaaaccggcctgggcaaaacaatgaatccccatctctaccaaaaaaaaaaaaaaaaaaaatttgggggggctgtgtacacacattcggtatctcccagctacggaggaggcgggggcggaaaatctattggagcccagaggttggaggctgcggggagccattgattcgcaccagggttttctagccggagagacacggtgaaaccgggttctccaaaaaacaaaaacaaaaacaaaaaataaccaggattatggaggtactatgatttgggagttatatgcttgcaggttataattttactggagatttcaaaaaatgtgtttatagctggaggggacgcagaaggg

SEQ ID NO: 525769 - DNA, 409 bp, Homo sapiens
  misc_feature (20)..(20): n is a, c, g, or t
  misc_feature (29)..(29): n is a, c, g, or t
  misc_feature (61)..(61): n is a, c, g, or t
  misc_feature (86)..(86): n is a, c, g, or t
  misc_feature (117)..(117): n is a, c, g, or t
  misc_feature (156)..(156): n is a, c, g, or t
  misc_feature (331)..(331): n is a, c, g, or t
  misc_feature (336)..(336): n is a, c, g, or t
tcccaggttcttcccccggnaaggctggnagactttccacggggaatgacagcatctatgnggagctcccagaaacatgacaaggnggactttcctgccctcttggagatcagaggnggaaatggcagcagaagccgcagctctgcgggtctacgntcagtggcacagatcctgaattccagcaaaagagctattgcccaaccagtttgaagaccgcccccccgcctctccccaagaggaactgaatcagcatgaaaatgcagtttcttcatctcaccatcctgtattcttcaaccagtgatcccccacctcggtcactccaactcccttnaaatncctagacctaaacggctcagacaggcagatttgaggtttccccctgtctccttattcggcagccttatgatta

SEQ ID NO: 525770 - DNA, 345 bp, Homo sapiens
  misc_feature (6)..(6): n is a, c, g, or t
  misc_feature (15)..(15): n is a, c, g, or t
  misc_feature (56)..(56): n is a, c, g, or t
  misc_feature (81)..(81): n is a, c, g, or t
  misc_feature (92)..(92): n is a, c, g, or t
  misc_feature (162)..(162): n is a, c, g, or t
  misc_feature (183)..(183): n is a, c, g, or t
  misc_feature (188)..(188): n is a, c, g, or t
  misc_feature (194)..(194): n is a, c, g, or t
  misc_feature (205)..(205): n is a, c, g, or t
taaggnaaaaacagnaaatgggtggttttcattggatgcaaagagatgtacagganccaattccccaaggggccaacgggntgtgaggggantgaggggcggaggtaggggccagaaagacttagaagatgtcccatatgtttaatgtctttggcctttaantctgatttctctgatgggaanattgnccagtncctggcttttncctggcagggcatttgccgggcctatgtggctttaaccttaaggctgatactttcctttaggtgtcactcttgttagccagacagaacttttgtacccaactacagatggctctgtgcttttagtagaggcattttgcac

SEQ ID NO: 525771 - DNA, 907 bp, Homo sapiens
  misc_feature (191)..(191): n is a, c, g, or t
  misc_feature (205)..(205): n is a, c, g, or t
agcgggaggccgcggaaagcgtaggccatgactgagcgctgatgtgaatccaaaggcctatccccttgccgatgcccagctcaccaagaagctactggacctgggttcaggcacgtcatgtaactataaagcagctccggaataggacgccagtcgaggccacgcaagagacgactcaagcagggccatcntctgatgtccatcngtgactggctggcaggaccgccggagccactgggatgatcatgtctggcacagtgccgctagctgtttgatagacgagaaatgtagccctaacgtgtttgatgcgctccaagtcaggcccatggggagacgcctgatgcgggtctcccaggcactgtcatgcgcactgttctggtcaccaatcaagagaagcgctcgctagcttgaaacgagcaggatatcgaagtgcctattcgaagcgagtccactctgaagacggctcgtataggtactgaacaccttgtggagacctctgcgcacgttgctccgcatgacacaagtgtatcccccactggagggttgtagtaatcaataattattctgtgttcaggcatgttaggtatttcccaggctagctgctcatatcgtgtatacgccaatgtaggtagctaacatctgggtattctggattgtcacgcgtggaacggggttctgtctttaacaggggcttgactatccaccctgtcctgttccttccctcacctctgtccatgccgttcagtcctttggatcgctccctgtatcggaacgaagtggtccagagcagaaccgaagcagggtgggtggcacccgtttgaacacaggcagagagaagcccgggagaaagcttgatgggagccaggagccgagatctggtaccaggtcttcagccaactaagctacg

SEQ ID NO: 525772 - DNA, 810 bp, Homo sapiens
gtgtctgtcgggtagaaataggccttgatgtcctggggctctccatgcaggtggggttatgtgtctgactgaaggtgtgatgtgcagaagagcttgagagagtggatcagagagtactagtgacagttactgcagagctcctaagtcaccactcaaccagtggctgtgtcacaaggatttgagggcacttgcctgtcttgtgaggtctgtgccacaatggtgagtctgaactgactgctccagcataagtgatcaggcagcgttgacgagtatactggtgtcctcagtcacatacacctgtgggaaaacggaccgcttcttggctcctgactcccagggtacagcgcccagtaactcatccttcattcagaggtttgctggccttcccggtttcccaaggagcaagagcatctgtaccgcccttatggcccgcgcctctgctctgactccattttattatacataagaaccaatctgtgtgacacattgggctaacgtggattcggttatacctttgttatatatatttttagcaacttggatttccagtgtgtttacaagagtagtcattaggtagtatgcaaaagagccaagagaagagattcgtatatgcatgagctcaaagccaaagcatgagagacggcagaggagtgctgagcaggggactctccaggctttctctgaccataaacacgccggggtcccaagggacctccgttccttttcccatttggatgcatccgcgtcctccaccacgtaccattgcgcagtgcagctggagcaggaatacgcctcagtgtgagggaatcg

SEQ ID NO: 525773 - DNA, 480 bp, Homo sapiens
ttttatttttttgatgcaaggttgttttccccccgccgcatttataaaacactgtttcctatgcctgcctgggtttctgacggcgattcaaacggtgaatccgaggaatcttttgggacctgcccagggctttttttattagggcccgctgggcaccggaatcaggggtgtacctttaattacgcgggcctaagagccacttacaggaaagccccttaactgcatgggagttttgtgtaaaaaacttctgcttctgccaaagtggccccaagggaatttcgcataaccttaccacttcgtggatctgcccccgctggaacaggtgtgttggtaaatacgataccacttgccggagacattttatagggtaaataatcctttaccaacaagctggatatactttggacttcggggcccaaattctaaaagacgaggctgaggcgtaacaatcttaaggggggagtgggggttcctctcaag

SEQ ID NO: 525774 - DNA, 147 bp, Homo sapiens
tgtagatagggaaactacatctcacagcactgacggtatggggatttcagaagccataagcttacggctctggacttacgtgacaaatacaaagatgttcaggtccttaaaattctagtcagggcagtgattgatgggatgacgcgg

SEQ ID NO: 525775 - DNA, 297 bp, Homo sapiens
ttggtattgtggtgttggaattggaaggaattaaacccccatgaggagttgggagaaattgcagatgtgcttcccagttcccactctcctcagtgttggctggaagtttgacagtgacctggggtgtaccgctgccttcttttggtatgtgctcagattcttcccctccttcactgaacaagcgtttattgagcacctgtgctggggatgtatcagtggaatgtgggattgatgacggatgatggagtgtgcggatgatgataggtgatggagtgtggggatgatgatggcatgtgc

SEQ ID NO: 525776 - DNA, 473 bp, Homo sapiens
cagtgacttgctccaaagtctacacagcggggcatggcagagttcaagatccacattcctggtccggctgactgtggggttcagtgggggttggcggtgcttgagcattgaagacaaagaccttgttgggttgctggctgcttctagagatggatgtggtgggtggatgatggtttgtgttctttccagagtcagatggctgggcagagtcaggacatcctgggggtgttggattcccaggtgtggagtgacaacactggctcatatccattttcagagctcatttctgaggcttcatctggtaccaaccctgtgaggcgaggatgctcctgcgaatccccttgtgcagccaggcttggagaagtcaaggatttgggttggggcacccaggaagcctgagggttagctgggtggacctcctggctcctcggccactgcttttcaccctgcctctatgtcattttcggggatcc

SEQ ID NO: 525777 - DNA, 783 bp, Homo sapiens
gttacacatactccccgaggtcacgtttttcgtagcgaaggcctgggattgggcgaatccgggaaacgcgcagaaccgaggaacgtccgccacggttgatcatgtcagacacgctgtaacggtctagctgtaccatacggtcttcatacagacccagatagccgtcataaatacccattacgttccagaccttctgtcagcgcagaacgaacaaccccgcgaattgcggcgttcatgcctggccgcatcaccgccgcttgtttaacacaccgattatcttaaatcatgactacctctgaactttggaatgcaaatgaaatctgttgccggaagtcttcttgcacatcgaagtgatccaacgaatgtgcacaatagtataacaatcacttcctgctgaattgattcaaggtcaggccaaatggcggtattttatacaacaaaatgcgggtctggctctcttttatactgattcatgaaagcatagaccgtataacacctccctgggtacgacggaacaggggtcctgatggaataattacatccgatcccggaacacgccgtaccgctagccctgctctacctgatccgacaccatatgtgcctgaaccaaaggcagaaagttcttccatcaccacgatgaattctcgcataaagcgggtccggcctgactgcagagtgcgaacatcgtgagcgccgctaacaaccggccaggaagtcacgatatcataatctctgccgactcatcaggcaacgccgacccataatgattgaccgctctatcct

SEQ ID NO: 525778 - DNA, 768 bp, Homo sapiens
ggagagagaactagtctcgagtatatatttttgatatttgggggtctccaacaaaactttattaccaaaacacgggaagcaggcacgttgggccctcagacggtaatcttcccatcactactcttaaggataactcagatgaccgggaggccaatgagggggctggtggcccggtacgtgatctcgtggtgagaagtggaaaccacctcatagggctctccggggagccgcagaggcattaacacaccaggcagaaacacgggcacgtgcgctgggacagttcgtgaccacaggtggctgacacgcagaggcgcaaacacgctgaaggcgtgctgcgagaaataaggcgtgaaccttccctcataagcaacaccaacgggtttaattccaggtcagggccaactccttccgccagtgaatccaatacagtggcacccgtggggggaacggatccttacggggcccctaggagatccctgcgatacgaaggccatgacccaccagacccctctcatggctgagtggcccagtggatagcttctatccgggagtccaaggccagtcttccacccggtgcccttccagggtaaccctcaccgggtgatcgacagtattaacaccatctacctggcacgcttgcacgcacttccccgctccttggggtcgagcgccaaggcctagcacctcttcgggccttagcgggcctgctcacacgctttgccgttgctacctggctccagatacctcttgcctgagcctcgataatcc

SEQ ID NO: 525779 - DNA, 711 bp, Homo sapiens
tgtcactctgcccaggccaaggacctccattgatcaggtgtggatccctgcgggtgggcatgggaaatggcgtcccatctgccattacgccggaagtgctggcctttgggcggcccccagccaaccagccagtgtaccaggtgtcaagagtatgcccggcgctttggtgttcccggtccattgctgatggaggaatccccaatgtgggtcatattgcgaaagcccttggccccttggggcctcccaaccagtcatgatgggctctctcctggctgcccacccctgaggcccctggtgaatacttcttttccgatgggatcccggcttaagaaatatccccggtatgggttctctcgatgccctggaccagcacctcagcagcccgaccagatatttcagtgaagctgaccaaaatccaagtggccccgggagtgtctggtgctgtgccaggaccaagggtccatcccaccgaatgttgtcccctacctgattgctggccatcccacactcaagcccggaccattggtgcccagagcttgaccccagtccgagcccatgatagtactctggggagcttaagtttgagaagagaacgtcctcagccccggtggaaggtggcgtccactagcctcccttcgtatgagaacggcttttctgaaaagggatcccgcacccctcctcggtttttttttccataaaagtttagaaaga

SEQ ID NO: 525780 - DNA, 197 bp, Homo sapiens
gggggggggggggcccccccttttatggggaaaggggggaaatggccccccttttggggggtgggccttttaggaaaaaagcgcgggggggaaattttttggtttttttaacccttttaggggcccttttttttttttgggcccccttggggatcgggctttgctttttttggggaaattttttcccccagaattta

SEQ ID NO: 525781 - DNA, 163 bp, Homo sapiens
ccgctaggaatggcattttctctctcagacaaggcgacagccagctcctgttgagacagattgggagtcattttgcagatctgcgcactgatccgccaaggggacacacagtgagttagcggggtgttgcccgtagcgggggtgttgcctgggtacctgagct

SEQ ID NO: 525782 - DNA, 622 bp, Homo sapiens
ggtggattccgtgggattgttttttacatctcctttttccttccttgaagaaaaattctggctgtcccaaggattcttcatgtatatgcaaaatttaatatattgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaatgcttgaacccgggaggcggaggttgcagtaagccgagaccatgcttattgccctccagtctgggcaacaaaaatgaaactccgtctcaaaaaaaaaaaaagtaggtcaattcgtaacagtttatttgggacacaccctgaagctttggtttggaataagaaatgagtttcaggaatggacaaaccatgtgttaaccaaggtgtccgtgggctatgaagaagatttcatttcgggcatccattgtggagtcaaagtcctctagtgaaaggcatagaaattaaagatttactatgcgtgataatatatgaggggctcaagcagataggattattgaagggg

SEQ ID NO: 525783 - DNA, 889 bp, Homo sapiens
gaaacctgcatttctatgcatctgctattccagaacaaaaatgggaatgtattacaggagagttacctcacagtgtcttatgtcgtggaacctgaaacataaccacgtgttttcttatatgatcattctgtgttgatactgcttttatttgagtttatgaacagaaatagaaagtatggtgcttgggtttgccctttcttactcctgaaagttaaatcagaagacactgatttcattcttgtgaaactttagctcagagactattgatctttcgtctccattacatatgaaccaacctattagtacaaacacatagctttaacagccatttctgctgatatctagtaatctattcttttaactgtgacacaactacgactacaatgtcctggagctaattctagcttacatttgccagtatttctgtatgtcacttaacgttcctttcctctaaggcttggcactacacactcttcgttactctttgcatacctgatggcactctatgtcaatgctgattgggtacattatacaatttctgtgctacatttaacacacttcacttttgcctcttaccgtgattgtcctctgagtaatcgatcgtactccaactcgacgtcatagcttgccaactatactatccacatgggtccgtaagtaccactaactaacccacacttgtctgacgacggctacgcaccaccctcctcatccaaaccaatcttctcctaaggaggccagttccactcttcagctctaaggctggacaattctcgtattggctccacatcaccggttcatctaacttaatccttccgggacctagcctggcgaccccacagcacgtcttgaactctcacgctgaactctatcaatattgcggtgatca

SEQ ID NO: 525784 - DNA, 419 bp, Homo sapiens
gaatccagagtgggcggggttgctcaggcatgttccatcagcacgggcacgtcgactgtggcaagagagaggacagcagctccagatcgtctcttaacctgagcccgtcctcgggggctaccttctcaggactggtcgcactgtctccattctccagtaagccacgtggagcttaggcagtatccgtgcacacatgccctctctgagggggtcagaagcaggggctggaggatagttaggaggctcctcaggtctaggtacagcctgtagccgttggcggagctcagccaggcgtcccaaaagagcagtcacatcttcagaggccagagcctgcctggcgcggcctggccagctgatggccctctctgtgaggcactgcagggcctcgccctcgggtagccgcacaggcagtctctgca

SEQ ID NO: 525785 - DNA, 328 bp, Homo sapiens
cccgagctctctctggtggggacgagactgggtgatttatatgaaaagaggtttaatggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccacagagagagcgtcagcgtccccccacagaaagagcgt

SEQ ID NO: 525786 - DNA, 100 bp, Homo sapiens
ccacttttaaccccttcttgctcatccagagaatttaaattgcttttgttcattttccatactactccccacacttcatcgccaggactcaggtggtgtg

SEQ ID NO: 525787 - DNA, 113 bp, Homo sapiens
gatctgtataccggatacctggaccttctacttccttcctcaactccagcctctatcttccaatacttcctacattcaaggacaaacaccaccactaaccgagagaaggtcca

SEQ ID NO: 525788 - DNA, 320 bp, Homo sapiens
  misc_feature (34)..(34): n is a, c, g, or t
  misc_feature (138)..(138): n is a, c, g, or t
aaaaaaaaaagccccagttgggcttggtggctcnacacctgtaaaaacccagcactttgggaggccgaggcaaggtggatctcttgagcccaggagttcgagaccaaacctggggaaagtggcaaagccctgtctctnaaaaaattaaaattaaaattaaaataccaaaattagctgggcgtggtggcatgtgcctatagtcccagctacttggggggctgcggcaggaggatcattgagcctgggaggttgaggctatgatgagccaagattacaccagtgcactccagcctgggtgacagagtaagaccctgcctcaa

SEQ ID NO: 525789 - DNA, 132 bp, Homo sapiens
aaatccacacaaggtatagaatccacacaaattccgccaccccccaccctttcttttttagaaggagccttgctctgtcgtccaggcatggagtgcagataagtagatactgatttgaacaaatactattca

SEQ ID NO: 525790 - DNA, 154 bp, Homo sapiens
ggggtgatctaaggatcccctcgagctgtcgtttcactactgcagtggattccagggcagcgacgcagatctggtgccaagctctccaggaactacctgaagcaaggctacattgagaagacggggccaagccaacggaaggcgttacgtgggg

SEQ ID NO: 525791 - DNA, 419 bp, Homo sapiens
ctactactactaaatgtcggccgcgtcgacggaggttgcagtgagcagagattgcaccactgtactccacctcccgggttcaagcgattctcctgccttagcctccccagtagctggactacagggcacgccaccacgcccagctaatttttgtgtgtttttagtagacacaggtttcaccatgttagccaggatggtctcaatctcctgacttcgtgatctgcccgccttggcctcccaaagtgctgggattacaggcatgagccactgcacccagacttctcaaatttttaaagtggttataaggtcctgcatagcctggtggtagtctccacctcccactctggattcatcccacctgtactcctccttgcctcagggtgccagtgcccctacccttgttgtcgaccggccgcgaa

SEQ ID NO: 525792 - DNA, 1291 bp, Homo sapiens
tgtcgctgcttgcttgtatgtgttatgttatctgctatctcgtggctgtggccggagcgcatgcccgttgttgttgttgctgtgagtgttgtttcactgctggcggtggcgttcttatggagcgctcccgtgctccttcatggtttgggggtttttttttcgggcgtggcccactgattgtggtgtccccacccagatgttggggctctgtccgctttattccccccgttgctcttagcgtgtgaagtgtgggttgttgttagcccgcgcgggttgctcttgtggtttatcgccctaaattgggggcaccttttcctgggtgccccaagcgctctgtggagtggtaatgtatttatcccagtttggggggctttctcatccgggtgttcttactcggtgtggtcacctttcaaggtgtcccaggttccccggttcttaggattattgggggaatctatttaggattttgagcatttagtcccccctagtcccgggtaacttcgtaggtctcacgtacccactggtgcgccccattggatttgaatgtaagggagggatccttgacctcctctgttatgtaaaggatgccttagggattgggaggccatagaggacttaggatgatggccggccaggatagttccagaaccggtttctatttcctcgaggcgcttctgaagaatgttagtatttagttaagttttggttgtgagtgtttatggaaaagggcacaacccgcgattatggaaccacgaataaagggaaatgaattattgaagggcgctgatcactggaaggtgataagctctttctatgataggggaagtagcgttcttgtagaccctataattttaataatcaacaccctcctagccttactactaataattattacacattttgactaccacaactcaacggctacatagaaaaatccacccccttacgagtgcggcttcgaccctatatcccccgcccgcgtccctttctccataaaattctttcttagtagctattaccttcttattatttgattctagaaattgccctccttttacccctaccatgagccctacacaacaactaacctgcccctaatagttatgtcatccctcttattaatcatcatcctagccctaagtttggcctatgagtgactaccaaaaggattagactgaaccgaattggtatatagtttaaacaaaacgaatgatttcgactcattaaattatggatgaatgccctcggccgattgcaaacacccagtcctgcgtactgagcctgatgggtg

SEQ ID NO: 525793 - DNA, 1260 bp, Homo sapiens
  misc_feature (266)..(266): n is a, c, g, or t
  misc_feature (763)..(763): n is a, c, g, or t
ggaggggacgtgtgaggagtgcggaatagacgaggactgcgggaatcggagtaataggcagatggctgcatgcgcaagatgcacatatctaggacttcgaaacagtctacttgtatgatcatcctcatccttggtagcaacagggctagtgagatgtagtggtgcctttatggtacaacttggaaggcgctgtccgcgtgtgtgccaatgatgctcacgcatgggaatgaggtgccttgcgtgcttatctgtaccaaaaggtcgtntcgtattgttaccctagaagtcgattatgccgagttggctacggagcctattccaagggtacccagaaagaacgatatcctgggagtacgtggggttgttctggatacgtcgaaacgcactatgatcgggtgcgtactgagaccacgtggtggggcactggtggtaagatcgtaggaaatcgataatgggcgatcgctccaaatgtaatcaaggcagaagctaccccactgtcttacccctgggagcagaactaggaaggagttcattccgaattctcggttgaaaccttccaaatcgagtgcaacataagattccacaactatgtgacaatgcatccttagcgcttcccattggaggaaacatttgaacagacggttcgagttgttgcaataaaggacccgggaaccttatctaagtaccaaactgtgggatccaaagatggcttcgataagttactagtccgaatgagggttgcggggctgagtgagtccgaggncaagataggtctacaacacggggtgggcgaggtggagatttgtgcaagccctcctgggttctccgaaagaacaccacccaattatatatttaaaccaacgggcgacgagacgcacctatactctaaaaatgggtttgcacaattcgctggtccgaaccgacagttaggtgaccgatcgttgggaaggagatttattatatacattacttcagctggtctgagagaggacatctcggttgggtttacgggaatatgggagtgtggtggccgacaactttaaggtctagcccgggaactttaatgggcaaacgttgagggtccaaattggaggacacaaaacttgagcattaggaggtcccataagaaccccgagtattagagacaaaataggccaaccgtgagaagcaccctccgtttgcatcggtctacgcgttacaggcgcagttctccaaggggaaccatgcaagtgggccgcatcgaagcacagattgagaaag

SEQ ID NO: 525794 - DNA, 182 bp, Homo sapiens
agctctttcaaaaaagctgtaattggccaggtgtggtggctcacgcctgataatcccattcagcactttgggaggccggggcaggaaaattgcttgaggcaagattgcttgaggagtctctaactcctcaagcaggagttaaagaccaggctgggcaacataccaagccctcatttttgtta

SEQ ID NO: 525795 - DNA, 584 bp, Homo sapiens
ttgtctttgttggattgggttaatatcaaagaccaggtctttgaactctgtaatttctttcttctaccatgttcaattctattgctgaggagctttcccaagccatttcgtgtttctaaaagggcatcccaagtttccctaattttaataatcaacaccctcctagccttactactaataattattacacattttgactaccacaactcaacggctacatagaaaaatccacccccttacgagtgcggcttcgaccctatatcccccgcccgcgtccctttctccataaaattctttcttagtagctattaccttcttattatttgattctagaaattgccctccttttacccctaccatgagccctacacaacaactaacctgcccctaatagttatgtcatccctcttattaatcatcatcctagccctaagtttggcctatgagtgactaccaaaaggattagactgaaccgaattggtatatagtttaaacaaaacgaatgatttcgactcattaaattatggatgaatgccctcggccgattgcaaacacccagtcctgcgtactgagcctgatgggtg

SEQ ID NO: 525796 - DNA, 231 bp, Homo sapiens
  misc_feature (100)..(100): n is a, c, g, or t
  misc_feature (215)..(215): n is a, c, g, or t
gccggttttgctgtgttggcccggctggtctcaaactcctccacctcaagtaatccacctccgcctgctcttttcatgtcctaacatggcatgtctttcngtttcattattttcctaccccttgtatgtcaagaaaccacattttgcatggtcttaccgagatgctgttaattgtcccagtgagtgcttttctaatctgcagaccatttacatcntcctggtttgcagcat

SEQ ID NO: 525797 - DNA, 683 bp, Homo sapiens
tgatcgagctcggtaccggccccctggggaattgtctgcccatccgaaggtgtggctggcacaggacagaacagaacctcctagcctcaagttccaaacccacactctccaatagccaggctctcagatgggaagcttcaaagccttgtgacagcctggctgaacctctccagcctggtcaacaggtagtgaatcctgtctctactaaaaatacaaaaattagctgggcatggtggtggacgtctgtaatcccagctactaggtaggttgaggcaggagaatcgcctcaggtgaaccaggaggcagagattgcagtgagctgagataatgccactgcattccagcctgggctacagaatgagactctgtatctcaaaaaaacaaaacaaaacaaaaacacaacagtctgttctgtggaggccttgggcagatgctgggagctctgagcacagactggtccctctgttgggagcctcttcccttcatccctcctggttaacttgactcagcataaaggccatttcttctaagagcctgtccctgactctccaatcggggatgtgtctgttgtctcatagagtgcccaattcctgccaccatttgtcatttccattcgcaacatttctttcattgtttgtttttcagagcctgggtaacagaccgagattctatctcaaaaaaaa

SEQ ID NO: 525798 - DNA, 436 bp, Homo sapiens
  misc_feature (1)..(1): n is a, c, g, or t
nctagaggatctcccggtgctgctgtgggaatgatatgatgtacggagcactgagtaaaggatgaagcagcttttaaatgggcagactagcctgggagccctgttaactcaggcccaattggttgtctcaaggggttccaggattcagtatcttaccacacccataacccactcatgggaagcctgtctctgcaccacaaaatatcaactgattaaccaaaaatattagaaacatatcctttaatgagcaggcagctcagacgtgacctttttcaaaaaaaacttttgttgatttcctcgtctcaggtaaggattttcctagtaaactttcacagaactttgttctcatcataatgtgcatcaaatagcctgtaacttgacagcagacaggaaatgtcttaatttcccccagaatcagacacaaagcttctcaata

SEQ ID NO: 525799 - DNA, 787 bp, Homo sapiens
tataaaacccctgtccttgggggggtggggttttaatcctaattgaaaaaaatttcatttagggggaaaggcccttggaaaaataggccttattttcttttgtcctttcaaacggggagaatttgagaattaaataaaacccccccgtggaatgatacctcgcgggggaaggccgtgttggacaaaaaaaagagaaagttgttgttttcaaaaacattgtaatttactccgaggggttatttttctcataatcttacagatactcatctcaagccgtgatttattatttaaaagaaggtgggcgtttaaaagagtgtggtgacaagtgtgctcttttctgtttttaaagatagttgtgaggagaaaaaaactttttctgtgtgtgtgtgggtgcgccccacaccaatccgccgggggcggcttatgagggagtttgctttcttttccacacagaagacaacgtcgtctttttttattactaaaagaggatatgtaataaacccctggtgataaacaacaaacaccaaaaacaaacaaaaaaaaacacaagaagaggagggggcgggggcgcgcgtctcctcttcctcataagaggatgatatttcttcccctgcctcatcgaaggaagagggggggggcggcgcccacaaatgttttttcgagcggcggtgtggtacccccacaggtgttttttctctttttgtgtggaacaacaaaaggttggtggtggtgccgccccatcatataatgatgggtgaggcggacgtgtgtcatttattattaaagg

SEQ ID NO: 525800 - DNA, 343 bp, Homo sapiens
tgcttctgcctgatctcggaagctaacagcgatcttggtcaaggcagaagcaagaagcaagaatcattgatcaaattggaaaacggaggctgctgagatgggaaagggctccttcaatgtattcccggtgtcttggtgagggcagaagcaggaagcgagaatcattgaaaaattggaaaaggaggctgctgagatgggaaagggctccttcaagtattcccgggtcttggtgagggcagaagcaggaagcaagaatcattgaaaaattggaaaaggaggctgctgagatgggaaagggctccttcaagtattcccgggtcttggtgagggcagaagcaggaag

SEQ ID NO: 525801 - DNA, 147 bp, Homo sapiens
ctagacacccgattagcagtatgttgatctaggcatcgataaatatgtaccacgtgtcatgtcaggcaaatatgataaaaataaagaaaaaaatggaagatataaaaaaaagacctagggccgggcgtcatggctcatacctagtaa

SEQ ID NO: 525802 - DNA, 270 bp, Homo sapiens
agtagcatctttatcttgttcactttttttttttaagatagggtctcactctatccccaggctaaagtgtagtggcgcagcactgctcacggcagcctcgactttctgggctcagttgattctcccatctcagcctcttgagtagctgggacctactgcaagtgccactatgcccagctaatttttttgtatttttagtagagacagggcttcaccatgttgcccaggagtttgagtccagctgagcaacataacaagatctcttttctt

SEQ ID NO: 525803 - DNA, 145 bp, Homo sapiens
agcgttctcctgctcggctcacgaagtagctgggattgcaggtgctgcaacatgcccggctgatttatggtgtatttagtagagacggggatctgctctgttggccaggctggtctcaaactcctgacctcaggtgatccacccg

SEQ ID NO: 525804 - DNA, 143 bp, Homo sapiens
ggccccccttttcccccgggggcccggtcccttttggggggcaaaatttttgggggccccgcccccctttttttcacccccccctaaaggggccccaaaaacccgttttgggccagggacctttaaagggaaaaattccccca

SEQ ID NO: 525805 - DNA, 554 bp, Homo sapiens
  misc_feature (104)..(104): n is a, c, g, or t
ggtcgttcctttgtctactatcacttgggcagactctcagatgctcagattatgtagataaggtgaaacaagctgcagaaatttcaatcatacagtatgagtanctgaactgactgtgaggagggtgacacactgaagtgtggaagaaatgaaggggcgaggtgtgtttgagaggctctggaagaaaagccaaaaaccagaattctctctggactgggcattgcgaatggttacatctggataattcacccagagaaacagtttcttctactgattgtttttgaagcagggcattgagctgagtccttgataacccaataccgtcaaggttcctcttgggcctgaaactgcagaaagatgaataaagaaagctgaaggagagcagttttgttgaagacagccttggaacagtctccttgccaaacagatgttctccgcagtgcagccaaatttacagaacgaaacgggtgacctagacaagctattgaactgtttcacggggtgttgggatcacaccaagaatggctcctctatcaacagatttgggtgtgcta

SEQ ID NO: 525806 - DNA, 233 bp, Homo sapiens
caggagaattgcttgaactggggaggtagaggttgcagtgagctgagactacaccattgcattccagcctgtgtgcgtgcctgtctgttggtgtatctgtgtgtccgtgcgtgtctgtctgtgcccatttgtgcatgtctgcgtctgtgtgtgcctgttgctgtgcatgtctgcgtctgtgtgtgcctgtcgctatatctgtatgtccatgtgtgtgtgcccatctgtgcatg

SEQ ID NO: 525807 - DNA, 328 bp, Homo sapiens
  misc_feature (56)..(56): n is a, c, g, or t
  misc_feature (64)..(64): n is a, c, g, or t
  misc_feature (68)..(68): n is a, c, g, or t
  misc_feature (80)..(80): n is a, c, g, or t
  misc_feature (117)..(117): n is a, c, g, or t
  misc_feature (172)..(172): n is a, c, g, or t
  misc_feature (185)..(185): n is a, c, g, or t
  misc_feature (234)..(234): n is a, c, g, or t
  misc_feature (238)..(238): n is a, c, g, or t
  misc_feature (254)..(254): n is a, c, g, or t
agcaactgctcctttctcagctcctaaatagctaagatacaggcgctgccacacanccggctantttnggtattttagtnagagacgggattcaccatgtggtcagactggtctcgntctcctgacctcaggtgatccgcccacctcgaccttccaaagagctgggattacngacgtgagccacngtgcccagcccgagaccctgtctcttaaaaaaaatccatctccacttcnggtngactgtgttactcagnctctgtctgcttcagtttaattttcgtacttaataatggtattttcttgcagagtgtttgtaaagaataaatat

SEQ ID NO: 525808 - DNA, 391 bp, Homo sapiens
acaaagggcccaaactctacatgctgctcaactcagaatttttggggaagcccaggctggtaactggactgtttctgctgctgagggcacatacccatcccggaggagctgtgagtttctcccccaactgagtagaggaaacagaggggaacaaggagggggtgctttgtaaggcaggtgtaatctggattaaaagaaattgtactccaaatattggatttctgagacctatattggaagagtcaatttagatggctagaaaaggaaaaaaaaaaaatctaaaacagctttcaaaaatactaagaagtggcactaccctcattttacaagataccatcgatcttattttgaggtgaaaaagagccacaaatgggtcctttctgagacacag

SEQ ID NO: 525809 - DNA, 135 bp, Homo sapiens
atatgttatcccaacacaacgagggtagcccaatgactggggcagtgggctgaagatctccaagtctctgatctatataattaaacatgttcatattgtacgggtgttgtttactagtgttgggcgataacatca

SEQ ID NO: 525810 - DNA, 461 bp, Homo sapiens
agagtacttcgggtgctttcctgagctgaggagattagagctgcttactgaagacatggactgtactaaagagctgaaaagattacatattgtgcaaattggctctattaattagaatagaggtagttttaagcagtaacttaattacatgtttcagtactcccaattgttctctgctgaatggctgttgacaatattgggagcagggaggagaaaaccaattttcaactggaccaaattggtaatagggaggggaggtcatgcgcccctttgaaatatgctgctgcattaatttgatgcactgaccttcagttttccatgtaattaggatgagctcatccagccccatgagctggaagaggaggcgtctacagtaggcagcactgatgctctgtggttctgacttttgatgatccagcatcttaacaataggcatgtgatttctagggaaagggcaccgg

SEQ ID NO: 525811 - DNA, 681 bp, Homo sapiens
agtgaccttagacagcctccccacctgctgcggatgttctttgacggccctgtatgacgaggactggtgaaggaggatgccttctacagttgggagagtagcacaggacccccctgagcacagggcaagggtgtggccccctaaatctgtcacagcctttttcaagtggctccctgaacccgaggaggagtctgacaccacccaactggagggctgtgtggggcccggggacctgggagccccacatggacaccaccagatggccccggctagcccgccttggacttcaaggggggccggccaaccaacgggccggttggccaatgggtcgccctgttagtggtgaatgtgtctgaactaaataaaagtggctgaagaggcaggatggcttggggctgcctgggcccccctccaggatgccgccacggtgtccctctcctccccctggggcacagagatatattatatataaagtcttgaaatttggtgtgtcttggggtggggaggggcaccaacgcctgcccctggggtccttttttttattttctgaaaatcactttcgggactgccgtcctcgctgctgggggcatatgccccagcccctgtaccacccctgctgttgcctgggcagggggaagggggggcaccggtgcctgtaattattaacatgaattcaattta

SEQ ID NO: 525812 - DNA, 206 bp, Homo sapiens
taccaacactgaaacactagagttaccctcagagcaggaagcacactgtgccatttctggggatctgattgatccagctgtggacatttggaaggcgaaggaagggaggtggctcctgccgctcatcctttcacaaggctcaagacttcaaccttgcagatgtatctattttcccctccatgttttctccttctaagtctcttttt

SEQ ID NO: 525813 - DNA, 911 bp, Homo sapiens
agcggaggtctccgccctcgcgcgggagctgggagtgctgctgagatccctaccgcagtagaccgcctctgccgaccgcggagcttcccgaacctctttcagccgcccggagccgctccccggagcccggcgcggtagacggctgcaatcagcaagacgtggagccccgacatgtccgcgcgcaccagaaacccgaacgaacgcaccaaacagagaggacagccaccagtgccgcgggcccaattggtgacaaggtgaaccgtaacgaactccggctactagagcccagaacgggaggccaaagaagggacgaggccgcaagaagcggcgcagtgcagagcgctacaatcaataccgccacaccgggacagcacggaaccgcagggtaggactagcaaagggacccaacgagaatcgactggatgggatacacaagaagtacggcgcacaaagcaaggagagcaaggcccctgagcatggatacagagattgcgcaatagcatgagccaacgtcgcggcaaccgttcagagcgagctcatgtagatgagacgtctagacacaagtgagggtagctagcacatcgaccttacagcggcacgaggacgcacaattaaggtgtggagataaccacgaaacaagctagcgattagacaggcggacacaaaccgaagtgctgaacagacaccagagggacatgggaacccacgggatggcaattaagccgtataccagtctacggctggtgggaaagaatgtaaggacaaaagaataggcgaaagtccacgatacgaagggagctctgggcaacttgggttcgagcatggcgtcacgagaagcgagagggggagagaaggctcgcccgtaccatgaggacaggagacaatggacgtaccccaccaaggcgccggtg

SEQ ID NO: 525814 - DNA, 235 bp, Homo sapiens
ggccaggaggcaggggtgcccaaaccacagggagcccctggggaagcctgctccatttttttggtgaccttgggggtccttcactcatttcccctgccccctcaggaaatggtgggccagcttccacacccccacctcccagtttttaacctttccatctgtttgtgtatggcctggagtcactccttcctcagcccccagggcaaaaaaggtcaaataaaaaccagagggctga

SEQ ID NO: 525815 - DNA, 617 bp, Homo sapiens
  misc_feature (269)..(269): n is a, c, g, or t
  misc_feature (325)..(325): n is a, c, g, or t
atactgtcgctgggatatagtgagccattatgaagggcgtcatctgccaacatcattcactaactctttctgttgcctaaaggagaaaattgtgctgagtttgaataggttactgcctattatagagaagagaatggtctgtagaaggggtgtttattctcaccattgactaggtgaccacctgctaaggttgcatggttatggtttcaatgtccctattgtgtacagagttcaagctcaaagaacagcaagtctccaagttagatttnagagaggatgtttttcttctcggtccaagggaaaatgtccgagtgtttccttctgnactggagagcatgcgggatggaagttggtttgctctcctgcgtcacatttcacaggatacaactttgaaagtgagagttcatagtttcttatggtaacttgaacttcaaaataactaagacctcagcataccgtgtcttgggcccactgaatgaattagtggtttttagaccatggcacttaatccaagctcctgttaaggctaatacctccgttaaaggtttccttgccaagcagggaaacaagggcttggccttgatacaccaatgagatgaaggctcaagctctcatat

SEQ ID NO: 525816 - DNA, 112 bp, Homo sapiens
  misc_feature (31)..(31): n is a, c, g, or t
gagatcgtgccattgcactccagcctgggtnacaagaacgaaactctgtctcagaaaaaaagaaaaaaagtcagactactgcaggagctccagtggcttctgcaaatgaggg

SEQ ID NO: 525817 - DNA, 404 bp, Homo sapiens
  misc_feature (262)..(262): n is a, c, g, or t
  misc_feature (293)..(293): n is a, c, g, or t
  misc_feature (310)..(310): n is a, c, g, or t
  misc_feature (368)..(368): n is a, c, g, or t
aaggagcccataggttgaaatacaaggtttggaagaaaatgtgatgcttgctggaatgaccagatgggcaaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgtngctgcagccaaacgtctctgaaagaaaatgntcaaattgtaattggtncaacgtgttctctccaatgataccttggatacattcattttaattttgaaggtttttnattccatctcttaatgtttttactttcaggcacctt

SEQ ID NO: 525818 - DNA, 233 bp, Homo sapiens
ggaggtgggggttgcagtgagccaagatcgcagcaccacactccagcttaggcaacagagggagaatgtgtctcaaaaaaaaaaaagtgtgatgagagattataacacaagaacctgatttggattagtaaggcttctcgggaaaagtggactgaagagtgaagggaaattacttaggcaaggggttgaatgtgccaggggcacacattatggaggggtaccggagctcgaat

SEQ ID NO: 525819 - DNA, 221 bp, Homo sapiens
agatcctggccataaaatgaaagatccttgcaataccctgtgtggcctaggaaggaaaacctgcaatggacccaaaacttaaaagaagaggcgtcttaaaggttcatatgtagtcgaactataaatgtatgagtggcagacctgataagcgtttgaggtcaaaacccttaccatgttgaaaacaaaatcttacatgttaataaaagtattcgtttgcttga

SEQ ID NO: 525820 - DNA, 510 bp, Homo sapiens
  misc_feature (284)..(284): n is a, c, g, or t
gagtcctgtggcctctccagtccagactgctcctcgatgaaatgaggcctctgtaccagctggttattgggccagctctcctgagccactaagtaggtggattcccaggcctcacctcctggtgcacatggtcaacgacatgagaaaccctggcctgggtggcctccaggactccctcgagctgtgatacaccacaaatctgtggcaaaacagtgtgggctgtgtcatccgagcagagtgcctctctcatgccttctctctctcttgacccgctcacacttccntctcccgggccaccatccatggcctggccgggatgctgtcccttcacacggacgagctctccacgacactgctgacatgggagcccgaagcagaacaagcgagttcagaaagaagcggagtcgaggctgacattccaacatccagaagcattttcttggtgctcctttaaaataagacaaaattgccatgtatcaataaaaataaataaataaaaacaaaaaaaaa

SEQ ID NO: 525821 - DNA, 152 bp, Homo sapiens
gagctcggtaccggatgcgatacggcgtgctgtaaacgcactccaccatattcatcccatcccccggctcgtgtacgtttcgcgccgcatttgccagaatagcgactgcccggcatagcgcgcccacagcgcctgcgggtagccgttttcat

SEQ ID NO: 525822 - DNA, 1543 bp, Homo sapiens
tccaagtcaaagctgtttaattatcattctcacatttttttcataaaaaaaggaattatagcaaagggctcacggctcagggttgtgtacattaaaaaactccaggtttgtggtggcaagctcgcgtttcttatacattcgtgggaagccggggctgtgctcccagacatctcaggccgcaagcagctgtgcactgtgtgtttcagaccgcccctttgtgacaagattgcacgccctgtggcgcacactgtgtggcacacgcccacaggggcaagacagagacgcaagcagctttttcttggacaagagaggtgtgcgctctttgcgcctctctctttcggctattgtgcgcagagagaccgccgggccgcactgtgtgcgcaggagattgtacaaccggcgcgggcgcgccaggcagaccgcatgtgcgggagtatcccctatggggcgcgctcactccacgtctctgtggagagaccccacatcttcacacaacagcgtgtagagagggcgcctgtgtgtacccccggggtgtgtgtctgacgactctgcgaacgcgctctgagtcttccccgcctctgccccctcttactctgggcttgtgtgcgctctggaggatcatatctgctacaacgagaggggagacaccccgaggtggtgccacaaccgcgcacaaggcgggcagacattatgtgttcatctccacaagaaacgagacaatcttgtcgacatttctcttacgaccgcagatccccctctttagttttctctcacacgaaacatatttcacccacaatagtcgaacaaacacaaaagtcggtgttacccccccacgaaggagagggaggtttcctctccccccccagtactttgtgtagtggggaccgccacaatctcacaagcgagcgtcggcgtcttcaacaacaaaagggacacacaccaaaaagcaccacacaaccacacaaccaaaacgctccagacggaccaagtagctggctgccgcacaactttctttcaacacgcacggtgcacaccagctgctggcggtcgcaccatctaaagtcacgacgggggcgatactagtgcgggcatccggcacataacaaccaaccgtgcttacatttacaacggctacaacatcttcgtacaagcacgaacggacaaagttggcgcgtggcatctgcgggcgagcaacacacccaagagctggtctgctacaaatactcgtcagacacatatcctatacccccacaacgtgggaggggccccacaagcttgcccgcaccgaagcgccctgtgtcgtgactgcatggcatcctccttgtgacgctattttgctccggcacacaggtgtgctgccccctagttgtgccactgtgcgtactcccccgcgtgctctacgtgtggtgtgtccgccccaccgcgagccaaccgcgaaggggtggctccaatttcccacgctgtggttgcaacgacgtctgtggcgtcccgcgccaccaagcgctgcgttggacgcaacacaccctcattctgtgtgcaccgg

SEQ ID NO: 525823 - DNA, 262 bp, Homo sapiens
gcacgaggcaactctaaaaagtttgaaagaagcaattgttccaccagatgtacagataacactgaagtgccaaaagaaacatttaaaagcaaggaaatatgacattaccaaaagaacataataacttgctggtaaaagacatcaatgaaaaggaaataaatgacctatggaaaaggaattcaaactactaatcttaaggaaactcgacaaggtaaaggaaattacagccacaattcattaaatcagtaacctttatgatacg

SEQ ID NO: 525824 - DNA, 302 bp, Homo sapiens
attctgatagatagaataatggtcagccgggcacgtggctcacgcctgtaatcccagcactttgggaggccgaggctggtggatcacgaggtcaggagtttgagaccagcctggccaacatggtgaagccccgtctctactaaaaatacaaaaattagctgggtatggtgattggcgcctgtaatctcagctacttcaggaggctgaggcaagagaatcgttttgaacctggggaggtgggagttttgcagtgagccgggattcgtgccatttgcacttcaaactgggacgacagagtcttc

SEQ ID NO: 525825 - DNA, 984 bp, Homo sapiens
gggctgtgaagggcaggcgtgggacgcggaggggcccggcgctagtggccgcagacagcgcggggctcccagcggtagaggcagcctggcggcaggaccagctggcggcgggcgcctccgaagcgggtgctcatgggagtggtatggcacttgcctctcctctctccattcagctactggctctcgcaaagttcaatggacctacctgggtgggttggggcggcctgtttaactctccacgtggttggggacaaaccgctggaagactcatcgagtctctttttatgagaaagttggctcgcacccctggggcggcgggcattcgtggaagcttccgtcgggcgctcttcggcaacggagatggacctaccgggaccccgtacgaacccccgggggccgggagcacatacccgggcgcgcatgcctttgtggaagcaccgtggagtgccgggcgcggggtcgggactcccggcctggccgagacggacccctggaacggcaaggcccgacctacacttccgcgtcggacggcctggtcctacccggattgcagcatgagcacagagcaggatggagcaaagtcacgaggctgtcaccaacaaagtggcctggtgtggggaacggacagcgctcgtggcgcccggggcaccagatggaggccgtcgcccgagcaagcacggtcagactgtatgcgcacacagacatgggtcacattggggcaagacacatctagcatgggggacaatgccccagaccgagttgagccgaaccggagccggactggtgagcccctagcagcacattggaatggaagcacaccgctggggccgacacagacgcggcaccgggcgactgctgacaaacgggcggcggagcacacgccgattaaccggggggcctcatatcaccacaatacgcgagtggtgatgcgtgcccgagccccaggcccgcagggccgtgcgccacacgtacacccaactgacg

SEQ ID NO: 525826 - DNA, 206 bp, Homo sapiens
acgggttacaaaggataatgattgaagcttgagagctgttactcctaggtcgctgggggaggacagaactattccatgtcatggttctatcaagcagtgggtgtgctcagactctgttgtcctgcggtggagtgtgaagtgagtgtagattggactagcaactctcagggtccttgcagcaaatacgagtgtgcagacttggcgtg

SEQ ID NO: 525827 - DNA, 311 bp, Homo sapiens
gcacgctggccggctatatcagccactccccgttcacttgtcctctactttgttgctcccttatggtcctcccaccgctcacgtgcctttcgtttaccttttcctacctgctcagcatttcacactcggtcctttgactctccctctcgccgtctagtctggcccaattgagctcacctttctctgtgggtcggcgcctgcttgtcctctgcagagaaggcagggcgattgcggtcaccggccttcaccgggcgtcccgttgccggcttgcctgccctgcatctcctgtctcctccccacagagagagcgt

SEQ ID NO: 525828 - DNA, 167 bp, Homo sapiens
cgtacgtccttgttgtgtgtacttagggtgagggaggacaattcctttcaaacacaagtttatatatagaatgggtcatttttaagtgcttgtaataaattttaaagtccaatataatttttcttttccccacttctgataatgtattttggccaaactgaaatgag

SEQ ID NO: 525829 - DNA, 1255 bp, Homo sapiens
cctccctcctcagtttttctcctctctcctcctctcctctttctgttccttctcctctgttcttgccctccctcttcctcttttccctcttctccctcccctctcgttccgtcttctcgtctctgctatccttgtgctcgcctctctcccgtccctccctcttctccccccctatttcttctccctgctttgctttgtcccctcctgctgccgacactctctctgtctctcagtctcgtagcgcgggcccacgactttgtctgttcttctcccttgtattcctggcctcttctctcggtctctttttcttgtcccatcttcttccttcttgtcttctcttcgcttacttgttgattttattccctttcttgcccctccctctttgttgtctgagtgtccccttatttggtcggcccctctcgttctccttccgtccacatctactcgctctgcacactacgctctcacctgcctttgattctagtctatgtctttaagactgcccatcatgctaagacacctgacaagatgctgcacacgacttcaaagcatcctgtatgtctattctcgtctgcacaacgcgattacctactccaaccggtgtcaccttaagacgaacacttattctgttcatacttaaggctatacacgctttgttcagtcataccatcgctggaatgcagtttttatcgagagcgtcacttgcgactgcacaatgatatgcacactaggccatggccaggtatgtctgttccattcgtgtatcttggtaaccttcagttcacatgtaccatgtacggcatatgatttctcatttatctgctggtgagactattattgccctacggtctgctttcagactattcccaaagtaatgaacagttggatcagcacatggatgttctatctgtatacatgtggaatatgtggagcaaaatttaatttgaggataagatatgagatcacattataatgcctaagcatgttgaaaaagaacctgagtgatgtttcgtatctgtacgtaatgtttagatgatagcagataaaagcaccaaagcaaaggatatgagctatttaggaattgattatataagatgatttgttagaaacaaatgttcaaggccctttgtaactttaatatgatttgtttaggattttaagtatctacatttaggtattaaatgtttatcatttttgttgtttcttaatagtattatgttgttgtttagtttttctaagctatgattaaaatttt

SEQ ID NO: 525830 - DNA, 792 bp, Homo sapiens
cctcggctccagcgccatggcgccctccaggaagttcttcgctgggggaaactggaagatgaacgggcggaagtcaggagtctgggggagctcatcgtgtagctctgaacgcggcaaggtgccgggcgacgaccgaggtggtttgtgctccccctatcggcctatatcgacttcgcccggtcagaagctagatcccaagatggctgtgagctgcgcagaactgctacaaagtgactaatggggctttaactggggagatcagatcctggcatgatcaagagacttgcggagccaggtggagtggtcctgggtgcacgtcagaggagaaggcatgtcttaggggagtcacgatgaggctgattgggcagaaagtggcccatgctactggcgagagaggactcggagtaattcgcctgctactgggggagaagctagatgaaatgggaagctggcatcatctgaagaacggtcgtgtccgagcagaacacaaggtcagtcgcaggataaccgggaaggacccggcgcaaggtcggtccctggcgtatgagcctgagtgggccatagggacctgctcggagactgaaacatcgcaaggaggccgaggaagtacaacagagaaagcgccagaggatgggtgaaagccagcgccatcatgatgcggcggctcaagagcacacggctcaggatggcagcgcccgggactggggccaccggcagcgcggtggccaccagcccgcggcggctgctccctggggtgcggcccaccaccggatcgggctcccacgccaaagc

SEQ ID NO: 525831 - DNA, 173 bp, Homo sapiens
agatcaccaaaataccacaaaggaagttcacaatacttagacgtagcgaaaaaaattttatggtaattgcaacaagaagttttccctcctagcgaggcagtgtatcagggtggcatagtaatgcccctttttttttttttggaaacaaagtttccctcaatccccaaggctgg

SEQ ID NO: 525832 - DNA, 953 bp, Homo sapiens
gggagccctacatgattctcccgtgacccacgtggaagcggcactcaaggatgctgctgcctgcgatggtcccgcctgcgccgcgagtacctgtatcctgcaatggcccgtggaggaggctgcatgcgctcagcccaggagcaggaaggagcggctgcggcgcgcgctggaagaaaaccgcactgattcccaacgtgagtttacggcccgagaggcttctgtgcctttacgagggtgtcccttggagtttgatgtatgctggaggtgaatgtgtgaccatgccatgttggatgatgaataccggaatgggcaaggcagtcagaaggtatcccaaagtcgttatgtatccacataagcttccacgcacgacccccaagttccctgcacctctgaagcatgtttgctaaagcgatcgtgcaagctggttgttcccagggcgccctgcggaatgagccgaggtcgacttgaccgtgggggcactggtgcgagcctgcagatgcctgacggtcgtcgaccgtgtcttgctggtcgttcacggagccctcggtggcacacctgttgggcgtctcatcgtcagccaccgtgctcccttttggttcgctatctcggctacgtttcgacgtcgtgctgtcagagtgttgcgttcatgcgggcgatttgacgatcccagtactctgggcaccatgtcggaggccaagccccgacctcatctgcacatcggcttcgccgtcccagctctgggcaagcgggtcctctgacatccttccggataccgtatttccctgtggccgacagatgacaggccaccgggtcatcacgcttcgacaaaccagtgacgacgtaccgttatccttccgggaaccatgttgttatagaagacagaaccaaccgcaacgtggaaggcttcacttgaggttcggggccccgtttgagctgaaagctgtcatggatcc

SEQ ID NO: 525833 - DNA, 279 bp, Homo sapiens
  misc_feature (249)..(249): n is a, c, g, or t
ctccaaagaaattcgcccacgaggcctccccccgagcgccgctccggcttgcaccgcgctttgctccgagttttcaggcctcggtgctaagctagcgccgctcgttcgttctccccttcagttcgccattcatggattatctaccggggcccctcatccaaaccacgttgagaatgttctccgacatctacaagatccggggaagatcgcggacggggttcgtgcctggaggttgaggaggaagatggntcagtaggaccagaaggtaacattcatgga

SEQ ID NO: 525834 - DNA, 166 bp, Homo sapiens
aaaaaattttctgggggtggggggccctgcctggtattcccgctccttgggggggttaaaccggggaattccttttaccccgggggggggggtttccgttgacccagtttgggcccctgccctcccggctggggcccaaggttggggttttttcccccccccccca

SEQ ID NO: 525835 - DNA, 138 bp, Homo sapiens
tggtcctggtgaagaagtatggcggttgtatcaggaagatgctgcgccgggggtggggggtactctgagacgctcagacagccagcaagcagtgaagtccccaccacgtgcttgagtcacctgatgccacccgggcag

SEQ ID NO: 525836 - DNA, 490 bp, Homo sapiens
gcaacatggtgaaaccccgtctctactaaaaatacaaaaattagctgggtgtggcggcgcgtgcctgtaatcccagctacccaggaggctgaggcaggagaatcgcttgaacccgtgaggcagaggttgcagtgagccaagaccatgccactgcatttcagcctgggcgacagagggagactccgtctgaacaaacaaacaaacaaacaactcccggaatgcttggggagactgatttgagtactaggaagtcccagtactttaggaggccaaggtagcgtggatcatttgaggtcgggagttccagaccagcctggccaacatggtgaaaccccgtctctactaaacattagaaaagttagccgggtgtggtggatgggcgcctgtaatcccagcactttgggaagccaaggcaggtgaattatctgaggtcgggagtttaaggccagccttaaactggcgaaaccccgcctctactaaaaatacaaaa

SEQ ID NO: 525837 - DNA, 426 bp, Homo sapiens
cacgaggcgacctggtggttcgcgtgaccggcaccgccgaaggcacccgcatcgacgcgcgctcccagtcccgggtggggcgaagcgacctgggcgtcaacgccaagcgagtccgcacctttcttcgggagctcgcctcccgcctggaagcggagcggcgagcgcctggctgatccgccgcttcaccgatcccgagaggcgttccttctggggatagaaaagccttccgactgcccccaaaatcgcgtcatctcaggacctgtcgaaatccatgcgcgaagaagaaacggccacccaccgggcgagggagcgatacggccactccatcgccttcgccgaggcgctgaaagtctgggcccgggtcgccgccctgagcttcggcgggcccgcgggccagatcgcggtcatgcaccgcatcctggtgga

SEQ ID NO: 525838 - DNA, 108 bp, Homo sapiens
caggccactgctccagttcctgtttagaggaataagcagatctacagcactgagcccaataacttgaagtgcctgcaatttcttcacgctacaactggactgattcac

SEQ ID NO: 525839 - DNA, 792 bp, Homo sapiens
ggggcgaagttgcctggcaggcagaccgggggctgcggggggagggctgggatgggacaagtttgggcgatcctgtgttacgtaacgtgctgctggcatcccaggttgctggtctggatcgggttcccgaagtctgcgccctaggtctgtccagcggcattacccacccgtggggtgggagtgggaggtccctcgggggaagtgagtctcgggacaatgtttacctccactcttggggggagctggggatatgcgaggaagaaaggcctaagtcgtgattcaaagaagatgttgcgagaacaagtgtagcagtggggcttgagtcctgcctagctccgttgggtcttcttccgcgcgatagccgatcgtgcagacaaactttgggcgtgataatgaggcgattcaggttggacccgcttacctgtgtatgaacgaggcatagtcggctcaatcgattgtcgggcggggtcagggggggtgaggtggcgaaaaaatgctgggttgaatctcgagtagtcccgcgagtaaggatataatgggggcctgccttaaaacatgtggctgtgtcaggcaggtggaacaaagcaagttgttaaactcgggaatgttccaggactgcggattcagaggtacatagcaaacagtcttatggatgtgtgttgaactttctttccaaactcgcgcctcccaatttgaaagggtgaacgctgctgggctactttgaaattgctgacgtgtgtgcttctctttaacagtcgggtcatggtgctctgtttcccagctggtggtctg

SEQ ID NO: 525840 - DNA, 119 bp, Homo sapiens
tatcatgcatagactttccttctcagctaattaataaaacatctttaggctgggcgcggtggctcatgcctgtaatcccagcactttgggaggccgaggcaggtggatgcttgaactct

SEQ ID NO: 525841 - DNA, 155 bp, Homo sapiens
agcaactgaaagcatagggctgaaaattcagagagtactctggcttcaacagattttggcgggaggttggagagagctggaagaatggtataacaaatactgaagcgtaagccattacggatgaggtatgctcagcgcggggtaccgagctctcg

SEQ ID NO: 525842 - DNA, 380 bp, Homo sapiens
ggagtgagaatacagcctggagcaacatagtgagtacccctcctctctaaaaaaatagaataaagatttaagtgtataacaattaagtgaaatccggagaaattgcactggaaaccgagccagcagtgcagtcactttggggaaatgcacataactgattatggtctaagtcatagctgtattctcctgttaatatttcttactggttctgcaggggtctgtgtgcctggagtaggtcagtaaagaaaggttagctagatagtggatgtagctgtgagtggtggtaaactagtgccaatccccaggtgatctataccaccggcactaatgtgttccttgaattcttttagaacaaaatcctcttcctccatggtgctaga

SEQ ID NO: 525843 - DNA, 400 bp, Homo sapiens
aggaacaatcaggacgaagtaaagtgcagagagtacagtagcaggagagggcaatcgcactacgacagcatcgtgaggtcagcgcaccgaaactctaggtgtgcaggcttatcctgatgacaagagccatggacctcaccatgtgtctgaaaagcgcaatgttgctacttaaattgctatgcctataatggtgcattaataggatggttaagtagcatattcgcagacttaactctacgtaagtcagctgtgtactgactgtccctcaccactaaaaattcaccaaatctgtatctttacttctttgtaacactgttaaatattggtatatctcagttctcaggtgtgattccagcagctatggtgagagcattgctgctcctgaatctccactttcatg

SEQ ID NO: 525844 - DNA, 251 bp, Homo sapiens
gaacatgaagagcgtacagtctccaggcccggtctgatgacagctctgagaagctgtctctgaacttttaaggggccctagccaccctttctgaggcattctgcactagttgggttattttcaccatgctacagtctgtgcttgtgtcccagactaacgcaacgggagctcttgggagacgtggcgtgcttggccatcctaaccttggagtaggtcagcgtcaagggagagcctggggcaacatggcagct

SEQ ID NO: 525845 - DNA, 166 bp, Homo sapiens
ggatactctaactcagagggtgtgaatctttaatgaaaatgaaattatagctaaatgttttttatcctcaaactctgctttctgtaacctatcagtgttttaatgtttgtgtgttcttcataaaatttaaatacaattcgttattctcgtttccaactgttagtga

SEQ ID NO: 525846 - DNA, 183 bp, Homo sapiens
tgcctcgcagttcccgctgtcattcagtttgcatgtctgccttctgccaggcttgtcggcacatcttctggtgggcactgtgcggaaacttgaggactaaatcagtgactgctgcatgcactttaaaggcatggcctgtctcctcacttcagtgcacggtccatcgaccaaagccctgttctg

SEQ ID NO: 525847 - DNA, 222 bp, Homo sapiens
tcactgctacgacggctccttccacctcttactcaccacaatgctgattctttaagaatcaccatagtactgatggcagctacacataatgctaagagcatcaatgaaccatcattcgtcgtcgcatcgtagatccaacataaggtgtattgaattggatccatatcccgagagaattgatgaggcagaaccatgttttgaaacagccagccgtcgagtgat

SEQ ID NO: 525848 - DNA, 839 bp, Homo sapiens
cctggaccttggagggacgtttccggggacatgtgggtctcaatgcgcagagaatgtttcttctcaagaagtttttcctggccaacgttgcgtggtgcccgccgaattgacccccctatggaagcccctggcgttcacgtgctccaggggattattcctgggaccattcggccctattatgcccgcgctattccccctgtattggatttcccccaccggcgtcaacattgcacaagccaagtttgtctgaggctcgaaggcgaaaggttgatcgcccgttctggtaaaaagctgggaagatggccctaaattcttgaagtcctggtgatgcccccatgttgatatggttccctggccagccccaagtgtttgagagcttctccagacatatcccccctttgggtcgcctttgctgttctgtgatatgagcaccagcaccacttgccggtgggtggtctcatccaaccgccagtggaccagaaggctgctggagctggcacaggtcacaccagtctgccccgaaagctcagagaggctaaatggatattatccctgatacctgccaccccactcttgatccgtggtggaagaacggtctcagcaactgtttgtttccattggccctttaagtttagtagtaaaagactggttaatgataaccatgccatcgtaaaaccctcccgaaggaaaggagaatgttttgtggacccctcttggttttcttttttgcgtgtggccgttttaagttattagtttttaaaatccgtactttttaatggaaaccacttgacccaaaatttgtcaccgaattttgagaccccttaaaaaagttaatgaga

SEQ ID NO: 525849 - DNA, 740 bp, Homo sapiens
cgggcatagaccattagacatggtgcgcgggggcgagtaagtcaggtgaacgatggtcaatagacacagtatttaccttaaggagatcctggatcaatgatgtacttggctatgtgagttcttctagtcggattgtaacaaatagcgccacgtggggacgagtctgacgcggtaactgatatgtaaatcacagatggagattctagatggtgcattaacttggattctactcattgcatgtgagtacacaatgcagactgtcgatctttctcacagttatcgtcgctcgaggacttggggtgcttgaaggttcctagttcatttggaagctgcgacgagctgtagtgactgtgacgctccgtgaagacagatctgggccgttgatcatgggtctaagcagcagacttccattgttatacgatatgtgagcactcaatagcatcgtttcgcagattcttagaactacggcaggaatgtaattaattgtaatggccttaaaagaatcattcgggacacgacccatgaaggactcgcgaagtttgcttcgccagcacatttgcatcacataatgaatgcagtagatttcgccttagattcgcaagtggtagattcccaaactcttccaaccccacgaataccaccggctactgtaacgtagcacgtgttcctatcggagccactttcatcactttatttgtatggtgggactggaactgctattcatccgcccagaagaatgg

SEQ ID NO: 525850 - DNA, 528 bp, Homo sapiens
ctcgttgggccgtggcagcacaagtagcagcgtggggcgggcggggcaggagcagtggaggcagaccccagctactccgacctttggctgcgtgaacctcagcccttccatccaccccgctgatgtctgcagacttgccacataaattcccactctgtgtaatctgctagggccatgaataccagtctgtctgcgaagatactagtgccagtcctggttgtgtccggtgtaagtgccagatccagcatctggcggatatgttactcccctgaccatgataaccccttgactaccaagtttgggtaggtagtccagcatcgaggtggacagtaagagcggtaggcttgtttgcacgtgagatacccagataactccacagtctaacctttggtgacacttaccactccccacgtctgttcactcaatatccgctgtctatataagtgactcggactacctacttctcatatagtggagtgtgccattggttgaactgcactcttcactaggcagaagtgccctcctctc

SEQ ID NO: 525851 - DNA, 253 bp, Homo sapiens
tacgtaatatgtaaccacacctaaacagagtatttttcaggataaggactggactctctccaaggatcatttaaattccaaagagaactacctacaagttaatttctggttcccggatccagtcattctccctagcaatcatttattacccctcatctaatctaatcccaaaccctaaatctaataaaatacttcttaaaatctgcaccccgtaagtgccctcccacacttcaacccattccactttactctg

SEQ ID NO: 525852 - DNA, 596 bp, Homo sapiens
tcagagcatggcctgcatgcagcaattcaaccatcagctaccgaaaagagctttctgtcaagggccgatcacgggtaatgtgcttggtttgcacaagttggtattgccttaattctaattttattttgttcttgacatacaatcaatggaaagccatatcccaatgatccaggaatattgcaaggtttggaaaccttccttcttactagtttcattttaatcaagatggccaattgaataaaaatcccagccatttctgattttggggaaaaaaattgaataattttttaaaagggtactgaaagctttgccttccggaatccctttaagtttgcttgataaagtggaaagtatgttaaaactggggcctttaaaaaaaaattccccccttacatttagaaaaattggcatctcatttggcctaaattggtttgggattcaaaaaccctttccccaaagaaaaaagattaggtttccctggggccccttttaaaaaagggtcaaatgtttaaaaggttaaaaaacaaagcccacttttttttcgcaggtgttttttttttttaaattgagttatgccaaataaaaaattggaaata

SEQ ID NO: 525853 - DNA, 412 bp, Homo sapiens
aattctcttggtggaccgaaatcttacaaattaggtttgtgacaaggctttcgtgtgtcgttcctatctggcaaaacatactagaattcagatgtggaatgaaaccttacaagtgtagtgagtgcagcacgcccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctggcaag

SEQ ID NO: 525854 - DNA, 558 bp, Homo sapiens
agctgacaagctacgctccttttgggccagctcagtgtgatagctccagagccagattaaatgcgctccaggttaacctggggatggtcaggcagaacaaggaggagaggccagcagtgaagggcagggctggtgggcagtggctgggggtgtcctgggtggggctggccaccctcgctgcctctgacttgggccagacctgcgttaagtggagtggctcctccattctttacaccccaggcccctggcaggtgccctgcctttcctctgcccctctctctgccaacccatcctctccctcccagcccctgcccgcccagatataaatataagagcattttccatgggctgagacagtcgggagggagggggccctggaggacaggctcctagccctactcctcctcaagacccgggtgctggcctgtcccctgcctttgccccgatggggatgagggagaggagatgggtcagggaacagctatggccattggggaaggtgacttggatgcaacctttgaaagagatgcttccagtaaaccccatcggttaagatca

SEQ ID NO: 525855 - DNA, 855 bp, Homo sapiens
  misc_feature (459)..(459): n is a, c, g, or t
agctgacaagctacgctccttttgggccagctcagtgtgatagctccagagccagattaaatgcgctccaggttaacctggggatggtcaggcagaacaaggaggagaggccagcagtgaagggcagggctggtgggcagtggctgggggtgtcctgggtggggctggccaccctcgctgcctctgacttgggccagacctgcgttaagtggagtggctcctccattctttacaccccaggcccctggcaggtgccctgcctttcctctgcccctctctctgccaacccatcctctccctcccagcccctgcccgcccagatataaatataagagcattttccatgggctgagacagaagggaaaacattcagctttattttcggcttgtgaaattcctgtccttcattcccaacaggtgcaatcgcctcatttagatattgggacccagaaatagaanacaatttacaatatagcttcctttagggatctggatgctaccaaacaaacaaacaaacaaaaaaagccctcctgtgagatgccgagacttaatagaaaccgtggttggagctcttgcctttttccaggccggtggagaccctcacccctggcagcctgaccgtgaagcagaggaggcaagagctccgggagacagtcgggagggagggggccctggaggacaggctcctagccctactcctcctcaagacccgggtgctggcctgtcccctgcctttgccccgatggggatgagggagaggagatgggtcagggaacagctatggccattggggaaggtgacttggatgcaacctttgaaagagatgcttccagtaaaccccatcggttaagatca

SEQ ID NO: 525856 - DNA, 918 bp, Homo sapiens
tcgctgccgccgacacgtcaacttccgggccgcaggtggctagaggaagaagctgatatttaggcaaataacaagaggttgcgagtaacatagaatttaaggtgggaaagcagccgccaaactgacaaatcgtcttcgagaccgagcaagaacaatagtagtccggaattaggctaatggcatggcagaaggtggtcgtttttcatagacccttacggcagcaatatctcagtgcaagctcaaagagatcacctataaacttatgcattcaaacgccattgtctggaacagaggtcgtaaccgatttaagtatgtccatctatcagtcctgaacagttgattcatttcatataatcgaactggttatattaatataaaggtacataaacaaatattaccatatatacctccgtcctttaccaatgaatatctgtatagaagcacgctgaccagattgtcaacaaatcagacatacaagggctaccaggattcactgattcactagtcctcggcatgatgagcccagggggtcctacaaaatcatgaccacccagaacgggaccactcattcgtggcaccatatattgggcaatacgtactgtaatcaggtaaatttgacctaaagtgtcaaaccgtagtttaccaaatagcaggcaaagcgtcagcacgatacggcaacgaaaccatgaatgggaacacaatcccccctcagggacacacagaaaggtgtacaacaccattaggggtggaagggacaataacttaccaaactcagtggagaaaacgaaacacggcacacaaagcacaaacaacatgcagggaaagcaatccccgaaccgccaggaaaggaaaactaaacaaaacgcaaaaaccgggaaacagcacacaaaacgaaccaacaatacgggcacaagaacc

SEQ ID NO: 525857 - DNA, 462 bp, Homo sapiens
tcgttagggagtacattacacatgcttcatcacgagataatattccagagttaatcctaagagttatccaccctacagtaaaacaggggaagtgggtacccacttatgacatgttcataaattcccacttttattatttctgaattaaagctagcaatttgctttcttttgataagaggccattttcttaaaaactttttgctaaataaggctaatgtgaacctgtgttcagcaaacttttgacaaacattgcaacactacactccttctcaaagtcagtaccccaaggattttccactcccaggctgagtacctattaaagtaactaggacttcagactgcattttactatatgaattcaatttggactcaactccagtatgtttatctaccacaactattgttttaaataatcagatgactgttttcataacttttattatctcctaaacgagggtaccc

SEQ ID NO: 525858 - DNA, 1315 bp, Homo sapiens
  misc_feature (292)..(292): n is a, c, g, or t
  misc_feature (315)..(315): n is a, c, g, or t
  misc_feature (384)..(384): n is a, c, g, or t
  misc_feature (710)..(710): n is a, c, g, or t
ggtcaggaacacgagtcatcaggggactggacgaggcctgttctgagactacaattcagcccttctgaaggatagacaagtctgacccacgtgtcgactcatacttgtcgcactacactacacataagtatccctatgtgctggaaggagcagtaggcactcctatgtcttagacgattcatcgtcaattgatgaaggatccaagtcgaggaataggatatccgacgaggcatcctcgcgaattagacaagcgttacgacgagcaccacgcatcagactctttacgtccttngagaagcgagctgggcctacttnaacgcttggtcaccagcattcaacaccttagggaacagatgatcgtcagtttgcttcgttcgcatttgntcgccatctctcgtgatacttgcatcgcgaatggttttgatctataggagttcttatcccacacgttccgttctcgtagttcgcccccatgtagtaattggactcgggaggccgtctccacttggtgactgtctatggcagggccttcgtggtgagcattatactcctctagactgaggacacagtcctcgagttgctatcggattttcatctgactagactatcactatatggggtgtagacgtccaatagacttttagcttggtttgagtgcgaaccaccagagtcaacctaccaaaagatacgggaaagccgggtggtgtctnttctgctagtagagttggccaagtggaaacacaacatgaagaagaagaatataccttaggggtgggactcctcagatttgagtgcagtgtgaaaaaccgtaaggaagtcccttgcttgacccacaaactgggaccttgatttcattcaccaggtcttagctaccaatggcccccctgagagggagccgagatgtacccagcgaagattgaggttccccccattacaatgtacctttcatttcccccttggaggatattatacgtcacaagcaggtacagccaattagatacgcctacgcaaagcggcaaaccgctagatcttccttacttggtcttgggccatgggagtttccctgggtgcccctgcccaacttgttggttggccagaaggttgttcccttacttaagaacccaacaattcaggagccccaaatggtcttgggaggaagacaagtccggctccaagagggccctgcaagacaaggatataacttccccaacaagcattagaaaccccaggggtcaccttgtctgtgggggcgaattgaaccatggtttgcctggcttattctcttgcttggtcaggtttggtgttggacggccta

SEQ ID NO: 525859 - DNA, 1485 bp, Homo sapiens
ctagcatcatcttgataccaaaacctggcagagacacaagaagaaaaaaataacacttcaggccaatatcctgatgaacttctccaaaaaaaaaaaaaaaaaaaaaaaaaaaaaaacactgtgtgtgttgcggcgcgcgccccgggcccctcgggaagagagctttttgtgaaaccacctcgcgttgtgggcgcggccggggccccgtgggtatagagggaaccgtgggcgccataagcgggttctccccaaggggagaacaccgggggcccaagaaccacacagagggcgcgggggacattcccctcgacccatatttaaaacaaccgcgccccgcgagggggcacaaccgacgagagcgcgtttccgggacacacaaatatctccgaaagaggagactcttatctgaggagagggtctcaatataacagggggggagatctctatataccaaacagagggggagcagtccccacaagagcgagaagcactcgagagaatttatctacagatatatataagcccccacgcgaatatcgagtggggggataacacatgaccagaccggcgacgtacaacagagctgatcgcagacgagtgtcgtaccacgtacggaacacgaccggaggagcatcatacgccggtccgcacgctacacgacaccaaaggaccacaacaccagtaggagcggcggagcggtggtgcaccgagcacaagccacgcagccagcatggtgccagtagcgagtactcttcctgccacgtacaccctgactgcgacacgccgacgacagtgaccacgtcctccacgcagaccgcgacgcactcaaccacaacgcgcgcaacggcaggcaaacgtgcatgcggaccaccaaaacgcaacacgacgcaggtacccaccgccgcacacctccgaaatcgcgaggagcggagaagcgaggggcagcgacacacgggcgagacagggaggaggagtgactcgcggataggagcgcggggagtgcgccgagggaaactagagccacgcgtaagcaggaggcccgaccccgtgtgaaacgacaacgcacacaagctgaccaaacagacgcgaacagagcagagcgcgagcgaacgcagacgggagcacgagatagaaaaggaactgacgagggaggaccgaaggcagccgtcgaaggcacggccgagagaagcacaacgagcgaagagagaagggaagaagagcggagcgcagcgaagaagaaagggcgtaagaagcaggcgacaagccaggagagaaacaaggcacggcgagagtggcagagcgcggcacgaggcgaagcgggaagagagccgagacagccgagcagcaagagaacggtcgtcgagcagcagagagagaagggagggcgaaaggagcaggcgaggagcagagcacgtatagacagcgagagaacaaaagaaacgaacgcaggcaaacagagcaggcgagcacacgaagcagagagcg

SEQ ID NO: 525860 - DNA, 116 bp, Homo sapiens
gcaaaagaagaaaactgagccctcgaggccaactgtttcacccttgagccttagactgatgggctgcctaagagctgcctgcacggcacagatcgcttacacagccagaagtgcgc

SEQ ID NO: 525861 - DNA, 299 bp, Homo sapiens
cctatgtaaaacgggagggtggagagcagaacaagatctgcctgcaaaccagaaatgtcagcatgtatctgttgtgttgttttttaaaaacccaaggtatcagggtcttgctatgttgcccaggctggagcacaatggctattcacaggcacaatcacagctcactacagccctcaaagtcctgtgctcaagcaatcctcctgcctcagcctccctagtagctgggaatacaggcacaggccacagtatccaagttgtttaaaactggatgaaaaaattacatgtacaagcaggatagg

SEQ ID NO: 525862 - DNA, 654 bp, Homo sapiens
  misc_feature (436)..(436): n is a, c, g, or t
tggaaatgggagtcaaagtctcaccctgtggcccaagggggagtggtaggggttggatctcagcttcactgtgcaaccttcccccttcccaagtttcaagcgattctcgtgcctcagcctcccgaatagcgtgggaattacaggacatccgcgtgatcagtgccgtggactgaatttgtgggtagttttatagttagaagagcgggggttttcacacatctggaccaaacgtggctctgtgaaactctgtgaccttcggtgactccagctgtgccctcggccttctcagaaggtgtggggcattacgggcgtgtgagccaccagtgccgggcctcttgggaatatttaaataagcataaaaaattctttatacacgggtagatttaattgaggtagccgaggagtgtggccccgtgtaagagtttgtgttcgtggncaaacaccttagaaacgtgcgattccttagccattcaggtggtacctttcggcgcctccctggggtcttccttgtgccagttactagttaaaagggtggtgggtgaggaccgctgggcagagtcccaggcgtctggctgtccagctccccagcccgggcctgcttgccgagccatcgtgggcgtccccggtgtggcgagtgtgtggtgcttgaacggg

SEQ ID NO: 525863 - DNA, 208 bp, Homo sapiens
acacttcagttcttatcaaagaaattacccagacttcatcttacatgatacgattatgcccgatattaacagtaaaaaatataagagaaggttatcttaaatagatcttaggcgcaataccagctgatgaaggcctctgatgccttcatactgttcagtcatctcactgactcagtccagcagccagtggaccaggcattcatactaa

SEQ ID NO: 525864 - DNA, 621 bp, Homo sapiens
tcctagtgacttaggctggagtgcaatgatgtgatctcgagctcactgtaacgtcttcctctcaggtccaagcgattctcctgtgtcagcctcccaactacctgggattacaggtatgtgccaccatgcctggctaattttcgtattttcagtaaagatggagtttcaccatgtcggccaagctgttcttgaactcctgacctcaggtgatctgcctgccttggcctcccaaagtgctaggattacaggcataagccaccgtgcctggcccagcagtagttattcttatatcagacaaaacaaactttaaagaaattgcagttaacaaagacaaagagcggcattatataatgataaaaggccttgtccaacaggaaaatatcacaatcctaaacatatatgcacctaacactggagctcccaaatttataaaaccatcactaatagacctaagaaatgagatcgacagtaacacaatactagtgggggactcactatgtcatgacagcactagacaggccatgagacagaagtcacaaagacacatgattaaactatacctggaccttgacttaaacatatatcgacattcatccacactgcgatatctcattcacagga

SEQ ID NO: 525865 - DNA, 1437 bp, Homo sapiens
  misc_feature (557)..(557): n is a, c, g, or t
  misc_feature (563)..(563): n is a, c, g, or t
  misc_feature (605)..(605): n is a, c, g, or t
  misc_feature (607)..(607): n is a, c, g, or t
  misc_feature (609)..(609): n is a, c, g, or t
  misc_feature (627)..(628): n is a, c, g, or t
  misc_feature (638)..(638): n is a, c, g, or t
  misc_feature (652)..(652): n is a, c, g, or t
  misc_feature (663)..(663): n is a, c, g, or t
  misc_feature (688)..(688): n is a, c, g, or t
  misc_feature (704)..(705): n is a, c, g, or t
  misc_feature (1395)..(1395): n is a, c, g, or t
ggaccttcctctctactgctgacctgtgctggtattgcaggcatccgagcgctagtgagcgagctgggacagagtggcaattctggcctgcggggaaagtagtggtggccacagtgcatctgtctgcacaattgtttgtgggccatgtcgcagattacctgattcagtcgatcaaactcgtgagcgtccccctgaattatcggcgaccttcctgtacatgtaccccgagggggactggattcttgaagggaaaccgtgcctcatcatcatcgtcagatgtgtaaatcatcctgacccctcgcccatcatgaaacacttgggactacctggggatacaccagtggtctctctctgacctagcagtgcatgtatattccttgtttcggatcatctagcaagaagttccaacttaggctgtgctatagggccacaatgaaacagcaatggacagtgaagctctcgtgggactccccagaccaaggactcaacagcagctgtgaggcccagatgttcacagttgactcacagatgtcctacacagtgcccattatggcttngctttngtctgccaccctgaggtgctgcccatctatacggagctctgncngncctccaagcgcaggatgnnaggccgtggncaacgtagtccatnggggccatgtnctgcatgtatgggctcaccagcaanctttggatacctcacnnttctacagcagtgtgaaggcggagatgctgcacatgtacagccagaaggacccgctcatcctctgtgtgcgcctgtgcgtgctgctcgcggatgagcctcagtagtgccaggtcgtgctgtatccctataccgccgggaccctgcagcagtctgcatttatcccaggcaaggccttcagactggccacttactatgtggccatagcgtctgatcctgcatggtgtaggtcaatgtccttgtcatctgtgtgccaagcatccgggcatatctttggagttatcggtgtccacctcaggccccaagccgtcatcttcatccatcccgcagcattcttactacctccgcagttgtagccctcttgagggtgggagcctttctataatcctggcccagagatcccaggccgtgtgctttggacgtcctgggaagttcacttgttcattggcccgtcagatctaggcattacattgtttgacaacttgggggccacaatcgccaaagaccggatggtctaggaccacatggatcaaagggcgctgcctgggcacaacgggtaccctagaggcgccaattgacacaatggaagggggccacagggccaggaccccaacgggtacaatactgaacaaaggatgtggcaaggcgggcatggtcccaaagaaagcggaggagaacagaagggcgggagnaacagcaaaagctggaaaccaggacacaagtgacaacaccgc

SEQ ID NO: 525866 - DNA, 390 bp, Homo sapiens
  misc_feature (245)..(245): n is a, c, g, or t
ctgcacaaaggacactcagaaataagacagtggagcaggagaaacaaagagccaacatgtccaatcagaggcaggaggaaaactaggagcctggagaagagtagatcagccagccagagtagatggtggacaaatgagtaattcgggggcaacttacataaatgaatttatctctgccttgcttattatgccttttccctattctgattgatagataccaccaataaggtaaaaatgtatacccnctaatgttgatgcatggagatttataagcattttcttttccttgcttgattttagcattttgttttcaaactataataaatttgcctttttttttctagttctttcctctggctcttgtggtgttttctatggttgctacccaca

SEQ ID NO: 525867 - DNA, 989 bp, Homo sapiens
  misc_feature (261)..(261): n is a, c, g, or t
  misc_feature (270)..(270): n is a, c, g, or t
  misc_feature (288)..(288): n is a, c, g, or t
  misc_feature (295)..(295): n is a, c, g, or t
  misc_feature (678)..(678): n is a, c, g, or t
  misc_feature (687)..(687): n is a, c, g, or t
  misc_feature (693)..(693): n is a, c, g, or t
  misc_feature (745)..(745): n is a, c, g, or t
  misc_feature (812)..(812): n is a, c, g, or t
  misc_feature (844)..(845): n is a, c, g, or t
tgggtcttattctgcttatctctgctctaatctgttattttcttccttttgcttggtttgtcattagtttttttttccccttcaggtgtaatattaggttattgatttgagatatttcttctttttaatttaagcacctgcagctataagcttccctttagcatgggtttgagatctttcttctttttattttaagcatctgcagctgtaagcttccctttagcatgggtttgagatctttcttctttttaatttaagcanctgcagctntaagcttccctttagcangggtttnagatctttcttctttttaatttaagcatctgcagctgtaagcttccctttagcatgggtttgagatctttcttctttttaatttaaggatctgcagctgtaagcttccctttagcatgggtttgagatctttcttctttttaatttaagcatctgcagctgtaagcttccctttagcactgcctttgttgcctcctcctgagtttgggtatgtcatggtttcattttcatttgcttaaacattttttgtcctattgtaatataattttgttgtttttaataaaggtaattaatgaaacacataatgaattgtgcttctatttttataatattttaagcattcttaactcagaaatgtaaattttagaaaaaaattccaggccnggcacagtngtcacncctgtaatcccagcacttgaggaggccgagacgggaggatcatctgaggtcnggagttggagaccagcctggccaacatgtgaaaccctgtctttactaaaaatagaaaaaaaatatanaagttagctgggtgtcatggcgggtgcctgtnntcccagctactctggaggctgaggctggagaatcacttgaatctgggaggcggaggttgcagtgagctgagattgcaccactgcactccagcctgggtgacagaatgagagtccctctcaaaaaaaataaaatttcaaaaaaaa

SEQ ID NO: 525868 - DNA, 470 bp, Homo sapiens
attccttggacttctagcctccttcttctacgcctccattggggaataaagtcatggtgcttctccaaggcagcccagctcttccggtctggatgggcagttgtctctaggacggaactaggggtatactttaagagctgtaatccttgtattctgtagtattacagaatataattctagatgagtcacatcaactaaatcaacggggtcaaaatctcacttctcttatcctacgggttgaaaagtagtcatctttataagcacaaatgagggaatgtggtacagattaaacaaaaagggcagcataccaaaaccacgggtggcatatgaatatatctgatatccgggtaacggacaaaacttcaaaagtattaaccgatagtctagaagacggaactcagaaaaaaaataagtgggccaggcacgggggctcacaccggtaatcttagtacttggggaggccaagacag

SEQ ID NO: 525869 - DNA, 826 bp, Homo sapiens
tatttacaatgggtggcaggcggaatttttctaattaagttctttattaaccatgaagttagtggagggtgttttaaattcataagaatggtgtttagaaagtaccattgttcagcgcgtatttagatgatcttggcctacaataaaccggacccaccgcgcggtagaatttgactgtaggtggaaccgcgcttgtgccccgtcatagttatgcgtgagacaccctctcgaatgagagctgtctacaagaaaaaatctctcgcgggcggggcgcacactctctctcggcaggcacaccaccacttttcttattaccgcacgtggctttacggaactcctttggtgtagcgaccacaccccccttgtgggggagtcatactattccaaaaggtgcagattacatgcatcattatataaaggtattaaaaaaaagaggtgatgcaatagggacctctctgctaggagacatatatgccgtctgtataaacatgcgacgttccgttgctccaacgtatgcgagagttggttacatacatatttcctaccgataggtgttgagtataacaaatcgttaggtaatattgaaatacaccccgtgtctgatgccccgactccactaccgccctcctcactctccacgccaggtgacacacgcacgcgtgccgccaccacaccctctcctcctgtacttctagttcctgcaacttattattatcacctcttaaatctttattctctaatgctactcgtacaaagttctcactgtagttacccacaaaagaaaatatcatcaagaaaaaatttgcggcgggctaaacaaataaca

SEQ ID NO: 525870 - DNA, 824 bp, Homo sapiens
ccagttacatcactcataatcacattgctgctcccacagaaaggtctctagccagttttagcgggcttttcctgactttgcaaacaccattgattagaattagattgaaaatcaaggccagcagttttctgagaaaaacataaagggcttctttgaaaaagtggggagaagagcttttgttgtcagaaaacttgaggtgtttgggacacatggaaattctttggtttgaaggccctcatcagtgtcacctttgcagattgttcttatcaaagtgattcaggagaaggccaagtatgcatttagattaatgatgcagggtttgttggcttggccacccaagcaaggtctgcaccagaggtgattcatctccccagcttactgttctaaagagaaatacatttctgtgtacacctgaaaaattggcagcccatccttagaagatttcattcataaattctttgcttttcatgtatctgttaaaacaaaaaaaattcttttaccaactattcaaagtaatgcagaattgtgggaaccaaattcagtgtgaatctctgaatttgctataacagtagtaatattgtgatagcagcttccaactatggaccatctagtatgttctaaacacagtataagatgctttcatttcaaaataccagttccaacaaatctttggcaaacatttcagttagcctcaggccaggcgcggtggctcatgcctgtaatccgctcatgcctcattttgggaggctgagacaggcagatcacttgagcccaggagttcgagaccagcctgggcaacatggagaaaccctatcaaaagacga

SEQ ID NO: 525871 - DNA, 256 bp, Homo sapiens
  misc_feature (18)..(18): n is a, c, g, or t
  misc_feature (100)..(100): n is a, c, g, or t
tatttctgtataattttnattatgaccataaaaataacaatgtagtcaataacaatttaattgtacattttaaaataattaaagtatataattacactgnttgtaataaaaagtataaatgttagaggtgatggataccttatttaccctaatgtaattactacacattgtaggcctgaatgaaaatatgccatataaggcataaatatatacacatactatatacccacaaataccaataataaatttcaataag

SEQ ID NO: 525872 - DNA, 130 bp, Homo sapiens
ggcgactctacaggatcttgtgtcatcccccttcgtattcttggaagcagaagtgggtttcagcctcctctgccatagatcctgatcctcacacatttggggatccctacttgcccttagttacggcttc

SEQ ID NO: 525873 - DNA, 361 bp, Homo sapiens
cgagctcggtaccctcgtcttttgataggtcttttaccaactattcaaagtaatgcagaattgtgggaaccaaattcagtgtgaatctctgaatttgctataacagtagtaatattgtgatagcagcttccaactatggaccatctagtatgttctaaacacagtataagatgctttcatttcaaaataccagttccaacaaatctttggcaaacatttcagttagcctcaggccaggcgcggtggctcatgcctgtaatccgctcatgcctcattttgggaggctgagacaggcagatcacttgagcccaggagttcgagaccagcctgggcaacatggagaaaccctatcaaaagacga

SEQ ID NO: 525874 - DNA, 773 bp, Homo sapiens
ggacacttcctggtgggatccgagtgaggcgacggggtaggggtggcgctcaggcgggaccatgggtatcacggctcactgtgcctctcatgtgtgatgagcgtgttctgggcttcgtcggcttctgtggtgcctgtggttcatccctaagggtcctaaccgggagttatcattaccatgtgtggtgacctgttcagttggtgctatctctttggtgatgtgcaattctggcccaatcaaccctctcttgtgaccgcaattgaaaaatgaaaccatctggtatctgaagtatcatgtggcctgggaggaagaagaaatgtctacagtgctcagtcttgtgaggtcacgagaaagagaaatgccttctagatgcaaaatcactccaaaacagacattttctgtgactgtgcctgtttgtggccattagtgccttaaacgttaacagcacattttgaatgccttattctacaatgcagcgtgttttccttttgcctttttgacttgtggtgaattacgtgcctccataactgaaatgtgccgatccaaaaagattatgtactcttctgagatagaagatggtgtcttctgaagatacgttactctctccttggaatctgtggatttgaagatggtcctgcttctcaggggaatcagtgaattgttaggaactgtggcagacaaccagactcagtgggtgtcagagagagcagtcgaggaagccttcaggaatgcaatattttcggggattttctttggacttgggaattcctttc

SEQ ID NO: 525875 - DNA, 155 bp, Homo sapiens
agagtatgatggcctgtggtgtatgtaactttaatagtgtaggaagctgaataatttatgaaggagaggggtcaggattgattcgggaggatctattggtgcgggggctttgtatgattatgggcgttgcattcagtagtagttactgggttgca

SEQ ID NO: 525876 - DNA, 449 bp, Homo sapiens
atatatatatatacagttttctttttatggtgaaagtttagtttatttatgtgtaaatatacctgtgtgtatatatataaagttgtttttatggtgaaagtaatatatattcattgtaaaacaaccaaaaaattaagtaaattgtaaattgaaaatggattacttggccaggtgtggtggctcatgcctgtaatatcagtagtttgggagggttgaggtgagtggataacttgatgtcaggagttggagatcagttgggtcaacatggtgaaactccgtgtttactaaaaatacaaaaattagccaggcatggtggcgggtgcctgtaatcccagctacacgggaggctgagacaggagaactggttgaacctggaaggtggaggttgcagtgagccaagattgtgccactgtactccagcttgggtgacagagcaaaactctgtctca

SEQ ID NO: 525877 - DNA, 403 bp, Homo sapiens
  misc_feature (14)..(14): n is a, c, g, or t
  misc_feature (306)..(306): n is a, c, g, or t
  misc_feature (353)..(353): n is a, c, g, or t
aacattaagccaancaaagagagctggaaagtctttgaagagatgattgaaccttatcggcttcatgaaagccacaaagatttgaccactgctgagaaattaaaaagagaaagtccatggaaaattacagatgcagaactggaagcagtcaaggaaaagagttaccgtcaagttcgactgaacgagctcttacaggaacactccagagccgccaacctcatcgtgttgagccttccagtggcaagaaaaggatctatttccggatttgttgtacatggccgtggttagaaatcctgaccaaagaancttcctcctgtgttactggttagaggaaatcacaaaaatgtcttaancattttactcttaaagcctgaaggatgagaaatgttgtgccttggtgtct

SEQ ID NO: 525878 - DNA, 108 bp, Homo sapiens
ggtgaaatgtgaccctcggcatggtaaatacatgagctctgctgtctcttgtaccgtggtcgacgtggttcccaaagatgtcaattctgccattgccaccatcaaaac

SEQ ID NO: 525879 - DNA, 742 bp, Homo sapiens
cgccttctcaggaagaatgatagtatgggcgactggcgctcatagatgcatgagctcgttaagagctgagtgtacacatgagatgtgagtgtttatagaaaggcatgtctaataaataaagccactgtcttcatgggaaaagtggtttttccatttaacatgggaaaagtggtgtattagcgattcatgatgagtgtggattattgaaagtgcatgcggtttgcatcggaccccagccccatgtgtacctcagcttcactgagctccatgagaacccgtctctaatacaaatacatgacggaaaggaaaaatgacaaagacatgctcaaaaaaaagtcctccgcaccatggagagagactggccagtgatatcatgtgtacctcagctcactccagcgccatgtcgggttggaggtctcttattctcatgcaacgtaattcaagccctacatccatgcatttcaataaaccacttttcccatggtccagaaagcacatccatttaacatgtgcgctgggggattttccatttaacatgaggggccgggggtctcatttcgcatggcaacggatgtcaagtttattacatgtcaacatggaaagggcgatgcttccatgagcggggaatgagcacttttcccatgtccttgtggcgcacaagacaatcatgtgtacctcagcactgaagagtccatgtcaaatggacaaacaatgggaccgcatgtcatacacctatcccaga

SEQ ID NO: 525880 - DNA, 126 bp, Homo sapiens
gtgagtcgagtctgagtgaatggcgtcgactggtataggggaaagatatcgaacattagtagtggtcctccgaagtttcctcaggatagtggtgtctcgagactgagcacccagcggcggtacgag

SEQ ID NO: 525881 - DNA, 87 bp, Homo sapiens
aacaaccatttgtcgcttgtacaatcgcagaatggcccaaacgcttagtgttgtgccctgtttttaacataaagtatcttgaaataa

SEQ ID NO: 525882 - DNA, 105 bp, Homo sapiens
ggaggacatgcaacagaaatccaatctagagctgcaccgcatctaccctagctgctcatctgatatctgtggctggagcccagtgcggttcctacagtgagtatg

SEQ ID NO: 525883 - DNA, 134 bp, Homo sapiens
agcgggtgactcagaggatccgacgtaatatgtaactgcattaaaaattaaatatttctctccaaatcaaaacaccacacaatcttatctgttctcatctagttaccttagaaacattgtcatatgctatcagg

SEQ ID NO: 525884 - DNA, 456 bp, Homo sapiens
tgatagcagcgtggtggctcatgcctgtaatcccagcactttgggagtcgaagtgggtggatcacctgaggtcaggagttctagaccagcctggccaacatggtgaaaccccgtctctgctggaaatacaaaaattagtcgggcatggttgcacatggctgtagtcccagctactcgggaggctgaggcaggagagtcgattgaacccgggaagcagaggttgcagtgagccgggatcatgccactgcactccagcctggatgacagagcgagcctccatctcaaaaaaaaaaaaaaaaaaagtaacaaaattatttcgggacatctatttcccaaaattccgggtcccaacactctgggacgctgaatgcgtgtgggaatgaggatgggggaaggcagggcagggtagcagggaacagagactgtgagaatgtgaggctggcctacagcacatgg

SEQ ID NO: 525885 - DNA, 298 bp, Homo sapiens
tgaaacgtccctggtgccaaaaaaggttggggaccattgaggcagataacatctatttttttattgattgactgattgagacagagttttcctcttgttgcccaagatgcagtgtagtgacacaatctctgctcactgcaacctccacttcctgggttcaagtgattttcctgtcttagcctcccaagtagctgggattacaggcgcacaccaccacgcctggctaatctttgtatttttagtagagatgaggtttcaccatgttagcggggctggtctcgaacttctgacctagggt

SEQ ID NO: 525886 - DNA, 191 bp, Homo sapiens
aaggtgcagatagaatcgagctcggtaccataagagcaatgatctcacgccgaaattttcctacaaccaatcataatttgataggaaatttgctatcagaaaatctagcaaaaggtaaaactccattctcatctgtctgattagggttgccccagatttcatgagcatggtcactaatggccaccgccttt

SEQ ID NO: 525887 - DNA, 1017 bp, Homo sapiens
cacaaatgagttgccctctcttcaaagagaatggttgtgattgtgagaccccccgtctgtttctcccaacaaaagattttgtgacaaacccctcttctccccctcctcctcccccggaccacaccaatgtatcgtcttgtgttgttccacaagaggagctcttttttagaaaaatctttcctccttttcaccaaaatcatagatgattgtccctctttgaacatcacccccccggtgttttccaaagagattttctcgcggtgagataatcctcctcgtcttatcctctccccctgcgccgggggttttttccgccgcccaccaacaatgagtgttcccgcttttcgtcaccaacatgtgccgccacgcagttgtgtgggagctgccgctcttggtgggtgcgcaagaatactaccgcggggggtgtatcatctcgttctgcgttctttttcttcggtcgtgggggtttttagtaaaagacgacgcccccgctctcgggattggtgggaggaagcactctctttctttgtgtcggcccccccccaccgcggtggctcgtcccccctcctcggcggcgcgagagagagatatatagatgtgggatatctctcttcccccccgggcggacgaggggcccagcaccccatttccagctctctttaataaaatgagtggtcacaaccaacgatgtgttttctcccacccccccctctgtctagaagaaatcatcattaaaataagtgtttccccactcctatttttcttctcccctccatgatttttctgtttaaaaaatgataaaatttcattagaagaaccccacctcttttattttgttgaaatcatccttgtaatgattctctttttatgaaccacgacttttttttgataaaaacacctctgcgggacaaacccccgcgcaaatttcagcgcggggggggaaggaccccccccccccaaaattttttttaaattcccccctcccaatttgggccaaaaaaaaagtttttttttgta

SEQ ID NO: 525888 - DNA, 109 bp, Homo sapiens
taaagtgttctaaatgcaataatgaaaatgaattttaattgataaaattaaatttaaaataaaattatttagaagtaaataattacttctaaagtaagtaatctctaca

SEQ ID NO: 525889 - DNA, 488 bp, Homo sapiens
atacgacgtacgtaggaggcaggaggcagggaggagacagcacagcccccaccacagtaactagcacacaatagaggcctgctagggagaagagaacatagaatagggaagctaacagaagtattgaaggacagaagaacaggaaaatagggcaggagaggaccggacaggcccggacgagcaggtctgaacttagcaaggtaacataaaggtaccacggttcctagagggactagaacgcacagagccgagaacgtacccggagatagggtaccacgaagggagtatactcatagcacaaccgcagctcggaatattcagcccacacacataccacctagaaaactctagtagtaatcaaggcccctaataggcctaccatagcatcctactagcccgctaccatgagtacgaaggcataaatctaaacacgatagtacacatacgatgaccggaccatactcctacaaacttaggtcgaagctccc

SEQ ID NO: 525890 - DNA, 100 bp, Homo sapiens
atctggaggatcccctccataaggtgtgcccagtgttatgtatgtgaaactttgattttagtttacgtgggggtgtgtatttggcgccgtcgcctacgca

SEQ ID NO: 525891 - DNA, 692 bp, Homo sapiens
  misc_feature (20)..(20): n is a, c, g, or t
  misc_feature (23)..(23): n is a, c, g, or t
  misc_feature (498)..(498): n is a, c, g, or t
  misc_feature (583)..(583): n is a, c, g, or t
  misc_feature (632)..(632): n is a, c, g, or t
  misc_feature (690)..(692): n is a, c, g, or t
ctctgttatacttagggganctntataatcagacacattgatacctaagatacttataaaagcacaataattcacattgaaatccagattatagatatccaggtatatgctttcctctattagtaaagatcagcaactgtatcagttgaagacatacataccagtgccaatcttgccgtggcaacactagtttaagaatacggtttctggggtaaactgctgggtttgagtctgattttatacatgcattacctgagtaaattacttgatatcttaacatagtatttataaacttgggaatttacctcatgtcttctagtataaaccttctcatctacaaaaatggagtaacgaaacaagttcaccaccccctactctaaatctatgggccagatatattacacaactcaaaattttttgaattttgtgaataccaaatatatatataacatcccaggtgaatatagggcagcaactcataatcatacacactaatgnttctgtagcaaaaaataaaaacaatgttgcagatgtaggatatatgacctttacatagcttcatctcacttagttcaggtttttnagccaaattagttgctataaatataggaaaccattttcaaacctttgantttcagaaatgaatatgatcatggatatatagcctacttgccctcgagacagcacatnnn

SEQ ID NO: 525892 - DNA, 754 bp, Homo sapiens
  misc_feature (645)..(645): n is a, c, g, or t
gggaataaagtgaggcaggaaaatgcttctccttgtaaaatcctctccactcctgacacatacacaccttttgaaacccttgcccaataatgtttctttatagacggacttcattgaaatctttgatgatcttgaatcaagtgtgatatcattaaaacattcttttttaaaatattcccactcagcactcatagactcaaaattactgtaagtctcaattaacagcagaatctcagagaaaagctgtttgcaatccaaatccagcctttggaggaatagagatggtcaattaacaatcgactagaggagattaacctatagctactttaccaacttgttgaatcagccttacttacacacacgcaaccaaccatttgttatagcatgactttgaaatgctgactgaaggtcttgatgcttgaacctttgacttgttaaatctaaattgcactccccagtgatttgcctcttacgttctttcttacaattgtcgaggatgactgtacattatagcgattttgaaaataacttgacaaccattgcaagttattttatgttggacgagatggcgcagatgtgttgtagaatggagatcactgtgtgaagttcctagctatttaagtgatgcatacctctagcttatgnatggctttttgagacctgaggtcattcccttgtgatcagagtgcacaagcacttctctgtgaatggctatgagaagatggcagaccgaccacttttcagatgcagctgg

SEQ ID NO: 525893 - DNA, 338 bp, Homo sapiens
aactcaattgattaggctacttactatgtggggagatacaacagtaaaaagacaaaaatctggccgggtgcagtggctcacacctgtaatcccagcactctgggaggccaaggtgggtggatcatgaggtccggagtttgagaccagcctggccaacatggtgaaacccatctctactaaaaataaaaaattagccgggcttggtggcgtactcctgtaatccagctactcaggaggctcagcaggaggagaatccttgaacccgggagcggaggttgcagtgagtcgagatcatgctactgcactccagctggggtgatagacagagactctgtctc

SEQ ID NO: 525894 - DNA, 4234 bp, Homo sapiens
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccggctcgggcgccggggcagccccgggcctctgcgaggcctgcggcgcggctcctagggaggaggtggcggctgtggcggccggaaccgcgaccttggccggacccagccccgcggtggacgcagggcggaggccgagccccgcaggagtctttgccgagccggaggaggcgcatctggcgcttcggtaccagcggcagccgggggtccggagcggctggaggagcgcagtggagaactgggaagagctagcccggctggagggcggacctctgcgtccgggagccggggtctcaaggcaccgctgggggcgaagcacggcgtcttttcgggcagccagtttcacacgcgcctgtgtgccggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggagagcgcggccccaccctaaagagggcgcacgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggggagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatatgacagaagctgggcatgattgggtggcaccgctggaatttcaaaaatgtcaaggaacagcaaatgtcaacaggatggaaaccagccctatctgagtcttcgctccctccttagtgttctttgctttgggtcatgtgcgtttcctagcttcaggccacttggtaactggaagaagctggaggacagaagcagtactcaacttgctgttattccagtgccctgtaacaaccactggtcctcctgcagatgacccttggtagagtctttatttgcatagcctcaaaataggttattcgttctaaacttggatggaattagagaatacaatcaaactttaccacttggaggacacggggttagtccaggaccaaagaggccaatggatttttcaaagtgtgccccagcacacagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggaggtgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataatttttttttttaaaaattatctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttag

SEQ ID NO: 525895 - DNA, 1058 bp, Homo sapiens
gcttcaaccatgccagccctcagtaggggacacagctgtgttcctccggtccagatttcaggtcgatgtgcagcggttgttgccgcagtcatgcccgcatcttcagccccaggcatgggtgggcggccgagcaatcagtctccctgacgtctggattcttgcagggggccgagttcctatgcgcatggtcgagaagaggacgctcccagagaatcctgacccgtggcatggatgccaagcaggcctaccgatggtgatggtggtgacatcccacatggatgctggtcaatgagtgtcatgctgagacattgagtgaccctggtgctcgtgctggggcctgagacgagcctgcgtttctgggcaactgcggacctgggattgagacagtcccgcctggaggagcgccgtcgtgcatcatcgagattccatgtcatcgagcaacatcacatgagcgacccaattggcaagccggcgggctgttgcgtgtggcatcgctgggcgctgccagaatgtcttttcccaccagctgccgcgcatgcctaaggagtatatcgcccgagctcgtctttgacccgaagcacaagactctggccttgatcaaggatgggcgggtcatcggtggcatctgcttccgcatgtttcccacccagggcttcacggagattgtcttactgtgctgtcacctcgaatgagcaggtcaagggttatgggacccacctgatgaaccagctgaaggagtatcacatcgagcacaaattctctacttcctcgactacgccgacgagtaacgccatcggtacttcaaacagcagggtttctccaaggcacatccaggtgcccaagaaaaccggtacctgggctacatcaacggactacgagggaagcgacgcttgatggagtttgtaagttgaatcgccggatcccgtaaacggagttgcccacattattaagaacgcgcaagggttcttcaaaagctgattgccgcaaaaggccaaaccgaggtctcccgggcccaatcttcaggaggtgagcagacccggaaagctcaggtcaaaaag

SEQ ID NO: 525896 - DNA, 939 bp, Homo sapiens
ataggtctaggtacgaggctgggtggcgcggagtaggcagcgcacaccagcctccagctcggccccgcccgccactccaccaacctcgggggccccgccagggtccgggcaggcccgactccgaccccgccgctgcagtcacctcggcccctcccggggcgccgcacccaccccgcaagcagcggggtccctaccacacacctcctcaggccggaggcccgccgctccgccgcgggaagtcccgggccctgggtccaggcctaagcagggcccagtgtcctgggtggtgtcccaaatggctgggcaaaatgcctgggcgggccgaagccaggtggccggcccgggcactcaagtacgcctggcaggcctaccccgaagccgcctgctatcgagcgcggctggtcgagccccgctgtgggtgccgccagcaccatccgcccttaccacctagcgagcatcaccaggggccccccggcccgggcgggcccggcggccgcagcgaggagtaagatctcggacctcggtaggggtttaagagcccatatttgtctcttcttgagggaggcctggcatcacgcaaaagttttcacgacagacgaatgctcggattgtaagggctcggggaagtctaccttgtctggatatcacggagggatgaatgtcaggcagacgtatttgctacaataatggagaaaccgagggagaacgttgttgatcgaccaaaaggcgaccgggagttcgcgagtttagtcaaaggcttgaggtctaccgagctattgggttggaacatgggcccagaaggccgagactgggttgatacacccattgagaggtacaccagcatccgagttcggcttagcgcataaatgcgtggtgccctttctgtccggaatcttcacccttatgttcccgtgacttgtggagaagccttagccattg

SEQ ID NO: 525897 - DNA, 88 bp, Homo sapiens
tataattatttttagcttaaaattaaacagattttaaaataatgtaactttgttaataggtgcaaaaacacaaatgcagtcaatttgg

SEQ ID NO: 525898 - DNA, 165 bp, Homo sapiens
tgatccacgatggggggggaggaccctggatagaggggaggaattgcgaccatttgtcgttgaggaggtccatacgagacattgcaaatgtgtggacatggagttaaattggatccccgttccacagccctcccgccctgagtgaatttcagaatcgctgtaaga

SEQ ID NO: 525899 - DNA, 423 bp, Homo sapiens
gaaaacgatccaacaatgacaatcgtaatacacccggatgactatttcatccttaggtgacagtcaataattagagtcaccctttctgaggccacatacctttcaatctaactgaggatcaggtgctgtactgtttctgcatcaaattcaagtcctagaggagagtctgaacacaagcatcattaaaccatgtgaaaggaccaacctctaagccaaaaactaggcaaattatatgaatcctcagaacaagaaatgagcccagagacctgtgtccccaaacatcctgtaaatctcatagtaaggcaggacaggataaccagaaaaaaacactgtccaactggtgatctggtttctggtctcaatggtaccaaagggatagtcactacctcaatcaaactgagatccaaaacagcagctgctttc

SEQ ID NO: 525900 - DNA, 294 bp, Homo sapiens
ggatttcactctgtgttacatcatcagtttgacacacaggttcatttgtaacacttagctatttgatatgttattttttggaattatcttttcaaaatttggatttctttatataatcatgtaaaatgtgtataaagttccagattcaaatcagcaaaacatgataaaatctatccagagaaggcaaaccttctgtccagtcgccatcctgttcctgcccttccccttatgagtaatcattacgagacaatcgtcggttagtccttacatgtgtatatcttagtacactcttgc

SEQ ID NO: 525901 - DNA, 1015 bp, Homo sapiens
cccgcaggctgcgccgcgtcaggagccgggactcggacgcgtgcctagagtcctggggagcttctgtccaccgtgtcctgcggaggagtctgtttccagcccggctgccccagtgatgggtgagttcaactgatgaagaaggaatcatacagtgtggcaccgctttgcctcatacgtacctgctgttataccgtatcaattgtgctgcttcttggcgtggcatggacccatggcatgtcatgagcacgtgaggcactcttggactgctggccctcaagagtgtacttaccgtcagcctgctggcctcaggcacctacctggaccacagcctacatccctgggtggtggtcggcgctactgtcgtcactggtggagctggggtcttgggctgctgtgccaccttcaacggagcgtcgtgccctgctgcgcctggctcacgagggcgcacgggccactggtgtggcgcggtagggtagcaagcagtgtgggcccagagggcaacggtgtggtcagcctcgactcgtggctgttggaactcgtggtgtccttgacttgttgcatctactcttggtgggggagtggtcaacggatcgcattcactagctgtcggtgcgcttaggtcctggttgggtccgccaacggttctctcgtctggatccagctggaatggggaagaacaggccatttcttcccgctccgaaaggtctctcaaggagagggcttgaggccggtgacctccagacgtcctcaccttggaagttgctcttggcgagtcctgctgtgctgggggaactctgcctcttgatgtggttgcactatggttcttagggcaccataagtccgtcaggatctaaagggggtggcccctttggggcttggccccacccccaaaatacgttccatcccgtggctcccgtgacccattctttcggtgcttggagaatcagtcggtagggaattcgtcgccttagccctacttacttggagactgacacgcgggagctcctggagaacc

SEQ ID NO: 525902 - DNA, 1113 bp, Homo sapiens
agcggggtgggtgagtcccgtgccggagtgcaggccgggactctggtgggtctaggcgcgtgatctggacccaagcaggctctggctggctggcgtgccaggagagctggccgggcgtcagctcctcgacccccgtgtcgggctagtccagcgaggctggacggtgtgctggcgtgctgcccatggtccagagcccaggcatagagacgacatgagtgagacgcgaacagggcatggcagctaggtagacacgaggggcactcggagaggagcattcggccgacgagccggtaggccccagggaccccatgggtcaaagacaagggaacttgcaacgagataggtagcgagcatgaggccccaacacacttgcgggagcaaacccattccgatggaaccattggcacatgacagcaaccggtacagcagttgccaagggccttaccaccgatggaaaccaaccgcatacgccccctaacagccattgttgcaccctaagttcaacaactggaagccgacgcggacatatcccatcttccaacctggtgtcatccaagggcaaattcccagattagcgtcaaagacacacagagccgagaagatcacgacccacttcctcgcaagtcatacaaagctagccgtcggaattttggagcaccgcaggttccccttgaaccaaagccccattggccgaatacaaggggaaaggcacccaaatgcaggactctagagaacaaacgaccacgttcagttacaaaaataggttcgaacaccgggacgcacatgggccaccctacccagacagattcctatgcacaaaacaaggcgaaaacgagacttaacacaacaccttcccgaagtgacaacagaagaccgcgcaactcagcatgggaaccaaaactgaggccacacaacgttcacatatcagcagtttaacagcgatcagacccaatggatacatagcagcccaaaccaagaagcgtaggatcaaccacacccatgacgacagatggagcaaacagcaagatatagccttaaattagtcgtgccacacccaacaccggtagttgacccagctcaatacctagtcccgttaaccacgtaatcgggtac

SEQ ID NO: 525903 - DNA, 151 bp, Homo sapiens
cactgtttaacttgaccctgatgaaaatgtgagcactgttagcagatgcctatgggagaggaaaagcgtatctggaaatgttcccagctactttggaagaaatgagatccctgcatccccagtgttatttggcttggttaaccaagggata

SEQ ID NO: 525904 - DNA, 875 bp, Homo sapiens
  misc_feature (523)..(523): n is a, c, g, or t
gggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactgcccccatgattcaattacctccccctggtctgtcccacaacacgtggaattctgggagatacaattcaagtgagattggtggggggacacaaccaaaccatatcagcatcctttcaagaatattagataatgggagctgagtactcaggaacttgaccgtagtagaatactgctagtttcttaattttaattcaccatcacctgaaagtaaaacaacaggtttgccaggtggatgctnttcagtacccgtgacggggcggtggagtccccaatgtttgctccggtgggtccaatactctcaaggcaaacaatggggccgaatttggtgaagaggtccccgggggacaaaaaagatacatgggccggcgacgcggagagttattaaggcagttcaagccccagattaaaggtcgtcaccacccagagtcgggtctctgggggccaccccaggaagaatggtccccgctgggaaggaccaacggggggaacgccgctagtaaaacagacagcagacataggaggttgccccgacgaacgagggccagccgagacctaccccccagctcggacgagcagcggggccaaaatat

SEQ ID NO: 525905 - DNA, 732 bp, Homo sapiens
ggcgggacgggcgcgttacgggctggccgaggaggaggcggcggcgatggagcatgcctcctgccggacgggccgggccgggccgagccccgaggacgctgcggcgacgcctggatcctgcctccgccaggccggactgccttggtgccccgaggaggctgcatgagccccatggccatggtcccctctcgcagagacgtggaacctgggagccacgcccatcgctgcggcggcctgtggagagatgggccagggaccccgagagacccgagccggggatggctcgaccccgaaacccgagagcacccagggccaagaccacggacacgccacacgacaccatagtgtccacaccgacataccagcgcccacgagaggaacgagatatgagacaacatggacgtcaatgaagaacacaagaaatcaccccaccaaaataatgcacgagatgcaccagcacgaggcagcattacacaacgaaatgaacccacagggaagaggaatgcaccacaaccttccgcacctcgctacgtctccacccacttcacacaatcaaccatagccacccctcacagcacctccccttctaacaccagccttggccaaccatacgggatgtacacttgcgaacacccaacaggacgaaaaaagacaactcaccccaactcatctcgaccattcccctatcaacaattacaacccccaatgaaccctacaaggcataaacaacac

SEQ ID NO: 525906 - DNA, 103 bp, Homo sapiens
ggcgtggtgctgaatgccttgtctcccctccctccccttcaccctgtttccttcttaatccctgacagtgtgaggtgaccctgaggctgcctcaatgtaaaca

SEQ ID NO: 525907 - DNA, 154 bp, Homo sapiens
ggctcaagaatttttctgtttgtcagggaaaaggaaaaggggaaaattaaaccatttccgtttagttttgtaaagtcaggaatttttcaaaaaaattaaaaaatgggctggagctttttttttgtgaaaaaaaactggaagccccagtgattca

SEQ ID NO: 525908 - DNA, 1878 bp, Homo sapiens
ttctaatgcagcctgaactccaaagtccatgggcaggtctgtactgatgtagcttctgtggtaaatcctgcatccttccgttgggatggagggtcctcacgtagaggttggggcctgcaaaggggcacagggaagctgcagggacctctgtgcctaccctccatgctgagtccattctcatagccagggtgatgtgtttacagcctagatatgattcctcactaccctgttccatggttcacccccacccctggggctacgtatggcagctgaacactggaagtcctggccagggcctgtggagtcctgtggggcctggttctctctggctctgctctgctctcttgtcttcattgcacctgcagcctcgctgatctccttgccgttctgcagatgttgaatcccttcagtgtcagggctgtgtgcctgtggttctttctctctgcctgggacatcttgtctccagctgtctgtagggctctttctctcacctccttcaggtctcccactctgtgagccttctctcaccattctgtccaaaatagcagccctagctctacccctttgttgcattctgtccttatccgggatggcattcattgctacctgacaccatcctgcatagctacttgtctgttgatttgttgtctgactcctccaattagaactaaagtgctgtgcagggtgggagtggagtgtacccatcgccagcccctgggcagcacctgctcactgtctgtgctcaaatgcaagtacagagagtctcccacttagcgtggttcaacttaagatggtgtaaaagccagatacattctgtagaaactgtactttcagtacccatactgtcactctgtttttcactttcagtccagtagtcaataaattatatgagctatttaatacttaattataaaataggctttgtgttagatgacttttttcccaaccataggctaatgtaaatgttctgagcacgattaaggtaggctaggctacactacgatgtttggtaggttaggtgtattaaatgcatttttgacttatgacatttttaactcatgatgggtttattgggatgtaacctgattgtaagtcgaggagcacctgtatcactcaccatccatttggttcctatgtccacagggccagagagtgtcaggagtttccatgttttccaaattgatttggcttctgaattgcagttagcatacagtaggataaccgcaagggagctatctgaaaatccagatctgctcagttcttgaatttgggtagtgagagttcaagttgggagagtttgagaatttggggaatgagggaaacttctatttgtcaataagagagggaaggtatagtaagacaaatgtaattgcagagctcctagggccattgagtctgaggggacaggagtgggtgtcactgcagctgcccagggctccctgttgccagtttctgttatctggggtgatgacagcagcatctggattcatcactaaagggaccctctgctttagagtacatcgtttaagaaggaaaggaagtaggtaagacccgtttattccgtctcccattgttaaaatacttctgcacttaaaagcagaatctgtgggccgggtgccatggctcacgcctgtaatcccagcactttgggaggctgaggcaggtggatcacgaggtcaggagatccataccatcctgactaacacggtgaaaccccatctctactaaaaatataaaaaaattagccgggcatggtggcacgcacctgtagtcccaggtactcgggaggctgaggcaggagaatcgcttgaacccaggaggcggaggttgcaatgcaccactgcactccagcctgggtgacagagcatgactccgtct

SEQ ID NO: 525909 - DNA, 949 bp, Homo sapiens
  misc_feature (43)..(43): n is a, c, g, or t
  misc_feature (118)..(118): n is a, c, g, or t
  misc_feature (121)..(121): n is a, c, g, or t
  misc_feature (150)..(150): n is a, c, g, or t
  misc_feature (169)..(170): n is a, c, g, or t
  misc_feature (186)..(186): n is a, c, g, or t
  misc_feature (211)..(211): n is a, c, g, or t
  misc_feature (216)..(216): n is a, c, g, or t
  misc_feature (219)..(219): n is a, c, g, or t
  misc_feature (230)..(230): n is a, c, g, or t
  misc_feature (239)..(239): n is a, c, g, or t
  misc_feature (241)..(241): n is a, c, g, or t
  misc_feature (258)..(259): n is a, c, g, or t
  misc_feature (264)..(265): n is a, c, g, or t
  misc_feature (267)..(268): n is a, c, g, or t
  misc_feature (270)..(270): n is a, c, g, or t
  misc_feature (275)..(275): n is a, c, g, or t
  misc_feature (277)..(277): n is a, c, g, or t
  misc_feature (279)..(280): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (303)..(303): n is a, c, g, or t
  misc_feature (305)..(305): n is a, c, g, or t
  misc_feature (308)..(308): n is a, c, g, or t
  misc_feature (310)..(310): n is a, c, g, or t
  misc_feature (319)..(319): n is a, c, g, or t
  misc_feature (332)..(336): n is a, c, g, or t
  misc_feature (360)..(360): n is a, c, g, or t
  misc_feature (364)..(365): n is a, c, g, or t
  misc_feature (376)..(376): n is a, c, g, or t
  misc_feature (392)..(392): n is a, c, g, or t
  misc_feature (418)..(420): n is a, c, g, or t
  misc_feature (422)..(422): n is a, c, g, or t
  misc_feature (424)..(424): n is a, c, g, or t
  misc_feature (430)..(430): n is a, c, g, or t
  misc_feature (440)..(440): n is a, c, g, or t
  misc_feature (494)..(494): n is a, c, g, or t
  misc_feature (498)..(498): n is a, c, g, or t
  misc_feature (544)..(544): n is a, c, g, or t
  misc_feature (559)..(559): n is a, c, g, or t
  misc_feature (693)..(693): n is a, c, g, or t
  misc_feature (723)..(723): n is a, c, g, or t
  misc_feature (763)..(763): n is a, c, g, or t
  misc_feature (798)..(798): n is a, c, g, or t
  misc_feature (881)..(881): n is a, c, g, or t
  misc_feature (948)..(948): n is a, c, g, or t
aaatacttccaatccccaacataccctttctggtgtaggggangggagggagctccccaccccaatagcaccaggatagcaccatgagaaagatgaggtcacacccggcctccctganacncacggggggtggtgaggggaacatgcctncagacaccccccaaccttnnccccaccgcagacagntgcagagctgagagcgaacccagtnccctngtnagggcagtttntggggagtncnaccccctacattagttnnacctnntnntnaggcntntnntttttgggagatncngtngggtngnccntnctccttatngttttttttcctnnnnnggaaggggtttaggggggtggatngttnntttagtttttntgtttgggcaggggtngggagggcagcaaatggccggggctnnntntnggagtnggggtggttnaggggttagcagttacaaagggttagggcttagatttttgggggtgttcaaacnaacnccattttagggttagagctatgttggagttaagggttatttccctnccagaggtctaaggnctctttctggaggtttgggtagcagctaggagagagaccctctctccctgctgggcctccccgtccggcctgtcacagctcttcaccgccgacatccaggtcgatggagccgtggctgaccaccagccgtaggngttgggtggggagaagggggcgaaggcganggcctgcttcgggatcaggatggggcctggggtccagcangggctggggtagctggtggggctggggcaggcgangaggtccacacgcacacgtaaggcagccatagcgccggcccagtgccagtctgctgaggggccagcggcgtgggggggctggnccagggcaccagggctctcctcgcaggcggagtgggggcacagctcccatcgtgcaggagacccggna

SEQ ID NO: 525910 - DNA, 298 bp, Homo sapiens
tatggagagatgaaagataaataaataattcacacaataacagcggagggtgcaatatcacactttcaatactggatataaaccaagcagaagattactaagaaaatacaagaatttttatcagcttaaggagctttggggccacaactatggggttttctggatataaaatcgtgttgtctgcaaacagagacagactgacttcctctcttcctattttgatgcctgatatttctttctcctgactgattgctctgggtaggatgtccaatactaagttggtagtgaggttccatcg

SEQ ID NO: 525911 - DNA, 149 bp, Homo sapiens
tcggtcctaaaacaaaaaattagcagtagcacacctgttactccagttactcaggaggctgaggcaggaggaggctaagcccaggaggttgaggctggagtgacctgtgatcatgtcactgcactgtgcctgagagacaaagggaaaca

SEQ ID NO: 525912 - DNA, 220 bp, Homo sapiens
cggtagctatccggtataggcgtttgccccgcctattaatgaaatatagatttttgttatttcactcccttctctcctctcctgctcgcgtctgcttagaggtggccggcgcagaggcagattggcaagattgcatcccttggcagggtgctactacccccatggtgcatccgttgcacttccatctatctccttcccataagcagtgcctcctctgtct

SEQ ID NO: 525913 - DNA, 401 bp, Homo sapiens
aggagctgactccactgggttgaggaaaacaagctaggatccactgattctacataatgggggagtggtataattatttcattacatatacaatgtaataataatagaaataacttcaacatacaataactatttctaattaaaaggtctatcacagccgggcgcggtggctcacgcctgtaatcccagcacttggggaggctgaggcgggcggatcacgaggtcaggagatcgagaccatcccggctaaaagggtgaaaccccgtctctactaacaatacaaataatgagccgggtgtggtggtgcatggctgcaatcccagccactggggaggctgagacaggagaatctctcggacccgggaggcggaggtggccgcgagccgagacgatgccactgc

SEQ ID NO: 525914 - DNA, 104 bp, Homo sapiens
  misc_feature (92)..(92): n is a, c, g, or t
actaagacgtaggacgcgcctcgtcgctcttctccgggagccagtcgcgcagcgccgccgcccaggccatcgccaccctccgcagccatgtncaccaggtccgt

SEQ ID NO: 525915 - DNA, 82 bp, Homo sapiens
aacagtgttctttgttatatggcttgaatgagatagagcccttacctattattcctttggacacggttatagattttggatc

SEQ ID NO: 525916 - DNA, 398 bp, Homo sapiens
actagcttcactgtgtctagctccaaggctttacaaactgtctctacgcttaggtctcacattcacatctccagcctggacctctcaactcacacatgtaattatgtaagacacatcaggtatctcaaacttaacatggctcaaatataaaactattgattccattccctccacaagaaaatattcactctcccactagccttccccatttctacaaatggtaatacattctaccagttattattattactattattttgagatgaagtctcactcttgttgcccacgctggagtgcaatggcgcgatcctggctaactgcaacctctgcctcccggatccaagcatttctcctgcctcagcctcccaagtagccgggaccacaggcgcctgccacca

SEQ ID NO: 525917 - DNA, 246 bp, Homo sapiens
acgtggcatcttgggaatctgacggatcggaggcatttgtgaggaggcgcgatcagtagcgggggaagagtcttagacctggcagtcctcagggtgagggccctgaggaagaactgaggacctcccaccatagagagaagaaaccccggcctgtacttgcgctgccgtgagacttgtgctccaggaaccaggtggtgacgaactgggtgtaggggggggtgtggtggggggggtgggtggggggtg

SEQ ID NO: 525918 - DNA, 624 bp, Homo sapiens
  misc_feature (438)..(438): n is a, c, g, or t
  misc_feature (624)..(624): n is a, c, g, or t
ctggtatcccttcctcttttaataagggcactaatcccaccaagggctccatcctcataatctcgctaaacctaattacttccccaaagcctcacctcctaataccatcacatgggggattagggcttctttaactttttaacttttaagttcagaagtacatgtgcaagtttcttatgtaggtaaacttgtgttgtggggtttgttgtacagattatttcattacacactcttaagcccagtacccattcgttattcttcctgatcctctttctctaccctccaataggccccagtgtctcttgttcccctctatgtgtccatgcgttctcatcatttagctcacacttgtaagtgagaacatgtggtatctagatttctgttccttcattagtttgttaaggataatagcctccagctccatccatgttcctgcanaggacatgatctcattcttttttatggctgcataagactccatggtgtatgtaccatattttattttctaccaatgatgggcatttagggtgatttcaagtatttgctatggcgaagaatgctgcagtgaacatacatgtgaatatatccttatgaatgaacgaattgtccctttgggatatcccn

SEQ ID NO: 525919 - DNA, 463 bp, Homo sapiens
agcaacgctcacgacccgcccgggcgactacgataaagggaaaaacattaagcaaggcatacagaaagcacggaaggaactgattagggggcatgggtaacggggctgtgaaaagggacctgggatagaaaaaagtgacaaacacggcaaaaagaaaaaagcagggtgcgttgatgcggcgcggtggaccagtgcgctgccccatgctgcgaccgaaaacagggctgatggtaacagggagaaaatggcaaagaagctacagacctataccaaatacaatttacaattgggacaagggcatagtacaacagaataggggctgcttgaccgtacggacagctacacaattcgaggggtaagtgtggggctgcctgcacccttgaggaaactggtgttacgaatgtgctgaggaaaacatgtgggtacgggcacaattatggaagagcagaccagcggttcgtac

SEQ ID NO: 525920 - DNA, 432 bp, Homo sapiens
gcactttgaaacttgttcacctctgatgcagggggaagttgttatttgattaagtatcaaggcccactactgtaatttaatgctttgctggttcacagtatgcctcaatctatgcgcaataggaagacaggacgcaccggttggaaccagaccgaccatgcattattcccctcgttcagactgtcataaataaaaaaaacagctctcttgagtgagcgcatctccttatgtctgcagacgcgctgtttgttactgatgaactggcatggcaaacttgtggtgccgcctgcgctctgaggatgtggagccttactgtaatccgcggtgcgtttgtaccttagtgctttaagactaaaccccctggttttgcaggaaatatgaggaataaaaaagggactcattttgagtgtgttgagcccatcttggcagttt

SEQ ID NO: 525921 - DNA, 112 bp, Homo sapiens
aaggtttggattgaggggtaaactcatcgtaaccactggcgcatgttgcatgctactctctgccgaccatgccgccgcccgtccctcatgactacagccagggaatgaggct

SEQ ID NO: 525922 - DNA, 890 bp, Homo sapiens
  misc_feature (835)..(835): n is a, c, g, or t
  misc_feature (876)..(876): n is a, c, g, or t
ggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacggtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtggggaggagctggatggattggaccccaacaggtttaaccccaagaccttcttcatactgcatgatatcaacagtgatggtgtcntggatgagcaggagctggaggcactcttcaccaaggagctngagaaagtgtacga

SEQ ID NO: 525923 - DNA, 930 bp, Homo sapiens
ggtccttgcccgccctggaaaacgccctctgcggtgaaggagagaccacactgccatgcctccctctgggccccgaggaaccctccttctgttgccgctgctgctgctgctcctgcttcgcatccactcagaggaaggagtttggggacaccggggagggctgggagacagtggacgatgcacgcctgtccctacatcctgatgtgaagacgctgaggctgctttgaacgagcgatgcttggcctgccctgtggcagcgcacgacgctcgaactagcccaatgtgccccatgctgccatcatgaccatgtgatgaccatgatgtgctcctcagtgcgctgtgatccacatgtgggcctgccctgccatgtgctccaagacacgacgaagatgctagcatgcaggctcgtgctagcacactggatgcagctgcgaatgcatgcagccagcagccagcaagcaaggccacaaggccccgagcttgcccacccatgaggggcagctcaagttccacaccagacacagacgatgtaccctgtcccagctccagccggtgaccagaaggaggtggacacttcagaaaagaaacttctcgagcggctccctgaggttcgcggtgccccagcatctgtgatcctccgggaacccagccctcaggacttcctgatgctccacggcgacctgatgggcgctggactgacgtggcacagtcagcttccctgggggccggtgtcctgttgggctcctggggcgagggcacggcatggcatctcacgcattggctgcacccagatcacctgactcaattacacagcatcaagtctgtggtctaccttctgtctccgagggcttgctccacgtgtcagtgagggcccaggatgagtaactataaagcgcacttccattcgctgccaaggttgcctacacgtcc

SEQ ID NO: 525924 - DNA, 1071 bp, Homo sapiens
  misc_feature (711)..(711): n is a, c, g, or t
ggggttcccagtctctccctgatcagactcgcctatcggtagtcgtctgtcctccttactgcacggcagggcgaaccagacgacgaatgtccgaatatgcagacacaagactagacgggggctctaagcttctagggacttcctgacgtgtactccaccctaggggctactaatcccagccagatgagaggctgaatatctgggaaggtacgtagacgcgacacggcacgcttctcattactaaatcagccgtgatggtagtgcggcacagtggccttagtgggagtagcgcactgtcgagtagccacatatgtcccataggacacgtccaggaggtgccgtgtgtcttactgtcacgccatccaatgctctattccatgttccaaaggagcatcactatacagaaagataaatggtacagaccgtacatatccttggttggagcatagcattgggacttgcatcatcgtgatgcatgcaccgatgcatggattgtagcgcatgtgacacaacgtctacgtggctctctggtcttgtacctccggaaacagtcatctggtgttgcactcgtttagcactcgaccaccctgtaggtgcaatgtattccccatccaaggggctaggttcttgaggcttggctttcaaattcctgatgggatgcgtaaaatacattctgggtccaccttgaggattacgactaggtttccttgntccagggcaatcgaaggataaaacggctcgaatgattggttgctcctcacaaggttagcaacgccatctgaattggtccgcccgtgaaactttgtcggttggtaatggagtgaggtacgtaagttatgaccgtttactgagacggtgcttcttacctagtgttggtgttgatttaaagtgttacgaaggtaagggatcaggggaatggggaagtggggggagaggtactggagattcattggtgacccataatccgtgggcagaagcgggtttggaggggcagtgttgggagactagaggcctagattggggaccggtttcgggttgaggcagggaggtcaaaatggttttttttaaaag

SEQ ID NO: 525925 - DNA, 864 bp, Homo sapiens
ccggttgctgcgtgtcgtgcccgagtgtttgtgttcggggccgccccgcctgtttgttggcgagcactggggtggcgccccacgtggtgtcgtgggttgccgcctcgttttcgcttgtgcttctgcgtcggggaaacgtgtgttgagcgaccgtgttctcgcgccgagcccatttgtggtctggttgggagtcgccctcgcccgccccgggttcagtccgccgtaatgttggcgtcgggtgagcggctcctccttgtctacgggagcccacgtcgtgtatgtgcgcgagggatagattatcggtgggtacacgacacggtactcttgcccccggcgagcccccgctaattggtgtccgcgccttcacgttagggatagcgtagccgcgcgctctaagaggaggcgcgttttacgttatatgcaggtagggggcaggaatcttgcgccgattgtgggtgcaccaccaggatcgcgtgcggtgacacacctctgctttgctgtagacaccgcctgtggtggtaggcccacacacatggatttgtgttgtctctgctttggggccaggcatatgtgtgcagcgccttgctgctctctttattgtcagggcatgcgtcttggtggccaaccacacaaccatataaagcacacctcttattagtacgcacaccacactccacagtagtgagtaattctactttacgccattcatatgagtttctgcgccgccatcattggtccccacacattttcataatagaatgcttttgttccgtgcacttatagaatgacacataaattgcatttctcttgtccaccgcggtttttctcatcaacgatattgaataacagccccgcccacatgac

SEQ ID NO: 525926 - DNA, 305 bp, Homo sapiens
  misc_feature (249)..(249): n is a, c, g, or t
caggtcggacatggcatggtgtggatggttgcccaacaatgtgaatggattggtgctctgaacttcacacttaaaaatggtaaatttttgcctgatgcagtggctcacacttgtaatcctagcactttgggaggctaaagtgcatggatcacctgaggtcaggagtttgagaccagcctggccaacatggcaaaatcccatctgtaccaaaaatgcaaaaattagccaggcgttggggcacatgccttntactcccagctacttgggaggctgaggcaggagagtcacttgaacccgggaggcgc

SEQ ID NO: 525927 - DNA, 775 bp, Homo sapiens
  misc_feature (7)..(7): n is a, c, g, or t
  misc_feature (65)..(65): n is a, c, g, or t
  misc_feature (68)..(68): n is a, c, g, or t
  misc_feature (103)..(103): n is a, c, g, or t
  misc_feature (134)..(134): n is a, c, g, or t
  misc_feature (151)..(151): n is a, c, g, or t
  misc_feature (154)..(154): n is a, c, g, or t
  misc_feature (173)..(173): n is a, c, g, or t
  misc_feature (204)..(204): n is a, c, g, or t
  misc_feature (216)..(216): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (246)..(247): n is a, c, g, or t
  misc_feature (260)..(260): n is a, c, g, or t
  misc_feature (264)..(264): n is a, c, g, or t
  misc_feature (266)..(266): n is a, c, g, or t
  misc_feature (268)..(268): n is a, c, g, or t
  misc_feature (274)..(274): n is a, c, g, or t
  misc_feature (276)..(276): n is a, c, g, or t
  misc_feature (281)..(281): n is a, c, g, or t
  misc_feature (283)..(283): n is a, c, g, or t
  misc_feature (292)..(292): n is a, c, g, or t
  misc_feature (300)..(301): n is a, c, g, or t
  misc_feature (321)..(321): n is a, c, g, or t
  misc_feature (327)..(327): n is a, c, g, or t
  misc_feature (329)..(329): n is a, c, g, or t
  misc_feature (332)..(333): n is a, c, g, or t
  misc_feature (346)..(346): n is a, c, g, or t
  misc_feature (355)..(355): n is a, c, g, or t
  misc_feature (392)..(392): n is a, c, g, or t
  misc_feature (406)..(406): n is a, c, g, or t
  misc_feature (414)..(414): n is a, c, g, or t
  misc_feature (423)..(423): n is a, c, g, or t
  misc_feature (433)..(433): n is a, c, g, or t
  misc_feature (460)..(464): n is a, c, g, or t
  misc_feature (468)..(468): n is a, c, g, or t
  misc_feature (471)..(473): n is a, c, g, or t
  misc_feature (475)..(475): n is a, c, g, or t
  misc_feature (492)..(492): n is a, c, g, or t
  misc_feature (495)..(495): n is a, c, g, or t
  misc_feature (499)..(499): n is a, c, g, or t
  misc_feature (501)..(501): n is a, c, g, or t
  misc_feature (506)..(506): n is a, c, g, or t
  misc_feature (513)..(513): n is a, c, g, or t
  misc_feature (522)..(522): n is a, c, g, or t
  misc_feature (524)..(524): n is a, c, g, or t
  misc_feature (534)..(534): n is a, c, g, or t
  misc_feature (546)..(546): n is a, c, g, or t
  misc_feature (555)..(555): n is a, c, g, or t
  misc_feature (566)..(566): n is a, c, g, or t
  misc_feature (577)..(577): n is a, c, g, or t
  misc_feature (583)..(583): n is a, c, g, or t
  misc_feature (648)..(648): n is a, c, g, or t
  misc_feature (660)..(661): n is a, c, g, or t
  misc_feature (770)..(770): n is a, c, g, or t
cccaccnccccccccccccccccccacccaccccccccccccccccccccccgccccgccccccngcncctcccgtccgtccctccccccccgaccccgaccngaacccccccccccccgtcttcccagagggnccctcccatgcctgccngcngccccgggccgcccctgcntgcctccgggccccccgccggcgtcctcccngggcgcccgccnggnccgccngtngcccggccgtcgggcctnncccccccccccgncccngncntccccngnctgcntncccctcccngccccggnntccgccccttgtggcaaccngccccncnccnnctagaccgtcgtnccgcccccngccgccgccctcccccgtccacccctcctcccgctgnctacaatccttccncttctagnaaacttagnagtacaaganatagctctactacgggtgactgatttnnnnntttnccnnncnccctttcccctaccccngcncgtngncctcngagaganccgggtatncntttccatctnggttcagaggcnatatgaggnggttggggggntggcaggggcntcctcngggttggggggcaggccaagggatgagatggcaaaggacagctttggaatcagatagacgatccngcgtgccttccnncccttgcctgaggtgccagtgaattcgaagagggccgggactcaccattgttttcttttcctaaaccttttgtataggcctgtttgatgtgtcttatgaaacgaaacanatctg

SEQ ID NO: 525928 - DNA, 2080 bp, Homo sapiens
  misc_feature (835)..(835): n is a, c, g, or t
  misc_feature (1215)..(1215): n is a, c, g, or t
tctcccctccccccctttaccatttcccctgggaggcgcttaccccgggcaggggcagagcgggtctacacccgccgcgactctccacgcggccccacgtacgtccagcgggcagaaacggagagacccaacacacacagcggggcctccgcaagcgagcgcgggcccaccagcgccagcagaagcacagcacagcggaactcagtccgcatgccgcgcggaacacataaagggaggagcgcggtaggacgcgagcatcctcgcgccctacgaaagggacaaaggcggccagaggccgccgtagaacggcccggccgaataccgagacgagcacaccacttaatcatcacaatccaaggagacgggaggcccgatgtgatcgcccccagcaggcgcaacgcgagcgcatcacgcagcacaccggaccgaaacaccagagagaggcgcaaacgagagggaccccccacgagactgcaacacaggagagaatggcacaaccgggagtgcagagcccccaaacagcaccctcgaccgcgagaaggacaagagcagtatgaagcgacaacaggcgccagccgacggaacagaggaaccacgacgaacacgagaaaaaccaaggaacagacacaacacgaccacgatcaacgaccgcagacacacgggcccctgtggaaaaacccggcccgaaacgcgggcgacccccgtgcgagcgacagcagcgagctaccacagcacgggaacacacacagagtgcagcacagcagcaccagtcgccgccaacgcgcgcgcccacgacccacacgcaccctgacgagtgcaacgagcagctgcacanatccagcggccggacgatacacacgaagatagcatcttcagcctaaccccatgcagcacgctgcgcacccaccagcacgcgaaagctataggtcatagctccgacgagagcacatcgtcggagtggacagcaactaccccatctgatccatcccgtcgagatccacatcgcccacccactagcacctgacaaagaatgtcagctagcaccacacccattggctctgccatgtgtttgctcgtctcttgtttgccacacgcagaagcacggaactacagcacacatcgcaccaccagccacacacgccacccatgcacgtcgctcccaaacaacgcctaactgaccgacacacaccagacaaccagcacgcgcgagacaancacacaaccaacaaccacggcccaaccaactgcagccagcagcatcagactctaacacgaggtaccagagctgatacacgcgccagagcagctgacgcacagaagcggccgcagcatgcgcagcgtacacggcacgaaaagccaccaggagcgctggcgcgtgcactcgggactagcgagcgaaagcaggcagcgaggacccggcgcaagcggcacccgaccgtgggccacaacaacgtgcccagcgagacaggcaagccaggaaccgacgcggcaagcgcgcaggagagcaaagccaggacaacaggcagcagaagaagagacatgggcacaagactagcagcgagcgtcgggagccggcacagcgatagtgacgcacgcagaagcgcacagagaaggggcaatgaggcagagaagcacagaccgaagcagcgacacgcacgcagcaccgcgcgaggacgaagaagccggaggacatgccacgacacgacagacacagcgacacgacacgaagcaagagagaggacggaagaaacatcaccggcgagacgacggggcgcggcggcgacgcgtgggagagacgaggagtagctatggggcgggacgacaggacgagcaaggctaagagacagggagtgatagacagagacgacgatcacagacgagaaagcggagagcgagccaagcacgagagcgaatagcgcaggaaggcgacggagagaacgaaaggccgagaagcgagggcgcgctcaggagcgcgaaccgcaggcgcagcaggccgagttagtcagagcgggagacgacaggacatacaggcgcagagtgaagacctcacccagccgatcatcgagccggcaccgatgcc

SEQ ID NO: 525929 - DNA, 939 bp, Homo sapiens
  misc_feature (225)..(225): n is a, c, g, or t
  misc_feature (235)..(235): n is a, c, g, or t
  misc_feature (241)..(241): n is a, c, g, or t
  misc_feature (262)..(262): n is a, c, g, or t
  misc_feature (286)..(286): n is a, c, g, or t
  misc_feature (290)..(290): n is a, c, g, or t
  misc_feature (382)..(382): n is a, c, g, or t
tatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcnctccccgganacgccncgagcgcactgcgaaacgccncgtgcccgcgcgcactcctcttcntccncaggcccatccgcctccggcccctgtgcctcttgtcggcccaggccagctccgcaggtccgtcacctgcttgggcctggcccagctccctgncctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggactcggggcatggcctctggggaccacccttcctggaactcagaagagcgaaggtcggggccctcgggaagccttggacagaagccctccaacccgctagaccagcgtacggcgtgtgtgggagagaaggaggccccggttgacctcagggagacccgggtgtccgatcttagcaaataactacccagggcgtgcgagaggtggggggaggatgagatcggcagtctggcgcaccgggcgccactcggggcagagagtgtgcagacgaggacgggcggcacgaacgggcttcccagacaaggg

SEQ ID NO: 525930 - DNA, 1534 bp, Homo sapiens
  misc_feature (1519)..(1519): n is a, c, g, or t
ggcatcttttaggaggtacgtggcacaacagcaagcttcagcaaaagcaagttgcgctctatgaccaatgagagatcatttgacaggcagcgcaaaccacaattcattactagcacaaacctgcatgtcctatccatatgacattcacgttcctggctattcgcagcatgctattcactaacgttcacactctgtctcattcccacagtatcacactaggctcgacagactacagacgagttgtacctgtacactgtctcagacaacagaaacactatagggcattcagcaggacgtatgcactctagctccatcgccagcctgcctgcacggactgtatggccacaaaggcactgcacacctgactgaaccaataccttgcaccacaatgttcaccaaggctacctacaacacgtccttcatacgctgacaacaccaacccttggaccacccacaaagcataacgacgaaatagaggaaaaacccctaggcccaacgaactcacagaagccctacgcatgaacaaacccaagacggcaggcaagcaaagaactgcctcactaggcgatccacaatgagcaaacacgcgggccccatcacgcacagcacaaagaccgcttactaattcaattcgttccaggcacatgatcccctttactctgggcaaacatcgaaagcgaacgttaacagaacgacacggttcagcaagccaacaagccaaaaactgtcggaaggtaccttcacgcaggaacacacatcgttcgcggcaaccgtaagctatagacctgcgtactaagttgagagaactaaccgctatcgttggcacattcactggaagcaccacatagcacgctatccagatgaagcgttgctcagtacacattccacgctggcatgccacattagacgcgataacggcgagacacatttaccacaagcgcctagctccagagaaaaatttggccgctaacaaatacatcgcagcgtcacaccagattcacataagcatacagatagacctacaacgcacactgacacgacctgtagaccgcgccgtaaacacaatgagctactgtaatactcagagcatatattcgggcccaaagaaacacatctgaacgtacataaccacatctaacgcggacaactcagaccagcgcctgcagccgagaacccctaaataccgacgatgacaacggaacagctggagggatcatgacaacacgagcatgaagcagcctcgactctgactacacaacgtgacacaacactgatccgacccagccacgacgatgaaactggatgcatagcacaagcagactcagcacaaatgacaacggtagcgacgacaacgaacacgtagatatatcatcacaccaacacgacagctgccagagtagacgacaaacagggacgcgtccaacgacacgaccgccaatacttaacgacgcagccagatcaagagacggagcagagacacgactcactaacatgacgcgagaatcggatgattatagantataatctcaagctc

SEQ ID NO: 525931 - DNA, 1013 bp, Homo sapiens
catcggtctgagtaagtgcgcaatagccgatgctgcgatggtgggtgagtgcaaggggcaaagaagctagatctgtaattattaataaggtcatgtatggagaggacagggtgtgtcttgctgaacatagcggataaaggggcggatggacgaagaggagtccatgtgaagtactctcaatggggaggtggataataggtatacatagtagctagcggactgcatagtgagcatgccgtttgagcatagattcattgactggttgttggtaatgcatccagcataaaccggtaggtgtgtgatagcacataggttggatagatgcccttcatcaagtgcaccacatggagaactagtgagaactcgcagaagagcagataagcttgtgattagggaattgaatataactagtcctggaatagaatggtagaaaatgtctattgtgaggggtcgctaccgggtttatgaagttggtaggagaaagtgtgagagtcgaagtactaggctgggatacgaattgatagatggagtgcagcctcaataagagactaaagacggaaagggctcgtaagggcgactatcacaggggatttcgctagccaatgggggagagaaggaatgggctgactacaatgatttggaatgaaatgcttgatagggataccgcataggacagatgtatcggcgagggaagatcgctccctgatattggctcattgtcctaatcatgctaaggcgaatcgcctcgtcagacacagaaggtgggaagggcaagacgacgaggggataccggggcagcatgcccatagtcgccatgaatctatcgtcgagcggggctgctcgcagcactttgacgcgctcgggccataaagaaaaagaggcaacattcgggaagacacggagccatacaaacggccagcaccagaaagccacaggagaacgcaagaggggcggaaagcgacaggaaaggaacaagaggcaacctaaaacaacgacgacgcacgcaagctacc

SEQ ID NO: 525932 - DNA, 963 bp, Homo sapiens
cacctattgtgattgcccggtcagcctgcataatcaatatactgatcctaaccatggcttacgcgtaataatcatccacataattgtaatttattagctccggcatagaacacacaagaagccatgcggatacgttatgctttggtctgaggctactagtagtactcaaatagagagtatcctatagcggtttcatacgttgtgaatgcctatcaaccattgagtattatataccgcgtatggtagaatacgcactgctaggaaccaaccatcgcacgactatgattatcgaccatccgacgtacccacttaactcgatacgttactccctcaaccggtcgatcggaatgggatatcctactgagctcgtccatcctcctatggaatacactgaattcgacatggattcctgatcggagtcggctctttggagaaccacataatgggatccaactccttgtgtgcttttctctatcactgttagtgctggagtcgttggatctagtggaactaaggtaatatacgtctaacaaaatacattgcacataggaacgaatgcagatacttaatcaacagaagcgatcggtttacctgacagatttgttgagacgcccacgtctcacatcgttatgctccatattcagagtaagtgagcgagtatctaagtctatgcactatggaaggccttctattctacgtgctttgcacccctgatttctgcaaaggctattactctgagagacaaattctaatccaaagattcaatcttcactatttataattcatggggcgtagaatcttaacttttactatgcctacataacatttgtctacggcgtataccggagtgtccccgacgttctctggtctttcctgatgtataaacccttttgattaaatctatcatcttgggggcgtggaggttctccaaacaaggactatttaacctggtttcccggcttg

SEQ ID NO: 525933 - DNA, 1083 bp, Homo sapiens
  misc_feature (958)..(958): n is a, c, g, or t
gtggcacccgtcgatcctggtgggtattggcgcctctgaccccactgttcgcggctccctttgggtccgtcctggtgtggtcaatccacctttctgggggtccctcctgcccgctcccccctgtctttcccttgttcccgtacactttcccagggccttgtggggggctagctggtgcttccgtgttggcatttcccactgttatttcgccttcgcatacccgcgacatcgaggtttgtcttggccgttttcacgtatgccgtgcaacgtgtcaggtcctgatctcccgtcgtgaccacctagttcatgggacacaggcacccagtgactccagtgactcccctgtcgtccctgtgtgctgccattaagctcattctggctcgcagccattgaagtgtcaccaggatctactgactgtgaagtcagcctgttcttcttttccaatgtcgcttaccacggcttctgcctccgtgctcactgaaaccatgcgagtcttgctgcgtgcaggcaggccctgtggcctgctgggctgagggaagtcagagctccacagggcgactcatcgaagtcagccatctgggatacctcctactcccgtcccgccctgtccgtcccccccccaccagtcctgcccccgcatggagcccccgtgattagtagccctgtatgatcacgtagacccacccgaacacactccatgcacactggccccggcccacggcacagcaatcccctgcgcgtggatttcacctcaccactttgtaccagatgattgagtgaccagctctgtaggccctgtgtcgtcagaggctctgtgattaactcgatggcggcagacacagcttagtccaccagcattgggccacggcttacccctgtcctcccatccggttcggctgcttgcaaggctgttcaggacgtgcacttccccaagtcggcactgagtggcccagcaccncctagccctgccaccccactgccctcctgggccttctgctggatgggcacctggggggttctggtttttacttttttaatgtaagtctcagtctttgtaattaattaccttgcattgtgagacag

SEQ ID NO: 525934 - DNA, 480 bp, Homo sapiens
actataaattcagttacacttattaggaaggtgaagacttgtagtatgatatggttatttgagtgtaagatgtagggggaataccattataggtatccagcagttcagaggttcagatagtaataatgtaaatggtatgtcatacgctactatgatgtaataggatatatggtcttgtgggttatgaatactgggcagcacaggggaggggctggcagtcgtattcatggtggtcatagctgccagcaggcattgtagcctcaatcgagtgagacagactagaagttcctagtgatggcttatgatagcaaatggcctcatgtcaaatatctagatgtaatttggtgtaagaaatacagactggatgtaccaccaactactacctgtaatgacaggcctgtccaacacatctcccttttccatgactgtggtagccagcatcggaaagaacgctgatttaaagcggtgtgcataggatca

SEQ ID NO: 525935 - DNA, 288 bp, Homo sapiens
  misc_feature (163)..(163): n is a, c, g, or t
cccacttgtccgagtgaggccgcttggccctggcgcagaggctggataactgtggcgcagacacactgccacagtggccagctcccctgcctccaccgtcgctgcttgcaaggctgttcaggacgtgcacttccccaagtcggcactgagtggcccagcaccncctagccctgccaccccactgccctcctgggccttctgctggatgggcacctggggggttctggtttttacttttttaatgtaagtctcagtctttgtaattaattaccttgcattgtgagacag

SEQ ID NO: 525936 - DNA, 242 bp, Homo sapiens
cactgatttcgttgaaggtgtggttcaggaggatggtctcctgggtcccgtggggtgcttgatgatgcacttcaggggcttgccaggtgtgaagtccttcaggccctgaatggtcaggttgtccacagggtgaatcttgttgtagtcagacgggtcagcgaaggtcagaggcagcaggccctgtctcttcaggttggtctcgtggatcctggacttaagctcgttggtgatgatggcccgga

SEQ ID NO: 525937 - DNA, 105 bp, Homo sapiens
ctaacataggggccctctgtgctcaacactgaattctaaactatcctcaatttcactctctcttgcctgcagccctggggggaaacgtcgggctgcaggcaagag

SEQ ID NO: 525938 - DNA, 193 bp, Homo sapiens
tgtcttacgattcatttgctaaactcaattcctttgaagcaccagaacatgttgcaacgatattgctattttaagtttacgtcgaatgaattaatctatattatcaataacttattacaatatcctatcttctaagactgttagatactttagtgagtatttgccctatgggatacgtaatacatcaccgcgg

SEQ ID NO: 525939 - DNA, 383 bp, Homo sapiens
gcggccgcgtttactccatgaagatagaaataatctctatcttgctgcctgagttttctaagtatgtagcacatggaagcactccataaatatttttaatgagtgacaaaataaatgaatggtggaaggataataaccatacctttatttcaagaaacactatataataataaaaaataatgacaagtatgatcatgttgaaaatgctcagataacatttaggggaaaagatcaaacagtgatgcaaaagtatacccagaaaagatctccaagtaaaaatagatctttaaaaagagaaaatatataaaatattttctttggtaaaatatgagctaaatcatttgctcacattattttctacattttccaaatttctaaaatga

SEQ ID NO: 525940 - DNA, 190 bp, Homo sapiens
tcaaaactgccctttgaggtaggtcagtattattatccccattttaacagaaggaaaactgaggcaccttatagttaagtgacttgcccagggtcacacagcaagtcagtggcacagtggttggagaggcctggcttaaccaccagcataacatggccacctcgcttttaaccttcatgatgacctattt

SEQ ID NO: 525941 - DNA, 864 bp, Homo sapiens
ggacgcgtgtgaaagcacgttgatctggattccaggcacattggcttgggtaacaagtgaacttccagtgacggggataatcacatcataaaaattgaattaaaaggcccagaaaaatacactgtagagttcgacgaagtcaaagatcctgtggctggtaaacgatggtgaatagctcaacaaatagctggccacgcatttcagccacgctgtggcccatcgcagcaggcaactgtgaagctgagcactctgcgagtattcagactgattaccgtctcaagctccattcggaaagcttcatctctgcgagatgctgaacctagcagccaggaacaagaggacaaaagcactattgtcatcacctgaaggagaagaacaaagtatacaatgcaacatcatgatgctgaccctgaaaggaacattatggtctgcgaagtcactattcagcaggagtaagctgagctaacttacaaaagacaggtgtgtgctcatattgtccaagctatacgcatggaagctaccagagtccgtgaagaatgggaacatgctatatcaagcacagaacacatgccaattctcagccaaatgatgaagatgcctcctctgatgcctactgcttatgagctgctctctatggttgttagcactgagtggctctaacgttggccggcaatatctggctcaacagctaaccctgcttcaggatctcttctcgctgcttcacacagcctctcctagagtccagagacaggtacctctttactaagcaagagtttgcctgaagtaaccccctaaatcgtctgggcaaggcatccaacagaagctgacacacccttcaccccccagagatatcaaggcacaccc

SEQ ID NO: 525942 - DNA, 486 bp, Homo sapiens
  misc_feature (187)..(187): n is a, c, g, or t
  misc_feature (207)..(207): n is a, c, g, or t
  misc_feature (241)..(241): n is a, c, g, or t
  misc_feature (298)..(298): n is a, c, g, or t
  misc_feature (458)..(458): n is a, c, g, or t
  misc_feature (477)..(477): n is a, c, g, or t
cttgtataatttcatggacactcacgcatcaactctaagcgaagacttggagcgggcatcagcaccccaggggtacctctgcaacctcggtaaatatagactatcctcaattcgcaggagcatttgtacgtggggtgtacaggcaggaacaggaaagacgctgtggccacccaggagtaggggtggnagccaacacccccggatccncagttccaaggtgcagggagggggcagaggcagntccctccgctctctgccccttgaccttggccttggtgagctctgtccctagactgtncacggtgtctgttccctcatctgaaaagcgtgaggcccacagccgttcactgcacacagctgccgtcactgcacacagctgcctccactgttcgggaagcctccctcctgcccacctgcccaggaaaagctgcgctaggtggccctgggcaagcgccctngctgggccaccttgccttncacctgggg

SEQ ID NO: 525943 - DNA, 444 bp, Homo sapiens
ccgggaacgtacccagaagtagcgggcccaatgtgcaactgacacttatttggcgtcaatcatcacagggttggactcgacaaatcgcgagatgtccctcatgtcactaacgcccatggacaccacattctcaaagagccaaaagcaggggcgatcatctccctcctaggaccgcgcatcatgcaggaggcggtagaactcaaagaagagccggacagtgccctcgtagaggcccttgcgagcagggttgacgaaggagaggtcattgcagggactgcccccaatcaccagatcgaatgggccccactcctggatatgcttctgtgtaacgctgcggacgtacccgaagtacatgaactacccctggtgccgcaccatgcccaacgagatggagtcctcacacacctccgaggcaatgtagcggtccacctgaatgcccagtcc

SEQ ID NO: 525944 - DNA, 248 bp, Homo sapiens
ccatcatcgatgtcgctcgccggtcggtggaaattccgcggctgcgattcatcgtgcgcgatgccaatggcgcggacatctatgcgtggaatgccgtgctggagcagcccgtgctcaatcccggcgagcgggcatggttcaagatacggctggcatcgccgccggccgaaggccgcgaaattgccgtgaggttcttccgcaagcagaatattgcgaccggaggaacctgaatgtctcgcgttttgatc

SEQ ID NO: 525945 - DNA, 136 bp, Homo sapiens
agcgccatctcattatctgtcatacctccatcgtgaacgagggatggttctggtgtccctggtcctcgtgggaatagaagatccatttgtctttgtgtacgagcaggcacgttcaccacctcactgtggaggaggg

SEQ ID NO: 525946 - DNA, 241 bp, Homo sapiens
aggctacagattaacgatatttggaggtcagcacggtgctcacgtgtcgacggaacttgtacagtggaggcatgcaccgaagtggtaaatacacgtacgaccaggatccatcttaacgtatatttggaggtcagcatggtgctcacgtgtcgacggagactatgtccaagggaggcatagcaccgcagtggtgaataccacgtcgagctggaggcattgcatgcatgatcgggtactagaa

SEQ ID NO: 525947 - DNA, 900 bp, Homo sapiens
  misc_feature (11)..(11): n is a, c, g, or t
  misc_feature (79)..(79): n is a, c, g, or t
  misc_feature (113)..(113): n is a, c, g, or t
  misc_feature (144)..(145): n is a, c, g, or t
  misc_feature (194)..(194): n is a, c, g, or t
  misc_feature (196)..(197): n is a, c, g, or t
  misc_feature (205)..(206): n is a, c, g, or t
  misc_feature (216)..(217): n is a, c, g, or t
  misc_feature (234)..(234): n is a, c, g, or t
  misc_feature (266)..(266): n is a, c, g, or t
  misc_feature (286)..(286): n is a, c, g, or t
  misc_feature (292)..(292): n is a, c, g, or t
  misc_feature (304)..(304): n is a, c, g, or t
  misc_feature (308)..(308): n is a, c, g, or t
  misc_feature (323)..(323): n is a, c, g, or t
  misc_feature (349)..(349): n is a, c, g, or t
  misc_feature (363)..(363): n is a, c, g, or t
  misc_feature (366)..(366): n is a, c, g, or t
  misc_feature (386)..(387): n is a, c, g, or t
  misc_feature (429)..(429): n is a, c, g, or t
  misc_feature (466)..(466): n is a, c, g, or t
  misc_feature (854)..(854): n is a, c, g, or t
aggagcttggngtgctcagggacacgggcagagggtgaatacagccgggggctgaaaggccagggcagcgcccaaagancactgagcgaaggaacagggatgagccaaaggancaccatggggatgaagaaaaagagggagtannagtagatgcacacagtctccaggaaggtgtagggccccatgcgctcctngnnacccttgnntcaccgcagnnggtccatagggccaggngcaccagctacgcatagcagttgatgttgttntttgctacggttactttgtngtattnggggctgttgtngttnttggggttcctcctntgggccagcaccagcgtcaggttgcnagttatggctaggntanaggccaatgtggcacagatnnagatggggccatatagatccggccgattccgcagatggtgcngcacaaagttgtggccaggccggggcagcagtgagcntttgatccggtccaggacctgtgaggtgtccacgttaaagaagctctgatagtagctgaaggtccagaatccgcggctgctgctgctgctgctgctcctgcaggagcgcggccttgtcactctcctcctccacctcatcctcggctccatagctgccacctgagcccacggccacagccacgtgcccttgtggggtcagctgatcgcttctgctggtggtggctgcatctggggtgtcagccagaagattagtggcctcctcgaattcatggaaggtcagctcgtcggccgatgccatggtcgttcaggggcgtctccgcatccctcgctggcgaccaactgcacccacggaggcttgaactcgtcgtcccgtccccacaggtgcgcnccgccccccctcaactgaggccacctgggccggcatccggggaatt

SEQ ID NO: 525948 - DNA, 107 bp, Homo sapiens
gttacactgcctttccagctgaggtagtagccctttccagctgaggtagtagccctttccagctgaggtagtagccctttccagctgaggtagtagctctttccaga

SEQ ID NO: 525949 - DNA, 384 bp, Homo sapiens
ttttcttgatgatgctgggggcctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaacctcatctggactaaaaatgcagaaatttacccaggcacggcggcggacgcccatcatcccagctacttgggaggctgaggcaggagaattgcttgaacccgtgaggcggaggttgtagtgagccgagatcgcgccattgcacaccaacctgggtgacagagcaagattgcatctcaaaacaaacaataataataaataataaaaacccg

SEQ ID NO: 525950 - DNA, 161 bp, Homo sapiens
ttttttaaaaaaaaagggggtagggccccccttcccccggtgttgtccccccgaattaggttttttccccccaaaaagggggggggcctgggcctccccccccccccaaaaattttttttttatttgggggggggccttttaccccctttttttccgggga

SEQ ID NO: 525951 - DNA, 1401 bp, Homo sapiens
cccgagcaacgcactgctgcagcttccctgaggcctattccaggcatgtttgttcaacgagtggctgtcatgaatcatggactgttattatatgcctatgattttctggtcaagaacaacatgagttcgcatggataaccgaatgctgatggtcggtgtttattatgccaagtgctgtgtaggagagcggcgagggcaagcgtagtttgactagcctgagtagcggggaacgaaaaaaggtcgcccgatgcatgtcgaggggccagcggcggcgacggagcgcctggctcagggacagacgaccatggagccatcctcgtcgggtgcacgtatccgagggcgtaccatccttcctgggcagatagttgtggggcgtagcgacacgcacagacaccagcaatggcacgtaagccaaacggagtgccagttgcagtatccagagagctatcgatgcagcggattgcttgtaccgggccttctagttgcctgggcgagcgaggacggaacgagtcatgatcctcacaagcacgtgggctctctgaggtcatccttggagtgcgccggcggccgaggcccgtggccatcacccctgttgatggacgccttccacgcaagagtataggaaccagtctcggtagaatcatcgccagggagccaggtgaataaccgtctgcctttgtcgtgttccatcattttaaaccgctcaaggtccagctattcccttgatgaaaccgacgggcgatacatccttctgcagaagcatattcggcgtcacttcccgagcgagcagtgctgggactcaatggggaccctggactagggcaacacggggggcttcccaccgttataacacactctcatcgacgggtgcttgacacgccccccaaggctacgaacgttgcgtgacgtggcggtcaccttcattcaacaggcgatacaaacttgtaccacgcagaacttggttcccacgccaccaacgtgtgaacacccgttggggcaaacctcttcggcttgtggaggccctcagggtcccttgcgattggaaccccgcacaaacacacccaaactttttgggctacacccattgaaggcggaatcccacctccaagtcagaaagtgggaaccccaccaggggggcccgccatgtccggcgaataacgcggacgctaccccacggcgaagggggaaccagagccccgaaccggcccccccggcgccactgtgcaccaaaggagacccaccgtccacgcgccgcgcaaatccagcaacccaccagccacaaaaaaacaggcccgacgccaataccaccgtagccgcacacgaccacacaccaccgcgcacctggaccaccccgagcaggccgacccaagccacaccagccccgcccaccacccccccacc

SEQ ID NO: 525952 - DNA, 318 bp, Homo sapiens
cttggctgagtacagtagcgctctagtatcccctctatcaacatgctagatgaagattgcaggtataaatgaccctggtgtggaacaaatcaccaactaagcatccctatttttccctaatttccttatttgtattgcttcctaaatattgtatttggcatagctgacaaccagggctttacagtttataccaagggtcttctctctgtgctagagtcaagaggaggaaaagaagaagagagaactgaacttccagtgtttcatcccattaggtttttatgtgtggtgcttactggtgtagaagtggcaatcaagctt

SEQ ID NO: 525953 - DNA, 128 bp, Homo sapiens
aggtactcctccgttgctcggttttccactgcaggtacagtgtttcagccacagacaagtgcaacaaaacctggttactatacacaaagccacgctgtgataattttactcttaaatcaatcattcag

SEQ ID NO: 525954 - DNA, 966 bp, Homo sapiens
atgacgaggctcgggtggaatggccagagccacacgatgacgaacgaacggatgcccgaaggaaacccctgcagcacaggaggtgtggttgctcatagcaggcaggcaagcgaaacagcagcaaacaccagcgcaggctccgcaagcaaggcatgcaggcagcaacagggcacacagcaaggctgcacagtcgcagcacaggcagtcctgcagcacagcagtcgcataggcagacccgaatcagtcgcatccatgcagcaaggcagcaacggcagcccacaaggcaagggcaggcaggcaagtgctgcacaggcaagtggtggcagtctgcagggcggcaacaggcacagcacaaaggtggcagcgggcacattggcgagggcaacctctccaccgcttgctgccgccgccctggccgccgccgccagtgaaagctaagcacttggctgctgttgaggaacaggaagcatcaaatctttggtggccctgctggtggagacccagatgcaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcaagcacttccaacagatgcaccaacagcagcagcagcaccacagaacctgccccaggctccaggctatcccccaaagtggttgtgggcaccgcagccatggttggtgtggctcagcctctgtagtcctgtcttgtgcatgggccttcagaagttggcctttgaaagatggagcaggtcatggagggccacgagagaacgtggaaccacaacggggagaccaggagtaccgccggacagaaacagcggacaaaagagccagagcaggaaaaagaaccaaggaaacaagaagcagaaaacaag

SEQ ID NO: 525955 - DNA, 871 bp, Homo sapiens
  misc_feature (6)..(6): n is a, c, g, or t
  misc_feature (13)..(13): n is a, c, g, or t
  misc_feature (24)..(24): n is a, c, g, or t
  misc_feature (28)..(28): n is a, c, g, or t
  misc_feature (32)..(32): n is a, c, g, or t
  misc_feature (44)..(44): n is a, c, g, or t
  misc_feature (47)..(47): n is a, c, g, or t
  misc_feature (53)..(53): n is a, c, g, or t
  misc_feature (59)..(59): n is a, c, g, or t
  misc_feature (66)..(66): n is a, c, g, or t
  misc_feature (75)..(75): n is a, c, g, or t
  misc_feature (78)..(78): n is a, c, g, or t
  misc_feature (108)..(108): n is a, c, g, or t
  misc_feature (120)..(120): n is a, c, g, or t
  misc_feature (124)..(124): n is a, c, g, or t
  misc_feature (137)..(137): n is a, c, g, or t
  misc_feature (158)..(158): n is a, c, g, or t
  misc_feature (172)..(172): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (200)..(200): n is a, c, g, or t
  misc_feature (203)..(203): n is a, c, g, or t
  misc_feature (209)..(209): n is a, c, g, or t
  misc_feature (229)..(229): n is a, c, g, or t
  misc_feature (233)..(233): n is a, c, g, or t
  misc_feature (235)..(235): n is a, c, g, or t
  misc_feature (239)..(239): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (265)..(265): n is a, c, g, or t
  misc_feature (291)..(292): n is a, c, g, or t
  misc_feature (309)..(309): n is a, c, g, or t
  misc_feature (312)..(312): n is a, c, g, or t
  misc_feature (322)..(322): n is a, c, g, or t
  misc_feature (327)..(327): n is a, c, g, or t
  misc_feature (329)..(330): n is a, c, g, or t
  misc_feature (334)..(335): n is a, c, g, or t
  misc_feature (337)..(337): n is a, c, g, or t
  misc_feature (341)..(341): n is a, c, g, or t
  misc_feature (360)..(360): n is a, c, g, or t
  misc_feature (371)..(371): n is a, c, g, or t
  misc_feature (377)..(377): n is a, c, g, or t
  misc_feature (385)..(385): n is a, c, g, or t
  misc_feature (396)..(396): n is a, c, g, or t
  misc_feature (402)..(403): n is a, c, g, or t
  misc_feature (409)..(409): n is a, c, g, or t
  misc_feature (418)..(418): n is a, c, g, or t
  misc_feature (434)..(434): n is a, c, g, or t
  misc_feature (441)..(441): n is a, c, g, or t
  misc_feature (444)..(444): n is a, c, g, or t
  misc_feature (457)..(457): n is a, c, g, or t
  misc_feature (473)..(473): n is a, c, g, or t
  misc_feature (480)..(480): n is a, c, g, or t
  misc_feature (488)..(488): n is a, c, g, or t
  misc_feature (493)..(493): n is a, c, g, or t
  misc_feature (497)..(497): n is a, c, g, or t
  misc_feature (501)..(501): n is a, c, g, or t
  misc_feature (522)..(522): n is a, c, g, or t
  misc_feature (528)..(528): n is a, c, g, or t
  misc_feature (534)..(534): n is a, c, g, or t
  misc_feature (536)..(536): n is a, c, g, or t
  misc_feature (545)..(545): n is a, c, g, or t
  misc_feature (547)..(547): n is a, c, g, or t
  misc_feature (558)..(558): n is a, c, g, or t
  misc_feature (561)..(561): n is a, c, g, or t
  misc_feature (588)..(588): n is a, c, g, or t
  misc_feature (610)..(610): n is a, c, g, or t
  misc_feature (623)..(623): n is a, c, g, or t
  misc_feature (630)..(630): n is a, c, g, or t
  misc_feature (654)..(654): n is a, c, g, or t
  misc_feature (656)..(656): n is a, c, g, or t
  misc_feature (658)..(658): n is a, c, g, or t
  misc_feature (706)..(707): n is a, c, g, or t
  misc_feature (709)..(709): n is a, c, g, or t
  misc_feature (722)..(722): n is a, c, g, or t
  misc_feature (729)..(729): n is a, c, g, or t
  misc_feature (760)..(761): n is a, c, g, or t
  misc_feature (765)..(765): n is a, c, g, or t
  misc_feature (779)..(779): n is a, c, g, or t
  misc_feature (788)..(788): n is a, c, g, or t
  misc_feature (793)..(793): n is a, c, g, or t
  misc_feature (797)..(797): n is a, c, g, or t
  misc_feature (833)..(833): n is a, c, g, or t
tccgtntgcagtnttttaatttanccangtanaaaggcaattancanaatttnaagganacttttnacttattanacnaaaaaaaaaactttacaaaaagtttaaacnaaaaaattacancccnaagtgattagggnccccagtaacacaaaaaaaanaaattgaaaagggncattgcccggcaanccncanaaccacanagnagagcncaacaattgtccgtgatcanaaananactncaaaaaancanctncncanatncccnagcattatgccccactagtaaaaggnnggcctatgacaatgccnttntttattttgngtacncnncccnncnattncccccaaaagttttttttncccgcaaaaanaaaaanaaaaggcngtacccccaanaaatanncccaangaagattancccaacagaagccccnacgtttnccnttttcccccgccntccccgaagtcccccngggtgtncccccgcnatttnccancccnttcattgttgattagcccacnaaaagnagaatncnttagcaacncncaaaacaaaanacncaggccaaaacaggccccacaaatacnctttgaaataggtatatttggntacaaacaaaacntccccgnccattattttttctaatgactaancncnaaatttttaaaaatggaagttttcaaaccaacgatgtgttaagcccanncncatgacacattcnttttaanttctcattcagtatgggaaaattttatttcnncccnttgtcttgcagaanaatttaggntcccncccngggcacgattcaccaaatagagtaagaccacagatnaaagtgacaaagaaacacaggcaatgaagaacacttcc

SEQ ID NO: 525956 - DNA, 901 bp, Homo sapiens
tggaaacaaagtctactctgtcgcccaggctgggttgcatgggattgatctcggttcatgaaatttccgcctcccggttttaagcggttctcctgcttcacctcctgagtggctggggattggcaggggctgttatgccaccatggcccagctaatttctggtcatttttatgtcagaaggacagggtttcaccattgttgggtcaggctgggtcatcgaactcctagacctcgtagatccgcccgctctgggctccgaaagtggctgggctattggcaggctgtagacgccactgcgccgggcctagaagctaatttcttctacaaaagctcttcagtttttggtcttgtgtactggtttggttttcttttctttttggccgagggatctctttctggtccgcccagcgtctcggcatgttgccagtgcggcctttgatctcagtgttcactggccaccttctggcctctcgggtgttccacagccgatttctcccctggctcacagcctcccccaaagttagctgggcgtttaactggccgcttcgccacccaacccccagctcatttttggtatttcactcacagatcggtgttccacattgtgtgggtcagggcgtggtcctcgaatcttcaaacctagaggatgaatacgacgttgccttgtagctctcccaggttggttgttatttgtcggcttttagaacatttcgcctcgtgcctcttagacaatcttggattttatttacaaagattcggggcattaaggcccgactattacatagcacactttttgattcagccaaccgggtacaacgttgcacgtgcattcactctactcttacgcaccttttcccactgtgtgtagcggtccccgcgtagtttgttaggttatgcactt

SEQ ID NO: 525957 - DNA, 336 bp, Homo sapiens
acctactgttgccggggagaggaagaaagtatgatgatgagaatcgcccagaaatgtaatatcaaccttctccctttaccagatcccattccttctggtctgatggaagaatgtgtggattgggatgaggaagcctaagctgatgtgcatacatatggtatagcaagtgtaccttaccaaccattaaaaaagcatattcagactatagagagatccctccaatttcaaaaagctcatggtgaccacatggattcctctagaaacaatcctgtatccggactatcagtcaaatctaaaaataatagcacacaatatgcttgtgtgaaaagccactca

SEQ ID NO: 525958 - DNA, 339 bp, Homo sapiens
agcagtatctagtaagcttactctctactaacaaaaacagatagactttccccaaaatacagaaaagaatcagtgtcttgtgcccaataacaaggatgcagaaaagagggagctttatattctcccttttctcaagcagacaaacccttttgcctaaacttagtaaaactgaccagtcagatatgacctccaaaatttcccttgaaaaccttccacgcaccatattctgctgcctattcctggagatagttactgattagtaatcagtatcctatttaatgagaaaagatttctcacagctttctataacatatctcactctacgagtattgtataaag

SEQ ID NO: 525959 - DNA, 215 bp, Homo sapiens
gaccaaaagaggctgcaggtcaaaacctgaaagaggctctcccaggccaggcgacaaccctttaggtgcagacggggaacaaaaggctcagcctgtggtaatgccaattccttctgaaaaaggagaaacgagtcgtccagcaacgggccatgggtaggggcggacggtagcaggggacactgtcccctgcctcagcatgtcctgtacagagggtg

SEQ ID NO: 525960 - DNA, 455 bp, Homo sapiens
  misc_feature (49)..(50): n is a, c, g, or t
  misc_feature (117)..(117): n is a, c, g, or t
  misc_feature (157)..(157): n is a, c, g, or t
  misc_feature (180)..(180): n is a, c, g, or t
cgtagatggggctacctgaccttgacactagtacactgtctgtaccccnnggataccatatatatgtagtgcaggatatcttcctcctgccgctaccaaatgggaacaggcggctantgttgactctctccatagggatcggcagctccctacacgngcggtgaaaagatgggcatgaanatttgctaacgactgagaaacactatgtaaagatgctgagtatgcaagcctctctttccactcgattagctcctcagaaatggttatcatttattttattttatttaactgagatataattcacataacatgaaatttaccagttttaaaatgtacaagtcagtgggttttagtatattcactatgtttggcatccatcccactaatttcagaacgtttccatcaccccaaccagtttttctctttttttaattatgaagaaaattcaaacatgt

SEQ ID NO: 525961 - DNA, 236 bp, Homo sapiens
cgctagtcatggccatccgcttctgcgcgggcgctgcgcttattggctttcgttcgaagcttcagcctgcccttgcacacttcttaccagaaggcacagcctacaccgccttattcccatgaatagttattatctgcaaatagccattagtctagtcatgtccgccgaatagcgcctggggggttcccgtcttagacgctggtaactgttgcgtgctgggccgctcttgagctctt

SEQ ID NO: 525962 - DNA, 319 bp, Homo sapiens
tcatagacaggcacgtaataaatgtgtgatactataaaacaggcatacagatacgaggagtcatcaaacatttctaggaaaatgaatcttataaaaaaactacggccaggcatggagactcatgcctgtaatcccagcattttgagaggctgacgcaaatggatagcttaaacctcaggagcttgagaccagcctacggacacatgtcaaaaccctatctctccaaaaaaatacaaaaattagccaggtgtagtggtatgtacctatagacctagctactcaggaggctgaggtgagaaaagggtgacagaggtagcag

SEQ ID NO: 525963 - DNA, 141 bp, Homo sapiens
  misc_feature (10)..(10): n is a, c, g, or t
  misc_feature (101)..(101): n is a, c, g, or t
aaattcaagncttctaacgaatgtacggggcacatgacacagcaaagacgagaagcaccctatggagctttaatttaaattaaatgcaacacaggtacctnaacaaaccccacagtgtcctaaacctaccacaacctgcat

SEQ ID NO: 525964 - DNA, 369 bp, Homo sapiens
  misc_feature (182)..(182): n is a, c, g, or t
ccaaatctgctccatggaactcttttctccctccaccatgccccatgccagggccgagactgggaccaggagagccaggtctataattcaatggcccatgaccgccagcgataggccaagagcccacttagtatcatgctggctgactccatttccttctggaccaccaataattcccccancacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacatca

SEQ ID NO: 525965 - DNA, 344 bp, Homo sapiens
gctgactattgaagggcatgcctcagtgcaccttgtgggctggcactggctcctagacacctttggctgcctagggctcaggcactttgagggtggcaggcctcacgcaccttgcgggtggcacggctccttggttttggggatgcactggttcctgacggtggaaggctgtgcaatgctgtttcacctgctgcctgctaaccctagggggctgggactgcagggctgcttctgctgctgaggcaactcctgctgcaacatctgctggctcctgatctcaagagaggcaatacccctgtctttgtccctttcaactggtccggtccatactccagagtcttccg

SEQ ID NO: 525966 - DNA, 400 bp, Homo sapiens
gaccatctagcccctaaccatggaggaaaagctttcggtcttccaccattgaggatatgttctgtggtgagcagatctatgcaaacctgtccccaaagtctgaggaaactgagaggttgaagaaagaggatgacaaatccagtttcttagaaagaaacatttaatatggccttacaaacagaagccgtgtctgtgtctccggtagcagcaagataagatggtggatccctgcaccatcaccctccagacccagggcttatctatcacagggaaggaatgtgtaggatgattgaaaccaacccctcaggaaaaggtattctaatgaagcctgtgaactaaaattttggggaaagcagtttccatggcagattgatttttaaaagcttctttcacccctaaa

SEQ ID NO: 525967 - DNA, 103 bp, Homo sapiens
gggcggtggctatctgatttacgcttattttcacgaccaggcatctgccagttggaacccacgccggctcaaagtgagttgcgccgctattccactgcatgca

SEQ ID NO: 525968 - DNA, 596 bp, Homo sapiens
ccgcttgtgaacacatggaataaaggcttcccattttccttacattcgtagtggtttgtcacctgtatgaattctttgatgttgaatgaggtatgagctacgactaactgccttcccgcagtccttacattcatagggtctgtcaccagtatggactctctgatgtcgtgtgagctgtgcgtgctgtctgaaggccttcccacattccttacactcatagggtttctccccagaatgaattctttgatgtcgagtaacttctgagctgtgaataaagccctttccgcatcccttacactcgtagggtttctcaccagtgtggattcgctggtgtacagtcagctgtgagtgctgtctaaaggctttcccgcattctttacactcatagggtctggcccctgtgtggattctccgatgcacagtgagttgggagccacgaatgaaagccttgccacagtctttacatacgtagggtttctcgcctgtgtgagttctttgatgcagaatcagctgtgaatgctgcctaaaggtcttcccacattctttacattcataaggtttgacaccagtatgaagtctctgatgtagaactaggt

SEQ ID NO: 525969 - DNA, 446 bp, Homo sapiens
  misc_feature (184)..(184): n is a, c, g, or t
ctacacacaaagaaaatgctcactttgggatggggcactagcagtgtcggcgggtgcaaagtggcaacgactagaactgggagtgcattctccacaggctgacagcttcctctctctgcggccagcgccacaagcagagtgactcctggctgatgaatggtgagtaacgggctgcataccccgngttgtccaggaggagcgccggcccttaccttgactgtccggcttcatcagcagcgcgtggcccaccagtgggtaggcgcgggccaccgtggggatgggccgcatctgctgccatttccgcgcgtagctcgccaccctctgcagctggctcaggaccagagtggcgccggccagggaaacggcactcgccgcgccccacagcagcagcttctgccacacgagccccagccagagccccgccattcgccaccgctggcggccgc

SEQ ID NO: 525970 - DNA, 110 bp, Homo sapiens
aggcgtcactagaggatcccgtgtgtcgagataagtaacagaatagaagtcacacataaaaagtaacaagctactgatacataccatgaacataaatgaaccttgcaaac

SEQ ID NO: 525971 - DNA, 1133 bp, Homo sapiens
tccccttggcccataaatttttattgggcagtgtcaggaaaaaacccgggggtaatgggtcccttccttcccatccctctacccaaaagacaccctccaaaggacagctagaagccccaaagcctgttgcctcagaaggaccttggaggcagacaaatggttgtagtgatctccctgtccctcgagcaggctgcggtagtgtggcaatctcctgctccagccgtgatttgatgtccatgacgccgttggtactccgtaattctgccgctcactatcagtctcgacacattcgcccagttgggctacaataccgcttgatcagcgccgtggaatatgcgccagcggggctccaaagcgcgcctcgcgttatctgccaggtgtgtctctccagggcagccttcatgcccagctgtagacttcgcagcctacaatcctcaagaacccttgaaggggttgcgccagaaaggctactagtaaccctcggacctgactcatcttgagaagcatgcctccgtgtgtggccagaggagaccctcccgggtcacaaatctctctcaggctcccggtctgtgtagacaccaggggttcaggaattaccataccgggtatcctgcactcggccattgaacgctccattatggggctttcggacatgtgtcgactccagagactcctgtggcgaaaaattccggtatgccccgagaagctgaatatcccaacctcacagcatgagacacttaggggcctcccacatttggcccccataaggggtaccgtgatatacgcgtccatcaggagtcctatctaccaggggtgcagggcccaagctgacaccactaaaagggcgcatcagaaagcgtggacatcagcccaagggggtgcggtccccgtaggcacaaaggggtcaaggacacaaccagagagacccctgtggcgcaaggcacggtgaaagcacggccaccacccggcacagaatagccagaaaagcaaggtaccagggcctcaaaccatggggccggcaaaggtccactggcgagccaacagggaggtcggcgtgcaactgagaagaaacaaccctgagactcaccacatggctggccgcccagaaagctggcgcgcaaggcacagggaat

SEQ ID NO: 525972 - DNA, 114 bp, Homo sapiens
gagctcggtacccatggtttatatcgtggtcgttaaggactcaatgcccacccattcctctctaagatatcacatactaccaatccgcaatgtctgacccatttattttcggat

SEQ ID NO: 525973 - DNA, 215 bp, Homo sapiens
ggtgcatgccaccacacctggctaattttttgtattttagtagaagacggggtgtcaccgtgttgtccaggctggtctcgaattcctaagctcagggcattccacccaccttgggccgtccaaagtgcctgggattataggtgtgagccaccatacccagccggattttttagatttaaaggttgtctttccaggacgggcaagcttaggcctta

SEQ ID NO: 525974 - DNA, 132 bp, Homo sapiens
ggagttcaagaccagcccaggccacacggcgaaaccccagctatacaaaatctgctgggcatttgtctttgactttctagtccttaaaaaaaaatcagctgggcatggtggcacacacctgtagtcccagct

SEQ ID NO: 525975 - DNA, 302 bp, Homo sapiens
gtcgatttgcataggtgcggggtcggcatggtggtgcacttccacaaggtcaaggagaggtctttaccgccgctacctgcgaatgggtgcatggggagacacgatctggaactccatccccgctgattcgcccaccatgcttcaggtctgaatggctctaaagcgtaaatggcgttagcattcccaccactcggcttaaacagcctgtttttcagatcagggtcgcattgtggaaaagctaaaacgcctccaaagtggaatcgaagggctcgacgctcgtcgacgcggccgcgaatttagta

SEQ ID NO: 525976 - DNA, 1085 bp, Homo sapiens
  misc_feature (639)..(639): n is a, c, g, or t
gcaccagttgtgtttcacatgttcccccccagatcttgtttcctggttgcgtcaactgtcggtttgtttccccacccctttgggggaaaaattttcctccccgtaaagttggtgctgtaaggacccccccgtgtggtgagatgttctcccggaggtcgtccctcttgggagcccccttgctgaaggttacccctgggtgtgaccccccgttaattatgtgtgggaagaaagcgggtctttagatgtttttccccccccgctgtttctctcacagagaattgtcaggggggcctgcccgcccaatctcccccccctttgttggtgccccccccacggcgtgtggtcgctacactctctcggggccctatgagatgccacgcttgagttttctcgtctcgcctccccactcaatttggggggcgctttggagattttgttccctctggaggggctcccacgccttgttgggccctctcctttctgttctctctgatacaccacgttgtggacaccacagtgcgcccgcctctctgttgggcgctttcttgcccccctgggagaatggcgcccccggttgtgtggggttgtggctttgtggtgtaggccctcttggggcgccccctgccccctgtgtggggntttctctgtgccttataaggcgaccacattcttcttctctcacttgtggtgggagagacccccgcgccccactttacacaccctcaccaccgcgtgttttatatgtaaaagagaagaagaaggtgtggggtgtggagggggaaatattagtctgtttcccccgccttagagagggggagaatataaagagagagggctctaatttagatttctctgggacaccagcctcgcgctctttgtgagggagagaaaatatataatagctcttggaacaccgagggagaaagttctataggaaattatcacttgaaacactattaaatgggtattttcttttttcttggagtttccacagcgaaaagccttcttaaattttaatgcttttcttcctgcgagaagtaaatgtaccccttttttttgaaactggattaaaaactcccttttta

SEQ ID NO: 525977 - DNA, 420 bp, Homo sapiens
tgagcttatgctgccatcactgctcagcagcatagaaaccttcttaaccttgagcgccttcatcatgtcaacagcatcttctgcatacctttcagaaaagtctctgaagaactctcgatctgagggcctagaatgtccatagcctcgaggatctcagccgaccaccgtgtagagcttcctattaaggttcctaagctgaggtccagaatcagtctctcagcttcatatcatcccaggaagtagcaggcatgcgtgatctccctatccagtatactggtaatgcagctgatacgccattcgcagtcactttgacagaggtaaccatggtgccgaactcgaccgcgggtccggaccgtgggacgtggatcacgggattcagccctcagataagcagccgcaggcgcaacacgcgccgtccgc

SEQ ID NO: 525978 - DNA, 455 bp, Homo sapiens
tgacaagaatcactgcgtgaaggttcttcaggttcataaagtctccatctttaattccggtcattttgatgatctgcaggtctagcagagttgtgacacacggaagatcctctggcactttgttcagacccaaatcagactactggtgctgtcgaagatggctcttgtcatcgtaaggggcacactaggactaggtagggctcgaaatcgcggtcatcagtagcatcggggcctatcccagaagcctcatcttctagcataaagtctaataagcctctctgttgaaacggtccaggacaggaagcttgtgcaagcagaaggagcatgatagtggccttcatgatttatcgcatgtacttacacaatcagggaaccttacaagatacttgtaaagattaaacaagatagtggacttctctactgtgtccgctggctcatacaggcgagcaggtccg

SEQ ID NO: 525979 - DNA, 123 bp, Homo sapiens
tgctgggatcacaggcgtgagccactgccccggccatcccagggttgtttgctggttaatttttgcacatatcaccttgtgatgtctgtggtagcaactagatgaagagcaggaacttacaga

SEQ ID NO: 525980 - DNA, 102 bp, Homo sapiens
taacagccctagaagtctaatgcctacatttaaaggatggcctggcacccagtaaacgccgattcctgctacacggacttctacgcccattactaggagaca

SEQ ID NO: 525981 - DNA, 520 bp, Homo sapiens
cgagtaaagatcaaaaattagtcagggtgtggtggacgcctgtgagtctcaagtctcagctactcaggaggctgaggcaggagaatcacttgaacccaggaggtgttgcagtgaaccaagatcacaccactgcactccagcctaggcaacagagactctgtctcaaaaaaaaaaaaaaaaaaaaaaccccccgggaaacagcagccctattttccgagtgtgaccttgtgctgtgtgaaaggctaccctggctaccccaccagggccaaagacagccacagtgtgattaagaacagaggcgggatcaaaatttccacagaacaacagttcagctgagggccctgcacacaccggggttgtagagaacccacaattggccgccgagaggcctgccttttggcctggcccaggcttcaccccaactttgggcttcacctcctcaaggaggcctttcccagttacccgaagctcgggtgcccttctcgagggctcccggttgcacctgtgagctgtgtacctt

SEQ ID NO: 525982 - DNA, 293 bp, Homo sapiens
tagaggcatttagtcttccgaatttgggtcgtccattggccgatggtgagttccttgttatttacgtttttcttatttatttattgtaggatatgagttatggcttaatgccaacattcaaggctttaacatcaccaatcatcctgatattaacactacaagttgcattatgctatatatgtagataccattacgtggttatgggattatggggagttaaagttaaaggcttatcttattttaagcattttgtacgaccttataaggctttgttaatactcaatattttcgag

SEQ ID NO: 525983 - DNA, 312 bp, Homo sapiens
tgcgctggtgccttcggcacatgctctgttcctgaaggtgcattgctgcgcatatggacaaggcggagagcgaaagacaatccagaccatcctcagctccagcatcccaaggcctgggcgcaaggcatcctggatcatgacctcgtgtacgggttcggggacctgaccttcggtattgagagctatgatctgcacttgtgtcagtgtttgccatcgagagtgaccagctccatcagctctgggagaaggaccgagctcactagtggccaaagaacacctgtggccaattctgaaggggcttccagagagggg

SEQ ID NO: 525984 - DNA, 863 bp, Homo sapiens
  misc_feature (26)..(26): n is a, c, g, or t
  misc_feature (87)..(87): n is a, c, g, or t
  misc_feature (127)..(128): n is a, c, g, or t
  misc_feature (137)..(137): n is a, c, g, or t
  misc_feature (140)..(140): n is a, c, g, or t
  misc_feature (149)..(149): n is a, c, g, or t
  misc_feature (170)..(170): n is a, c, g, or t
  misc_feature (181)..(181): n is a, c, g, or t
  misc_feature (190)..(190): n is a, c, g, or t
  misc_feature (202)..(202): n is a, c, g, or t
  misc_feature (222)..(222): n is a, c, g, or t
  misc_feature (234)..(234): n is a, c, g, or t
  misc_feature (368)..(368): n is a, c, g, or t
  misc_feature (372)..(372): n is a, c, g, or t
  misc_feature (415)..(415): n is a, c, g, or t
  misc_feature (428)..(428): n is a, c, g, or t
  misc_feature (500)..(500): n is a, c, g, or t
  misc_feature (517)..(517): n is a, c, g, or t
  misc_feature (532)..(532): n is a, c, g, or t
  misc_feature (584)..(584): n is a, c, g, or t
  misc_feature (672)..(672): n is a, c, g, or t
  misc_feature (715)..(715): n is a, c, g, or t
  misc_feature (767)..(767): n is a, c, g, or t
  misc_feature (770)..(770): n is a, c, g, or t
  misc_feature (819)..(819): n is a, c, g, or t
tttgataaaaaattttaggaatcttntcctttaattaactcatcaacctctcatggcaagaatttgagaaagtaaatttatactcangttttaattttaatagggaaggaagaagttacacctcagnncaccatgangtngagacaaanatggagacacctcagccccanctttctgcaangggtaagangattggggaggntgcacaggtcagggtgggangggggtcatggnggacatgggggtggggtggtctccccacctcctcacattatgcctacatgaacacagacacatgcaggtgcctttgcagaaacaaagtcagggttcttcaagtcacaaagggaagggcaggaacaactcttgcntctnagtcccacacaaggcagctgtctcacactttacaagctgtganagacacatcaganccctgggcactgtcactgcttgcagcctgagagtagctccctccttttctatctgagctgttcctcctccanatcacagcagcgaccanagctccagtgatcanagctccaaggagaaccaggccagcaatgatgcccacgatggggacggtgggntgggaagatggctcccatctcagggtgaggggcttgggcagaccctcatgctgcacatggcaggtgtatctctgctcctctccagaangtaccaccacagctgcccacttctggaaggttccatcccctgnaggcctggtctccacaagctccgtgtcctgggtctggtcctcaccatcccgntgncaggtcagtgtgatctccgcaggtagaagcccagggcccagcatctcanagtggcctcatggtcagagatggggtggtgggtcatatgtgtct

SEQ ID NO: 525985 - DNA, 207 bp, Homo sapiens
  misc_feature (185)..(185): n is a, c, g, or t
  misc_feature (198)..(198): n is a, c, g, or t
actagaggactcaattcggccggggcatctcaatgctgttaatccggaggacagtctgcggggtcgtgagattcttttcttcttgaagtttttccttttcctgaatctcataatggattctgggccatgattctggtcttttcaatgactggtggcttctactcggaacaagatcctttccgagngagtggctggcanaagcaagcg

SEQ ID NO: 525986 - DNA, 1429 bp, Homo sapiens
  misc_feature (1379)..(1379): n is a, c, g, or t
tgtacggtcgatcgcctgaagagtggcgctgttaagaagcaacgaacactctcctcttcgtcttccgacagtacaggccatcgggcagtctgtgaatgcagcaagcgcgatgcgtgagttgcttttcccatccagacagtgtgtgccaggctggtggtctagagtgggcaatggcttgactgggtcagctcttagtgccctgtgtcaaccacgtgcagtcgcagagcgcggaatggccagtatgctaaaagtgactgaagaccatggggcgggaggcaggatgagggccggttcaacattcatatactatctacgtagatgacggggggctggaaatgcagtgtactcgacggggctacggggtgttgtagaccgtagtgaacccagcacgttcactcttgactgagggtgaggacaactaggacacacttattctgctcaggtatctctactcaccccgtggcaagtcagacacgtgtattacactactggctaaagagggaaaacgaatggccttgcccaatatttagtcttgaatagctccctgaaaggcggtaacccttaatcaccaccaaatgtagaggctaatgggaacggaaggtcaattctgggtaacaccttccggttagttgtgagtaccccaggtaaattttccggtcataaggtccatagagaactcgagtaacttcaattgattgtgtccaacacacgagtggataccataccctaaggtggggaacgttggaacatatagagcggttagtactcttcacgaaagaaatgacttttttggaggaggcttgtgtgggtggaacaactgtgagatatacaattgaggagtttttacaagcctttctggaacatttggctttgccaattaggggaaaactggattggttgcattctaagatttaggaagtatagttgtggcccaacatggcagacagggtttccccagggaggcaccttggggtaaaggtttattcacaattacgttaagttgtttaaatctcccccggggaggtgtactcccacgaaggggtatttaattcccccaagccacgggacatatggaatagcaggttgtaggaacagagccgcccctgtaagacaagaagtgtaccgccaagttatgcgattcgtaagaacaaaagagtcgaaagaaagcgcgatacctcgcgcgttgagaataggagcaaccattcatgtagaaacttttgggtagtgcgccgttgttcgactgtgtgggataaaggacaacgaaaagatggaatgggggacaccaatatcttagattagaaaggcaaagtttcatgggttccgggtatagaaaaagaaccgtgcgggaaataaattttggagaggacaggatcgccaanagtggcgttaataagcgtagacggcacttggaaaatttaggggattaagg

SEQ ID NO: 525987 - DNA, 952 bp, Homo sapiens
cggtggggcgactcccgtacgtagtgtagttcgttgggccggatactgagagattgggtgtattgcttgaacattattgccactactatgccaataattggcgggtgtacccaaggatcctgggaagggatgttcaagccggagcgtgccggagaagcatttggccctcagcatgatccctatgcatcggcacggttgtgggttcatcaaggatttatgcgcgccatgtcgtgattcgtgaacctctggtggtgtctaatgtaaccagaatgactattcagtctggtgtgggatgtattacacatcgagtagcaagatgcttcagagagagtccacgaagatgtgagatactatcgccacaaggtcaaactgaattgcggtttgatggttagcgccaagagaaaggccgcagcgggggtgaccattggtaaacttgtcgtgaaatgggtttgacatatgagagatattttggtccggggtcacttgagcgtaaagtacaattatctttttcgaaattatgatgctcaggtgttgggggaccactagatggttaccctttcactgttaactatagaattggcgttggtcagaaagtccttaaatgagtgaatttgacttgtgcatgaaactctttctgaacgtgacttttacctaggagtcttaagggggattgcgaaacttggtttttgcaggggttagaaaatgcccttttgatttcagctttttggggacattctgcaatcagatgaaacattgcattcctgggtttaagagagactggcacgtgttatctccgactgttaggtaataacgatgttagacttgtttctctcgtgagagacatcaggtatccacgcactgtgggcgtggcgccatctgcgaacactccctggcgtctggaaattcattcacccttctttacggcatttgtgtaccattggcgggccagtgc

SEQ ID NO: 525988 - DNA, 636 bp, Homo sapiens
ggagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaagaggcaggagaatcactagaagctgcgaggcagaggttgcagtgagctgagattgtgccagtgccctcctgggcaacaagagtgaaactctgtctcaaaaaataaacaaggccaagcattttcccattaacatggtattaagaaatacgtagccataattttaagggtctttataggtggtgatgatttgttaggtcccattttttgcg

SEQ ID NO: 525989 - DNA, 370 bp, Homo sapiens
acatttttcttggccaggcgaggtggtcatgcctgtaatcccagcactttgggaggccaaggtgggcggatcacttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaag

SEQ ID NO: 525990 - DNA, 306 bp, Homo sapiens
  misc_feature (1)..(1): n is a, c, g, or t
naactttgacgatgatgaaaagcgagggcactgggggttgggctcaacatcttattcactgaacacgaacctcaactggctattcctagacatttcattatgtgagccaaataaacacctattttaagtcaaaaaaaaaaaaaaaaaaaaaaaaaaaaaaaaaaaaaccccccctttttttttttgggccgggttggggacaattttaaaaagggtaggggggggggggaaagggggaaaccccaaaaaaaaaacgggggaaaaaccccctaaagggttgttccctcccaaaagggggaaaaaacg

SEQ ID NO: 525991 - DNA, 177 bp, Homo sapiens
gtcctctgtaggctaaaaagatggtacctttgaattgtaagagtcatccctggaactcagatacatgaccttcaccttaaagcatgtggctctctctttaactcaggctggctgtgaaatttcagcattaagtcgtacagtggatttagtagtagcacaggtgatggcctttgactc

SEQ ID NO: 525992 - DNA, 224 bp, Homo sapiens
gatctctgaggaccccgaacatagcgaggctcgctctccttgccagcgtcaaagatgatgtctctgttgtgcctggatggtggaaatgcttctcagaagatagtaggggccactcggatgcagctcctcttatccagccttcccctgggcagggatggggattccctgctgatcttggccagggatgagtgcctgtgacgcccaggtcttgctgcaaagtttct

SEQ ID NO: 525993 - DNA, 161 bp, Homo sapiens
gtcggacctgcttacttggcgttgcccttttcctaacactcacaaagctacagtaatactaacatctcagacgctcagtgaaatatgaaagcgtctgaactatcctgccctgtcatcatcctagtcttcatcgccctctcatccatacgcccaggtcagca

SEQ ID NO: 525994 - DNA, 1168 bp, Homo sapiens
  misc_feature (187)..(187): n is a, c, g, or t
  misc_feature (308)..(308): n is a, c, g, or t
  misc_feature (341)..(341): n is a, c, g, or t
  misc_feature (353)..(353): n is a, c, g, or t
  misc_feature (391)..(391): n is a, c, g, or t
  misc_feature (411)..(411): n is a, c, g, or t
  misc_feature (470)..(470): n is a, c, g, or t
  misc_feature (478)..(478): n is a, c, g, or t
  misc_feature (560)..(560): n is a, c, g, or t
  misc_feature (615)..(615): n is a, c, g, or t
  misc_feature (648)..(648): n is a, c, g, or t
gcttctacataaaagctgattctgactgcgactctcgaaagctgatctgctaattagtaataacatggagtgagtgacgagataacactaccttgcattccgttaactgtcagtttgcatctcctcacatgcaccagttccaaggggagtctcgtggatcgactcgttcccatcacctccacttagncccgtgttctcgctagcgaatataggctcgttctgacaagagatacttgcgtatgcccaagggtcaaccccagattgcagggaggcgttgaatagatcaccgcatttccctttctctcagnctatcgtggggaagccaatcatacgaagaccangggtcatccagntgcgttcatcgcgagctctccgatgtagtgtgtcaccngaattttggaggtagtggtntgtctgtggacattcttcgattcgccgtatgtatcataccacgctgttcggtaagagtntactgcgngcgttcgtggcatactgttggtgggagattatgtgggtatatgtgtgggccttcgtttgtccataaaagacgtgcctaagcncatttgcctatgtatgtgcccacgtgtaacgtggtcttttatgccagcctatatncatacgccttcccgtttctcttccccatgttgnttccgacccgggactggtttcccgtattcggttactctagaactcgcggtctcttcttacctacacacgtggtttaccaattcacaaaggcctatgttctaccctaacgtaagcagaaatcgagacgaacgataagtttggaacccaggaatttcccttgggacacatatatgggtacttggcggttgctaaatattccccccctaggtaactgtgcaataggcaattggtcgatggtatccctgtccagtttatatacttcattgttagcccatgattgaggttttaattttcaatatacgacttttctaaagtcctccgtctagttttaacttgattaaagtttccacgcatcgttgggggggggcacctgtgttaccgtttcggccctatcttttgagaggaaccaatatccgtaatttcggttgagacctaatctggaattcgcccacggcttctacatggggatgcgtggaatttccctagttggtccagggtggcggcatttccctcgttggcg

SEQ ID NO: 525995 - DNA, 540 bp, Homo sapiens
cactttggaaaactatgtcctacttaagctgaacataagtaagccctatgacccagtaattccatccctgggagtatatcagtatatgtgttcacataaagatatatattattgagtttgtaggtacactatttataatataaaagcactatttataatataaaagagtgaaaattacccaaatgttcatcaacagcagaatggataagtaaattgtaaaacatccccaatgaaataccatattacagtgagaatagattaactacatctacacacaaacataatgtttagcaaaaaatatgcaaggtacttcatttgcataaatacaaaactagataaagcaaatctatacaagatggcaggataatggttacccttggggcaagggtggtgactagatgaagacaggaggagggcttctggaatgtggcaatgtcctgttcttacgaggatgctagttggttgggtgtgttcagtttgcattcttctatatgtatatcatacttcaataaaagttcaaggagaatcatcaaaaaaaaa

SEQ ID NO: 525996 - DNA, 222 bp, Homo sapiens
aagatcgtctcatatacttgggacggctgaggcagagattgcttgaggtcaggagtttgagacagcctggcaacatagtgaaaccctgttgctacaaaaaaatgtaaattagccaggcacagtggcatgtgctctgtgatcccaacctactcggtgaggctgatgagtgcagcgcggatcactttgacgactacggacggttgcaggcttgcagatgcagct

SEQ ID NO: 525997 - DNA, 770 bp, Homo sapiens
cctgtgcctcgcgtctggcgtgtctgggcccttgcgggctgagtgggcgcccgctgccggccgcaggaggcctggggatgacgcggctgagaggggccggcccggcccgcccggagctgccgggtccttggttgggcggcggtgcccgggcgtcccctgctagacactgcagcccgcgtggaactccctggcgggactggttggggctggaggtgaacatggacgccctgctctcgtgcctcccttcccgggcctggcgctgatgggcatgcctgttggttgggtttcagggcctgccttgggcagaagtgtcactgatggactgaggtgctggcactgccccgtgctccccgacgggcctggtctaccagatcttcctgagcctggtgcccggccgactgtgcttggccgccgggctggtgtgccgccaatggcatggcctgttgtcggcgggacgagttcctgtggagggagcagttctaccgctactaccaggtggcccgcgacgtgcccctgacacccagctgtgccatgtcctggtacgaggagttccagcggctgtatgacacggtgccctgcgtggaggtgcagacgctgcgggaacacacagaccaggtcctgcacctcagcttctccataccgggtaccagttcgcgtcctgctccaatggactgcactgtgaaggatctggagcaacgaactgaccatctcgctgcttgcacaggtgcggacatgcgggccctaaaactggagctacacccagtatctac

SEQ ID NO: 525998 - DNA, 96 bp, Homo sapiens
gggcccttcctggcctggagaaggccttttacacacacacaacacatacacacacacacacacacacacacatatcacagttttcacacagcccct

SEQ ID NO: 525999 - DNA, 108 bp, Homo sapiens
ttggttataatggagacagtctcactctgataccccaggactgagtacagtgatgaaatcacggctccctgcagccatggacctatccgggctggtcttgaactcttt

SEQ ID NO: 526000 - DNA, 227 bp, Homo sapiens
ggcagtcgttgtcagccgcaagatatacagtaactgccggtcgtttgtgcctcatactagtaactcactatataggccctacctgcgacaagtactctcatcaacaaccgtctattcaccgtcccatagaatgtactaagtcaaactaacctcaaaacacatgataaccatacacaagactaaaggacgaacctgatctcttatactagtatccttaatcattttta

SEQ ID NO: 526001 - DNA, 238 bp, Homo sapiens
ggcctttgctcatgccttcccccacctgaaacacatccctatggcttccctaggatggctcctcttcattttcagacttaagctcaaaatcacatcctcagtcaggtgcagtggtcacgcgtctgtaatcccagcaattagggagaccgagacaggcagatctcttgaggtcaggagttcaagaccagcctgtccaatatggtgaaaccctgcctctactaaaaatacaaaaaaaaaa

SEQ ID NO: 526002 - DNA, 1018 bp, Homo sapiens
gcttactgagacgggttgtgagaacttaactgtggggggagacagggctatctcagatacctgaatctcccgataaagagagtccatggtgcgcatgtacttgatgtgagatctcctcccgatcccgggcgtgcatcatgttcaaactgtctgagtctacgagctgtggcttagtatatcattgactaagaatcagtttagagataagtagaagttgttgactattttctaggtgcgatgtaatgggatttatttctgggtgaatattctatggcaaccgggtaaatggattatcgagaggtaggttatctgaagctttcatagattgcatttgtggaagttagagcattgaattcaccggtgtagatcctgatagaaatgttcctcattagaatccatgcatagcgtttgagctggttggggcacatggatcgagtgcccctaggaatgggtattcaccttgtgtttctgaagcgggaatagcagagttgtagaggtgggtcctagtcgcatgtctaagagaaaactttcctgtacatatggatgcagccaccaaatgttccattctttttgggcatgaagagatgaagatttaggattaaattccaggaggaaagtactgaattagagagaagatcaggattatgaacttcttcatttgttcgtgcaatgacgttggtgagcatagaaagagagggcctaccaagatctttgtagcgtatactagcttatgcatatgtagtaaattgatgttaaatactgggtttgcacttggaaacaacattaaagaggatttgacaaattacttaattaagccatgttaatgatatggtcatctcaaggtaaaatggaggtggaatgacaactaagcagtgcaatttagtttggtgactgctgatgggaattctccatggggaatcaaacttgggggttaggcattttggcgacggactggagtggggggccagaggggctcgggaaatctcttgggggggggaataacaggagtgggaggaac

SEQ ID NO: 526003 - DNA, 812 bp, Homo sapiens
gccgtgagccggccgacgtctccatgcccggatggttatcggtgactatcgttcctagctccggcacctatccagtcctgggcagcgcgctgagccccagcaccacgccgcaacttctacgcctcgttccccgggcatcgtgtatgacacgcggctcctctgccgttgcgcctagcggagcaagcagtgccccggggttgcggactattgcaaggatctcaggtggacttctcgctggcagacgacatcaagaccgagtacaaggaataccagcaaccaaggagaaggctggagctgccacgagcttgaaatgaccggcgttcggccgaatcttacatctgacgaaggtgtgcgcatttcacctggagtcagcaatgacataatgatccttgctgcgcccgagcgtcacagcgaggtcaaatgggccaaggcaaagttcgcgcctggtgggaaccttctacgaagggaggagattgcgtggtagctgcgcccgtgatatcgttggtaccagccgtaaccaatcgagcaaagcgccgcgtatgaagtgtgaaagcgtggacaaccttggagccaggaacaataatccaggccatccggagggatcaaacattggctagggaagcgaagaatgggctatcaactaggaaacagcgaacagtcggaacaccatgatcatttgctaagtctgtgctaaaacgagaatagtttgacaaattgcgttcctctggggacgggcctggggacctgtaggaacggcgaaattagggaaatcatatgctaagaaagaacattggcctctttgagaagcaaac

SEQ ID NO: 526004 - DNA, 467 bp, Homo sapiens
  misc_feature (10)..(10): n is a, c, g, or t
  misc_feature (31)..(31): n is a, c, g, or t
  misc_feature (58)..(58): n is a, c, g, or t
  misc_feature (68)..(68): n is a, c, g, or t
gttacaaaantttataaagcaaaacctgaantttgtccacttgtaaaagggttataanggacaaattnagaaaacagattttgattcccctaaacccatgtatttcctcaagcctgcctttccttgtgacccattttatacctacttcaggctccctgatttcaaatacatttttaaagcaccctaaataggcccaggcatagtggctcacacctgtaatcccagcactttgggagactgaggcgggcggatcacctgaggtcaggagttcgaggccagcctgggcaacatggtggaacaccatctctaccaaaaatgcaaagagttgggtgggcgtgatggcacgtgcctgtagtcccagctactcgggaggctgagatgggaggatcgcttgagcctgggagatggaggttgcagtgagctgaaatcgcaccactgcactccaacctgggtaacagagtgggacc

SEQ ID NO: 526005 - DNA, 549 bp, Homo sapiens
tgggggaaacgcggagtgagtttttccgtgctgatgtaggggctaacaatggacacccagaaggatgttcaaggctccaatagtcagtcaagcaatgatatatatctgtggagagtgtcacacagaaaatgaaatataatctatgggagtccgaatcagagtggcagagaagtgtggataccgaataatgtacaaagaagaaggactaagagagataggtcgtgttgttgatgctcgatgaatgctgggagagttcagaggagatgtcttcacttatatcttggatttgctctcttcccatgtctgatggtgtatagctttcgattccgcttacaggtagttcccccttatcttcgggcagatacattccaaggcccccagttgagactccttgaaaactcaagacgagtaccgaaacctttatagagcgtgtttttgttccatatatatatacctatgataaagtataggtgtataaattaaggcatagcaagagattaataataatgtaatagaacaatgataacatactataataaagagttatgt

SEQ ID NO: 526006 - DNA, 141 bp, Homo sapiens
ttcagttgagtagttgtctaaactagtacactgaagtttattccatctatgtgaagatatgtgagatatcacaggctacagtatagtgggataatgccagaagtacatttagtgaaaatatgcggcccacatgaaagttac

SEQ ID NO: 526007 - DNA, 598 bp, Homo sapiens
cccgcgggggggggaagccccccccctgttttttcctccaaaaaccccgggggcctttccacctcccgtttttttcttggccgggggggggtattaattttcccggggcacactttccccctttgcctctttttggggcctctataaccaatttgttccaaaaaacagggggggcccgggccggattttccgggatttttttaccccccggggcccccccccggcccctttttttgggccccctaaaaaaacgggggtccccctgggccccccccgggggtttttttttccccccggggggcccctggttttccctttggcccccggggtgggggggggggggcccccttttgcccgggggtttttttggggggggggccccccccccccaaaaagggggcccccctttgggggggtttccccaaaccccccccggggggggggggggttttcccccccggggtttttgggcgggggttttttttttttggaaaccccgggggggttgttttcccccctttttttggggggccccccccgggggtttttggggggggttttttttttttgccccctaagggttttttggggtttttta

SEQ ID NO: 526008 - DNA, 167 bp, Homo sapiens
tccgggagacacaggttgtacgggagggcaggcggtccagccagagggtaggaagaacaggttgtttacctggatttccataggatccaggtctgaatgagtgctgggtggggaaggggaggtgcagggaatgaagaatcctatgcctgctgtcgggctagtcgggg

SEQ ID NO: 526009 - DNA, 1704 bp, Homo sapiens
  misc_feature (297)..(297): n is a, c, g, or t
  misc_feature (385)..(385): n is a, c, g, or t
  misc_feature (1318)..(1318): n is a, c, g, or t
tggataaaatacaagtgtgggccccagaattcttttaacgtcaaggaaatgaataacagcgtgggtcagagaactttccttagtggaaagaaaagaaatttttatagaatactatcattgagggtgtggatagtggataatagaatatattctcagaaatagcagaggtgggtggttatagtcttactccattatcttatagggcgtgcgtgcaagaaaattttatagagggttaatagaaataagagccgtggtgaatattttatagtgccaaagaagctgtgggctctcataggnatatttgtggagcggagcccacaaatatacgaggagaaatttatacaaagaggtggatctgtggggtaaaaattcttacaactagcgnggctcctcgtggttctctctcacaagagtatagagtgtggtgtgtggtgattgtgtggtctcctctcattagcgtggcgaggtggagtatcaaaacagagaaaaacagagaaaaacaccaacaaacatataaattatttaaaagtgtacggtgtctccaagtgtgtggtggggtgaaaatgtgtggggttatatatagaagtgcccaaatataaacacactttataattgtgtgtgtgtgtgcatattaaaaaaacacacacaaaaaagagagggggggcggggcgcgagcgactcaaaaagaaaagaatataccccccgcgaggaggggggccccccaagagactctataagcgcggtagataccccccgagggattctctcgtgtggttcacacacggggggggggctccccaatatatgagcggtgggagggggcgaaaatatataaaaagaggcgcactaagaggacacagcggggggccgcgggagggggtatatacacccaaagcgtgtctcgcggcgggacactgcgtggggcaacaccacgcgggcggcataaaccccctcggggggcggacaccacctcgtggcggggacaccaaggaggaacaccccttttaatactctccggtcggggcgggcgggcgggagcaccccacaacagcttggggggcaccacaaaatctttccatccccacaacaagagagagaattttatcaaaacgacggcgccccaccagcggggggcacacactcatttcaacacaacaacttttctacaccaacccggcgggggcgcaacaacgggcgctcggtggtcaccaccaactcacgcgcgaggcggaaaataatagacctgcaggcgccaggcggttcttgagaaaacaacactatcggcacggcacacaacgcaggcaggaagaagtcaacnctctcagtgagcgcagccactaatttttatacccaggagggcgcgcacaccactatactatcagtacatcatacaaccagcactaaacaatacaaaaataacaaacaacacaacgatcaaaaacaaccgaaagacatgaacgagaagagtgctgaagaaagagataaagatgaatccatcgacgagtcaggatactacaaagagccagacgaagagtatacgtaacaagtagtagagaagcgcgcaagggttgacgaactgcagcgaaggaaaagacagacagcaccaagataaagaaagaaaacaattattaaacaaacatacaaaaacagagaaaatagtaacaaagaagaaaagacacacacaagaagaacaaatacaccaag

SEQ ID NO: 526010 - DNA, 494 bp, Homo sapiens
agtgcttatgctgtgcccttctgctgatctccagcatcttgatggcgtacactgtggctctggctaactcctacggactgcctcatctctgagctcaaactgtcagagagacgacggacggcgcagaataaaggtcttacctggtcacgtgcgcgctcgtggcgtctgacctccgaccaaacctggctcttatgacccccgacagtccactgtcccagctttcatgaccccacgtgcttcagtgcggactctgcaagcactggagcttgtctgcctggacaattgaccacactcgaacgagcttggcgccaatcgaggaaccaacatagtgccgcatccccattgtctacagaagactgaaaggacttgttggtgactgaggaacaagatgtatcccaatgggccatcagtgcggctcagagacagcaaactgtctcatccccatctcaggatgtacttccccatgtcctgctcgatccactggtacatgaagc

SEQ ID NO: 526011 - DNA, 477 bp, Homo sapiens
  misc_feature (27)..(27): n is a, c, g, or t
  misc_feature (36)..(36): n is a, c, g, or t
  misc_feature (62)..(62): n is a, c, g, or t
  misc_feature (467)..(468): n is a, c, g, or t
tttgcctgtttaaaaaactcccccaangtaatgccngaataactgccctaatgttttttaanggcaagaaggctgtgaatgatatgcccttttgtggaaaatacatgtgttagaacaagtttccatttaggcatgagttaatagtgctgctgttcgtgatctcaatattaatgaatcaacaagatagcccaggcatggtgtctcatgcctgtaatcccagcactttgggaggctgagacgggtggatcacctgaggtcaggagtttgagaccagcctggccaacatggtgaagacctgtctctactaaaaatacaaaaaattagctgggcgtggtggtgcatgcctgtaatcccagcttgggaggctgaggcaggagaatcatttgaacctgggaggcggaggttgcagtgagccaagattggccattgcactcccagcctgggcaacaagagtgaaactccatctnngaaaaaaaa

SEQ ID NO: 526012 - DNA, 908 bp, Homo sapiens
cgtaggggcacaatgcgagctgctgctctgtggctgtgccttcaccctcgctgatgtcctcctgggagccaccctgcaccgcctcaagtgcctgggactgtccaagaaatactggggaagatggcagccgggcaaacctgcagtgcttctttgagagggtacagagacagctttgccttccggaaagtcctgtatgacagccacaccaccctgctggcggcgcgtaatcccctttgttgtacgggtgggcaagaggaaatatcgcatcagccttgtgcgcctgctcgccttaaggaatcactgagggggatggtctgcttgcgccgagccaggtgcacaagcagcagtgctgtgcgcgagtggagaacgggaatatggcgtgcggagcggtatgcaagtaaagggacgggtatcgtccggcccacgtgatatttagccgcggagcgcgagtgctcgattcagacctataagaaatctacatgtgctgatattgcatgtagttttgaggtggtgtgtatgagatgcgtattggtgcataaactttagcttgatacgcgaagtagctaggtgagccgacggtcgtacgtcgaagtgtccagcggcgcggtcgctaataatcgatgatttgggcaattctcaatgaatatatgtttgtagagggccggcgcgacgcacgtagaagataggtgagagagcgggccgagtgtgcgggcgcgcgcgtgagatcgggtcagtcagtaatgctggggcggggggagactattatgcggtagctgaggcggagagtgcagtgatggatggaggtactgtgcggtagatgggctgctgcgtagtgcgaaatacacgccgtctgcgcgggtgctgacggtgacgatcaaccgttgaacaagtgtaagctgaacggcgag

SEQ ID NO: 526013 - DNA, 113 bp, Homo sapiens
cccgacacccgacagcatgagggagatggggtaggtggagttgagggagatggggtaggtggagttgagggaactgggcagggcacagtcacatcctgtcgggctagtcgggg

SEQ ID NO: 526014 - DNA, 284 bp, Homo sapiens
gcctcagatacactttctcattcttccaaacatcaggctgggatgccattctgtcacacattttcccctgccctcaggcatgtatacctgcaggcaatcaaggtcacaggcacagcatgtcagccacagtccagcctcatggctttcacgtagctcagcgtggccatggcatcctttcacaggcacagccaggcagcggcagtatggcgcacagcagcagcgcacagggcgtcgcacagtatgactcatcctcttctcacacagcggcagcagctgcatatttc

SEQ ID NO: 526015 - DNA, 221 bp, Homo sapiens
cctgggggttttcctcacctgaggacccttcaaagcccccctttttagtttgcatttcctggggcccacatttaaggcataacagcccattcatccctttggtttggggtttcaggaaaacagtcccatgcaaaaattttttggttttagggcttttttccctttttttaccccatcctttcccataagcacccatgtctttgaatatgaatgtatttgta

SEQ ID NO: 526016 - DNA, 237 bp, Homo sapiens
  misc_feature (40)..(40): n is a, c, g, or t
attcaattggacgaacgattaattcggcgttgcaactttnaaaaatggggtggtggtgtcggcattaacgtgtcgaacttgcgtgaagcaggggctcccacttattgggatcgccccttcagcaggtggcgttgtgcccctcatgaagttgttggaagactctttcacattttcatcacaagttggggcacgacaaggggccgggtgttgtctatttgtcagtgttccctcccgaca

SEQ ID NO: 526017 - DNA, 860 bp, Homo sapiens
  misc_feature (17)..(17): n is a, c, g, or t
  misc_feature (81)..(82): n is a, c, g, or t
  misc_feature (84)..(84): n is a, c, g, or t
  misc_feature (86)..(86): n is a, c, g, or t
  misc_feature (99)..(99): n is a, c, g, or t
  misc_feature (103)..(103): n is a, c, g, or t
  misc_feature (113)..(113): n is a, c, g, or t
  misc_feature (123)..(123): n is a, c, g, or t
  misc_feature (133)..(133): n is a, c, g, or t
  misc_feature (135)..(135): n is a, c, g, or t
  misc_feature (142)..(142): n is a, c, g, or t
  misc_feature (176)..(176): n is a, c, g, or t
  misc_feature (180)..(180): n is a, c, g, or t
  misc_feature (186)..(186): n is a, c, g, or t
  misc_feature (222)..(222): n is a, c, g, or t
  misc_feature (239)..(240): n is a, c, g, or t
  misc_feature (244)..(244): n is a, c, g, or t
  misc_feature (270)..(270): n is a, c, g, or t
  misc_feature (278)..(278): n is a, c, g, or t
  misc_feature (293)..(293): n is a, c, g, or t
  misc_feature (324)..(329): n is a, c, g, or t
  misc_feature (361)..(362): n is a, c, g, or t
  misc_feature (375)..(375): n is a, c, g, or t
  misc_feature (420)..(420): n is a, c, g, or t
  misc_feature (484)..(485): n is a, c, g, or t
  misc_feature (524)..(524): n is a, c, g, or t
  misc_feature (527)..(527): n is a, c, g, or t
  misc_feature (772)..(772): n is a, c, g, or t
  misc_feature (797)..(797): n is a, c, g, or t
  misc_feature (839)..(839): n is a, c, g, or t
ttattgttgtgtatttnctcccctttttgcaatactatctatcgctgagttatctattgccaactagcaccaattctccanntntnagtgtgtgagggnaacncactcgtgcnatcctctttnacagaagatncnccaagtnacctgtctgtcttcttctgttacccagaaataangggncttgangggctgcttggctgggggggtccgggtgggggagcntcctgccctcagtcggnntccntggtgaacagctgggtgtcctgtggnttccagtncaggccgactgctgngttgttgacaagagaccagacattgggggtnnnnnnctcctcgggctgctcctcttccacatttttgnntttcaattctggnaatttcttcagtctgtctttgggcagcgcaacgacgccttgcttnatgatttccaggacccgttccactgacagctcagctccagcttgcagcaaccttgagctaaagnnggggatctccaggtcaattttttgctttttttcctgatntgnaggatgagttcggaattgttcaaagagatcgcgtttgttaagcagggcgttttccaagtttgggttgtggtgaagggaatttgtcaggcaggagttgatgatctctaacatcattcgaatcacttcttcaatgacatttaggtcttgtgcataatctggtagaggaacatcattagaactcagcgaacctctcaaggactgtgtggcttgttccagaactttgttgtgttttttagacagcaaanaaaataaactgatgatcctctgggnagcatactgatggagagaacgaaactgtgccgacatattttnctaagctgccaaacaatttgt

SEQ ID NO: 526018 - DNA, 419 bp, Homo sapiens
gctacatgagaaccatcatcgtagttagtatgctgtctggaggtttgtacagagcatcactctcaccctgcaggtgtgcgtagccctcagctccctgcagagaatcacgctgctcatgaaggttgtggaagggcacgcacccttcagtgccacctcgctgcagaggcagatctaagctagtagcatttgttgcaagcagtccttccgtcatgggacaagaccgaaagggtagagggacatgaaatgcctcatggaaaaagctgttagatactaggggaagctagatcaatatgtgctcctctgacgtgccgttactcagaggtgggtggccgtctcccttcctctgtaccctggtgaagagcggtgcagtgccgtcactcaaaggtgggtggccgactcccttccctgtgtcctggtaa

SEQ ID NO: 526019 - DNA, 234 bp, Homo sapiens
  misc_feature (78)..(78): n is a, c, g, or t
cagataaatcgagccggtaccctgtcgataaaagcaatctcatcatgcaccatcggcatttcgtcagcatggtaagancatgcctcccaagacggggcttatcttctactttaaccggttcatctttgtgagagtgacaggggaggctttggttaacgcttcttgttcttgtttcgctgtgtgttgagtggctcgatctatattagagctgggagaacacgccgccaggctaag

SEQ ID NO: 526020 - DNA, 438 bp, Homo sapiens
ctgagacgctggaagagactgcagcagagatgagcacttgtgagctctgcaagtcatgtatctagaggtatgcgactctgcatgtactaagtgttattctcttcaggaagtgaaccttccctggtttaccttttttctgggaaacagccaactgcactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcactcttttatcctaatgtaaatgctttatttatttatttgggctacattgtaagatccatc

SEQ ID NO: 526021 - DNA, 276 bp, Homo sapiens
  misc_feature (99)..(99): n is a, c, g, or t
ccggcaggcaggttgtcgggaggagacagccaaggatagtcaaagcgcgctctcctacgcgcagctgatcgtgcaggcatctcctccgccaggaccggncagctgacctgagcggatctacgccacatcaccaagcatataccctactaccggacggacgacaaaggctggcagaattctatccggcacaacctctctttgacgcgttactttatcaaagtcccacgtcccccggaggagcctgggaaggggtccttttgacgagacctcctgccg

SEQ ID NO: 526022 - DNA, 328 bp, Homo sapiens
gaccttgtcatgtctgcattgtcatgtctatgatgatcccatcgcgaataaggctgtgcagaggaagactgccctggcagtactgtgagtgagacgttggatgctctctcggcacagttcttctctcagcatagtgcaggacacgtcatgctaatgaggtcataaagagaacgggttcccttaagagatgtcatgtcgtaagtcgctctgtctatttggaagctctctacagtccccccaaaatatgaacttttgtgcttagtgagtgcaacgaaatatttaaacaagttttgtattttttgcttttgtgttttggaatttgccttat

SEQ ID NO: 526023 - DNA, 150 bp, Homo sapiens
  misc_feature (39)..(39): n is a, c, g, or t
taatacacacacacacacacacacacacacacacacacncacacacacacacacacacacacacacacacacacacacacacggtcggggggatagacagcaatgtccgtctatccacatatggcccagtgtgtgacctggcagcagtgc

SEQ ID NO: 526024 - DNA, 547 bp, Homo sapiens
cagaggatccccgtgggagagggggtctcaggtttgattgggctctctcaaaatgccaggaatggatttattaaattaatccatcaacctcgcatagcaaatatgggagaaaacaaatttatattcagattcttatttacagtagggaagtaagaagtggcagctcagggcacataaagtggagacagagagggagacatccagccccacctctcgggaacaggaaagaggaggggggaggaaacacaagtcagcaggggaacaggggtcacgggggacaggggggtgggctggtctctccacctcctcacattatgctaacagggacgcagacacatgcaggtgccttggcagaaagagatgccagaggctctggaagtcacaagggggaggcgtgaagaaatccggcatctcagtccctcacaagacagcggtctcaggctttccaggcggtgagagacacatcagagcccggggcacggtcgcggcacgcagccggagagtagctccctccttttccaccggagctcttcctcctacacatcac

SEQ ID NO: 526025 - DNA, 216 bp, Homo sapiens
cgagagtgcgtcaatatgttgtcctaggaagcattgtagtggtgcgggtgttatataataatgtctgttgtatacggctcggcctcctcatctattctagccacctctagcctacccgtatactcaatcctctgcatcaggctgcagcatcaaactcaaactacgcccatgtatcggtgtactgtgagacgtagaccctaaacaatctcatatgaa

SEQ ID NO: 526026 - DNA, 892 bp, Homo sapiens
tatgagggccacgggtctgtgttcgacttcagccctcagggacagacttcttgacctctctttggccacagaggacctcactttgcccacaccagggggcagacccctgtcacagccctcaagtcacctcccaagccccctcctttgtctgtgcactccggggggcacgcctctgtggaggggggattgtgcgtgggagaacttggcgcgccatatcgccggggactctccaagaacccgcaaaaggcctctcccacagcttcacccctgtgtgagggacgggcgcggctctcctcatattatgcacccaggggctctcaccgtgtgtgggaaaccccgcgcatccacaaccacaccacggcacaacaaaataaaagaatcgtgcgcccacaccttcacagcccttcacaaaaacaacaaaaaacaaaaccaaaaaaagaagaaaaagaaaaagaaagagaagaaagacgacagcgcagagagaaaaaaaggcagcgaaacaacagcggcaaggagaagcgaggaagaggagcacacagccggagaggggagagcggcagaaagcagacagagagacaagagcgagcacacagagcacgaagacgacaagcagaagagagagagaagcgagcagcggcgcgggagaggacgacgaagcgagagcagcgcagggcgcggacccccacagcggcaaagcgagagagcgggcgggggcgcggcgggcaggggaggcggagcgcgcggaggaagagcaaggaggagccagccgggcgggcgggtggcgggacgctcgcggggaggagcggactcgcgggctcggggaggggggaggaacgagcgggcggggagcgcgggaggcagggaggggagagggaccggcggggcggggggg

SEQ ID NO: 526027 - DNA, 855 bp, Homo sapiens
tacaacgtgacaggaagaggagggagagggtgacgaacaccaggcattcccaggggctatattccactgttggtggttgcttggtcctgttatatggtgggtggtccatagttttggttgaagctctagcttaagaagaaactttttttaaaaagacggttgggggattcttttcccttattatatactgattctacaaaatagaaactacttcatttaatggtatattatccaagcaccttggttgaagctcaaaaaaaatgatgcctctttaaactttagcaattataggagtattatgtaactatcttatgcttcaaaaaacaaaagtattggtgtgcatgtgtctataatatatatatatacatatatatctttatacacatacaatttatgtttccgtgtggaagttgtattttatgagatttcacccagaacaagagaggcagataaacgaggcattccatagcaggtgctttggatcacttacaaatttttggaataacacaaaatctcattctaccgtgcagtttaatgggcaccagatgctgtgtcgttgagagtatgtatgtcgtgtgtgtgtcgtgtgtgtgttgtgccgcgcagcacgcacgcctttgagccagtcagcatgggcccgtgcttgggagaggtatccctttataaaaatctgcgtcatgtggatttccgtcacaggggctttcaacttggctcgtcgccaaaaacatgggaggccagtccttatcggctaagaaaacaggccgggaatctctcctctctcttctcaccccccggtggcgacccctctgcgatattgccccaaccggggcgtcttggaccccccactaaaggcgg

SEQ ID NO: 526028 - DNA, 942 bp, Homo sapiens
ctgtctgagtgccgacgtgtcagcgcctgtcctcgggctggaaagggcagagcatgtgggtgaggtgagccagaagcccaggtaagcaccattggtgctgggcaggccagccagctgcaggcatcgctttcagtggtgcagaagatccagacccagcctcaaggaatgggatggtccagagtgcctcagtgatggaccatgtgggcattgccaggaggaacacccagtggcgtgcggaaatgaattattatgctaatacttccaaagaacgaacctgtcaaaggttccatgtttccaactgaacccatgttcctccactactacttggcattttcttccaccacggccgttcctgtagactagccaagatcagttcctcctccttctgctcctcctcagacccacgttgacgtgaagacgacgaggatggagaccttgatcgtgccccactcccacctagaatgaatagtctgtagattttctcttccttaggactttcttcataacattttcctttctctatcttactttattataacaaatacagtatataacacagatgcaaattatgtgttaattgagtttttatgttatctgtaaggcttccagtcaacagttggccctcaggagctcagttttgggggagtccccacggttgtatgagtatttttcactgtgtggggatccagtgcccataaacctcaggttatttaacggtctactggtataaagtaagtattgcgctcctaattacaattagcagcttacaattttttgtggccttagcctggtacaagtgcttcatatgctaacaattactttttacccagcccgtcttttgttaaaaacgatccctcatttttttttctgttccccacttacatggcataaacaggggatacccgaggcacaaacaattttctcacctggtgcacaaaaccc

SEQ ID NO: 526029 - DNA, 367 bp, Homo sapiens
ggtcatagctgactctagaggatacaaggacgtccagtagatcttgcctttttcctagacacgtttcctgccgtcctagccaagtagtgggccttgttactctgtgcatgaggtgcatcgtgagtagatcccttctacagacagtattcagtttgggctcaactgcaacatgggacccaagcttcctctcctcctggtactccctactgtgacatcataatctaggaacttctctctgcttagagatcactgaacacatcagcctgagtcatacacttgcctttacccttactattttctctacctaaagtgcttatcttttccttagctgccccattcactaaaagttcacaaatagcaccgattt

SEQ ID NO: 526030 - DNA, 174 bp, Homo sapiens
ggcacgagggcgcgcgccgggctgattcatcgagcccctcccttcactttccgctcgcgttctccggctgggctcccgctccgctgaccgacctgccactcatgactgaacacgccatctgcttcgccaaagacttcatggccggaggcatcgccaccgccatcttcaagactg

SEQ ID NO: 526031 - DNA, 421 bp, Homo sapiens
cctttctttccgtctgaattctgccatgaggaaagccaacacggatgcatacaagtgcatccacgaatctatggggaaagaagcagtgggatgtcatgcgctttcatctgagggcaccctggtaggagtatccgacagctgtatgctctctacagacttgaacgtcctaaccggcctgaataagcgcgctaactgtggtacaaggccaagataggctacgttatacataggatctgtgtgctgcggggaaaaggcgcccagttcctaatggagcaacttactgggagcctgaacatcatggctgtaaacagataatggctactctaaaccttgaaatcgttgatgaagaacgaggtgcacgccacatgggcacgatgacagtccggaagttttactgactgggccatgtgcacagactctt

SEQ ID NO: 526032 - DNA, 336 bp, Homo sapiens
  misc_feature (85)..(85): n is a, c, g, or t
  misc_feature (92)..(92): n is a, c, g, or t
  misc_feature (139)..(139): n is a, c, g, or t
  misc_feature (196)..(196): n is a, c, g, or t
  misc_feature (258)..(258): n is a, c, g, or t
  misc_feature (300)..(300): n is a, c, g, or t
tgtccgaggatctcaagctttacgaggatttggtgtgcttaagagactggaaatgtttttaaagaatggataaagccaaagaacntcagccnagagaagctgcataaatacacataatgcctgctctgcatttactaanttgttcagtttaaatagtaaactttttactcctgtggaaattttgccaaacgtttcnatacatataagattataaatcttaatactaaccctgcacagagaaagaccaagctacttctntttttttttttttaaatacagtatctctacattctatcattntcagacccctcgttaagctggggtcccgagctcgaa

SEQ ID NO: 526033 - DNA, 128 bp, Homo sapiens
cacatagatattggtctgcactctgcgggtcatgatttccatcatcttcttccggattgggcggacctgtagggctgagcataagaggtctgccggtatctgattgtgcgttattattagtaaaacca

SEQ ID NO: 526034 - DNA, 689 bp, Homo sapiens
gtggcttggggattgtaccacgggaccagctcacgtaatgcattgcctgtaacaatgtaataaaaaagcctctttcttcttaaaaaaaaaaacaaaacgacaatcaaacacaaaaatttgttgcggcgggcctcgcggcgctcaagaaaaaaggtttctccagacccccatttctgttgggggcaggcgcgggccccccagttgagttatatgcaacaatggtgggccaaaaggtggtgcccaaggaaaaaaccggtggtctgcaacatgagctggtctggggttttccccccacaataaaaaagaagccgcgggggaggaaaaccaagcagggtggttttcttggagcacaaacacaccccgcagagaggggagcgttcctcacgaggaaacggaccaaaacagggggggatctccaaaacacaagagagggggtgtccccaaacaggaggaaggctcttgcgaaaatcaaccaaaaatataggcgccccgcccgctggtgggtgattatatcatctacacaaagccgcaactcctactagaatagtagaattgaacagacaaccgaatacatagataatacacagcatagcactaatgcacagcacattgactatagaacgaacaatcatctgtaataaaatccataaaaatcaaccacagaacagcactccacatacctacaagcc

SEQ ID NO: 526035 - DNA, 415 bp, Homo sapiens
tgctgctgcacaatcaacctcagtggacagaaagacagtggcatcagtctggagactggcgtgtatgctgccgctgtgctgcctggaagccctgctgctccagactgtgtcccttgctgtgggagacaggatctgttgctgcatcaatggcattgcactggacaacaagtctctgaatgaatgtgaatctctgctgcggagctgccagtgactccctgaccctgtccctcctgaaggtatccctcagagctcctcgtggagtggccagaacatttttgcaaatatcaaagactctgataagattgcttgcgttttctgagcccatggcccggagttcccaggctcatcccaaacggaactggatacagcacaataactccgctcgatgagcactccctggggctcctctagagtc

SEQ ID NO: 526036 - DNA, 283 bp, Homo sapiens
ccggactctcctactgtatctagcacttagggaggctgaggcaggagaatgctgaacccgggatgcgaaagttgcagtgagctgagatcatgccattgcactctagcctgggcaacaagagcaaaactccatctcaggaaaaaaaaaaaaaaaattgcaatcctgttttggccatcttgtggtggacctggtctgtttttaaatttccttccatgactgagttttttttggccatactcaggaaatgcctttcttcatgttccgtgtgtgctaaaaacgcttc

SEQ ID NO: 526037 - DNA, 519 bp, Homo sapiens
  misc_feature (252)..(252): n is a, c, g, or t
  misc_feature (274)..(274): n is a, c, g, or t
  misc_feature (359)..(359): n is a, c, g, or t
  misc_feature (399)..(399): n is a, c, g, or t
  misc_feature (406)..(406): n is a, c, g, or t
  misc_feature (415)..(415): n is a, c, g, or t
  misc_feature (458)..(458): n is a, c, g, or t
  misc_feature (480)..(480): n is a, c, g, or t
  misc_feature (494)..(494): n is a, c, g, or t
gagacggagttttgctgttgttgcccaggctggagtgcaatggccgttctcagctcactgcaatctccacctcctggcctcaagtgattctcctgcctcagcctcccaagtagctgggattacaggcatgcaccaccatgtccagctaatttttttttgtatttttagtagagacagggtttcatcatgttggtcaggctggtcttgaactcttgacctcaggtgatccacctgccctggcctcccaaagtnttgggattacaggcgtgacacncacgctcggctttaattatatttctaaggcaaagagcatcctactaaatctttggggggcaccacagtgctttgggcacccattnactaggcatatatgggcaggttacttcaattaaatatttngttcatntggcaatanttaaatggatccaattaggataaatgttttcccaacctaagtngggtatttaattaagggggccncaaggtttattccntttagtgaggggtaatttttaggct

SEQ ID NO: 526038 - DNA, 1362 bp, Homo sapiens
  misc_feature (628)..(628): n is a, c, g, or t
  misc_feature (1226)..(1226): n is a, c, g, or t
agcatggcgcaagtagcctagctggagaggctcgcccctacggagggagggaggccaccgacctactgggctcgatcggactccctcactggttccctgacgcttggttgccaggcaggtgacagcgcgtccatgcgagccgccgcgagcgtgcggggcgaggcccagggcccaccgttgtacatggtgcccgtggtggctggcggctgtcatgggtcgcatggtacgacttgctaagccacatcaggcacacaacaccagtgctatcatcgttggccgtgtcctcatcttgctgagtcaggcggtgaggaaacgtgtcgcctagcatcagagaagctagtggggcccaacgaacctacaaaggttgcccaacttgggcaccactgaacactgctcctttctgcactgagtggggagggccatcaaagccgtacactgcagggcggtctataatgctgtgacacccccaggtagtcagtctcactctcagtcggtactatgagcccgcttgaacactgggtcccttaggggccctggtacttcacagcgcctgtcgactttccctgacacgtggagacggtgctcctagtggtcaacttggctttggggattgttcgcgcaacgatgnaaactcgttgcgaagtctcatctatggggcgcaagcgacccgggggagagggaattgcctggccaggagacaacggtcgctggggacgtcaatcatcaccgagttccggagatccgacaaagggggacgttgcatggaccagcgcggtgcattggaggcccgcgctctagtaccgggaatcattgggaagtacgcgcaacgtgtggcacaggaaccccgatggttggattggcgagattggcaggccaaaagcataggaggctacgcggaaaccacactaggcgacttcgcttgcgtagactcgggcccgggggatggtaaagttccgaagggggccccccatggagattgatagatgtagggggcgccgaagccgtccagataccgaaccccccattgggaaaccctggggtgggcacattacccccaatgaaaccacaggcacgacattaacggcttccagcaagaagcaacagcgcccaggcagcattcgtaactggacaggctttcatggaacagccttcaccgagcgaaaggcaaccaatggccacggcgtttcacagtaggcatgtgaggacgcaacagcccatggggcggnatatcaattggtgtccaacaggggacaggaatgcaagacgcaccccccgatgggcaataccccgttctcttgatggagcgcccttgtatcatcaaaccgatccaggtatatacgccagggaactggagctaaacca

SEQ ID NO: 526039 - DNA, 280 bp, Homo sapiens
aaaatttttttggaaaaggggggggttaaaaatgttaaaggggggttttttttaaaatttggaggttttttccctatattgggcccatttacccctaccctttttttggggggtttggggtttgggtaatctggttaaaaattgggaggagaaggggtttattttccttttttttttttttagggggggaacggccttttttaaaaaggggtttttttgtggttttggggcccccccttggtaaaaaaaaaaacccccaaaaaaccccttggttccttta

SEQ ID NO: 526040 - DNA, 327 bp, Homo sapiens
  misc_feature (20)..(20): n is a, c, g, or t
  misc_feature (29)..(29): n is a, c, g, or t
  misc_feature (34)..(34): n is a, c, g, or t
  misc_feature (38)..(38): n is a, c, g, or t
  misc_feature (65)..(65): n is a, c, g, or t
  misc_feature (70)..(70): n is a, c, g, or t
  misc_feature (97)..(97): n is a, c, g, or t
  misc_feature (122)..(122): n is a, c, g, or t
  misc_feature (134)..(134): n is a, c, g, or t
  misc_feature (163)..(163): n is a, c, g, or t
  misc_feature (192)..(192): n is a, c, g, or t
  misc_feature (211)..(211): n is a, c, g, or t
  misc_feature (271)..(271): n is a, c, g, or t
  misc_feature (281)..(281): n is a, c, g, or t
  misc_feature (285)..(285): n is a, c, g, or t
  misc_feature (298)..(298): n is a, c, g, or t
  misc_feature (314)..(314): n is a, c, g, or t
gggggtatttcagccccctntttcggtcnttccngtcnagccccagccttgggcttgggctgccnacacntgggccagagcccctgttgtgattggngctccctgggcctcccgggtggatnaagccaggggtngccccctccgggagccctggggtgagccnccggggcccccctgttgccagcctccccngtccccaacatgcatttcnctttgggggttttggttttttattttttgtaagggtcatttgtataactttaaacgcccntgatagtagnttcnaactggaaatagngaaataaaataactcngtttgcagcccca

SEQ ID NO: 526041 - DNA, 939 bp, Homo sapiens
  misc_feature (826)..(826): n is a, c, g, or t
atgtggcccaatattactgcagccccttttttgctgactggttttccagggctggaggcagctcatcactggatctccatccccttctttgctgtttatgtgtgcatccttctgggcaatggcatgctcctctacctcatcaagcatgaccacagtcttcatgagcccatgtactacttcctcaccatgctggcaggcacagacctcatggtgacattgaccacgatgcctactgtaatgggcatcctatgggtgaatcacagggagattagcagtgtgggctgcttcctacaggcttactttattcactccctttctgttgtggaatcaggttccctcctggcaatggcatatgatcgtttcattgccatccgcaatcctttgagatatgcttccattttcaccaatactagagtcatagcgttaggagtgggagtgtttctaaggggttttgtatccatcctgcctgtaattttgcgtcttttttcattttcatattgcaaatctcatgttatcacacgtgctttctgcctccaccaagaaatcatgagactggcttgtgctgacataactttcaatagactttaccctgtaattttgatctctttaacaatcttcctagactctctgatcatcctcttctcctatattctaattcttaatactgtcataggcattgcctctggtgaagagagagccaaagccctcaatacctgtatctcccacattagttgtgttcttatcttctatgttacggtgatgggtttgacattcatttacagatttgggaagaatgtgccagaggttgtccacattatcatgagtnacatctacttcctctttcctcctttaatgaaccctgtcatctacagcatcaaaaccaagcaaatacaatatggcattatccgccttttatctaaacataggtttagtaggtaa

SEQ ID NO: 526042 - DNA, 613 bp, Homo sapiens
tgtccaagcgtagtacccatacgtttactaggaatgaagagtacagaatccaacggactttaactgttctgtccacgtgttgttcacaagttccctactatgtggtgcgagataagacactctctccaagacaaacaggaaatgtgataatggtaattacttacaaactgaatatagtgttgggtactacgctttggcatgccaaagcgtagtacccaaaggaatataaatcattctaacataaagacacatgcaaacatatgtgcattgcagcactgttcacaatagcaaagacatggaatcaacctaaatgtccatcaatggtaaactggataaagaaaatgtggtacatatacaccgtggaatactagaaaagaatgaactcacgttctttgcagcaacatggatggagccagaggccatcatcctaagcaacctcattcagaaacagaaaatcaaaactgcatgttctcacttataagtgagagctaaacatggagcacatatgaacacaaagaagggaaaaacagacaccgggacctacttgagggtggcgggtgggaagagggtgaggactgagaaactacctattgggtactacgctttggcaggt

SEQ ID NO: 526043 - DNA, 195 bp, Homo sapiens
cgctctgaggatcccaaagagtgtcactcaagacgtaggacctgagtgcccaaacctaccctgtgttctattagaaaccttcccctctggatacacgcgaggggctggaagccatgctcaaaaagcttcctcgtgatggcactgttgttccagaaatgccaaccgccccgtcctacgtcttgattgacactcttt

SEQ ID NO: 526044 - DNA, 323 bp, Homo sapiens
ggtctgcaacacattgtagaaaacattggcatggactgcccacggtgactgacgcctgtgtaatctcagcactttgggaggcggaggtgggcagatcacctgaagtcaggagttcgagactagcccgaccaatatggtgaaacaccatttctactaaaaatacaaaaattagtcgggtgtggtggcaagtacctgtagtcccagccactcaggaggctgagacaggagaattgcttgaacccgggaggtggaagttgcggtgagttgagattgagccactgcactccagcctgggtgactgagtgagactctgtctcaaaaac

SEQ ID NO: 526045 - DNA, 1939 bp, Homo sapiens
tggtagtagaatcagtaactgtgtgaggaagatcaatcatgagtacatgcgaagtgacccatttggtgagacttgattctcacataataaatgcagtcaattggctcctaatgccttgtacgtcactgagctgaccactgcgcgcgtgacccaggagtcaatcgagcatagtgcatgacacgatagagcagacaccatgataaccacaacgtgacatttcatcactattccatggttgtactcgtgactacgtcagtgtgtgtcctaggcccaaacctatgcgggtcattaccatttccacgtggctgaaatctcgaaaagagacagagcgaggtcctgtaggccataggtgaccttagacttcggaccagggagtccaactacatacccttctagcataattcttgttaaggatctcgcgtaagagataagcgtgtcccccaatttcacacggtttatcttgcaagtagggccatcttaacattggaactagttgccagcagagaatcagcgtgcaaatgcgtgcgcaattcacacaggcttgcggtagcaatgagctacgtagttgcgatcgactttagatcgcgagaaggacacgtttagtcccaccgaatgtgcgcgtccgaaattcgcaaagacactaggcaaaaggtcaataagagtggtatggggctataccgagtcggaattcaggactggatccagtataggtttgatgtgccaattactctctggagcttccacaaaatcaagagtatggcttataggaaaacctctcactttggaactggccggtcgttaacaacaggtggccctaagagttgctaacagggggcgcaacacctagaacccggcaggggaggagactcccacctgggagggtaaacctctacgtggtcagagtaaatacaccttcgcttttggaatggaagcgtacagtaagcagagttgggaggatgacgggttcgtatttcaaaccggaccgatcacaagcgaggtttgctcattaacgttcctggtagcgatccccagatgtagtaggaggaaaacatgatagagagatcacaggggtctaatagccccttattgtgctctggttgatatagactgatcaccacacgtttagtatggagcggtccattgcagggtaaaggtaagtaacatatagatcagtttagcaagaaaccgttgaggcagttatggaggagacacgtgtataggtatgacgtatgcgggacataagaagttcatgatgtgccactaattgaggacataagcgaactttattatagagaataccagagtacgaacacataaagagtgcacatacagataaaagcgaagaacaatcaagtactcatattatcctattagttactcaaagtatgctatgccatatatgagaactctatattcgcacaaagattatagacactgatatcagttttacttatgaataacatttgtacagcgacacagtcaagttacgtatcaccttcaaagtaaacagctagactaggctataacaacaaacttaccacgattcaacaacgcaactcacacacaaacagtacaataaaaacacactctactaaagagatagacaaaacgataaaccacgcgcaacactaccggtaatacagaacagagaacatgagaatgaacaatcactaatcacatagtaattcagaccaagataaaaacacaacagatgaggaagaaacttgtggaaaatagagtatgactataagataaaatataatcacaaagatatggtaattactaagtacactaataacatatagataacagcatataaggaaccaactataagtaatcacacataaggacaggatatcagagcgaccacagtatgattagaaacaaacaaacagcccatctttctttctcatctctaacacaaagaaacaaatagagg

SEQ ID NO: 526046 - DNA, 234 bp, Homo sapiens
  misc_feature (73)..(73): n is a, c, g, or t
  misc_feature (97)..(97): n is a, c, g, or t
aggcccatgccccgtccggaggcccatggggagcgaggtttttcaggattcaaggatcctggtggaagacganggttctattgagagggccgggcangagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcag

SEQ ID NO: 526047 - DNA, 182 bp, Homo sapiens
atgcaatcaggcgatgctctacattcgagcttgccggcttcccgggtgtgtactggtcgtcgtatgaagaagacacaaaactcttcaaactccttttatctatggccactctgccaagctctattctttttgaagtttacacatttatttaaaggttcacatttatgttcccaataataaaa

SEQ ID NO: 526048 - DNA, 316 bp, Homo sapiens
acagtaagaacacatcttctatccttggaattgtgaagaaggaaaaagatatttgctagttttgctgttgcacctcaaactgcaaaagttaccaccacggttcatgcaaagtgcttagttaagatggaaaaggagttacatttgtgggtgcaagacatgaacagagaggcattccaatcaatagcaatcaggttcagggggtaccttcctcagtttcaggcatccacagggggtcttggaaagtattccccatggaggggggccgggagggctactgtactccatacttattctaataaaactttttagaaatctc

SEQ ID NO: 526049 - DNA, 573 bp, Homo sapiens
tttcctctcacccagatttgccttcgcaagcctagggtgatcccctgcctcgctctactgcaccctatggggggccctctcccaggacactgcctcttctgcggcagaaggcccctccaggcggatctgctccaacaagaatagaagcccctccccgcaacttctaacgacagcatgaagttaggacgtgctatacctcctaaatgctgggacccccctaccctgttactctccgctagaggtccccagttccttgggagagtggcacccctcaactgtcactttatggactgatccggtagcaattacagtccacgcaaagagcccgtgatctcgcgggtgtacctgaatggatgaggaccgctgggggaccactgctgaagcatttctgacctcacgttcatgtcatctgcttctcccctgttggggctaaggaaggagataggtggctcttataagaggaggccatcttcttcacccaccccttcctcttcggcacagctactcctggtctgcggctggggccttgggggtctgcgactggcatccataaaccgcctcagcccagccagg

SEQ ID NO: 526050 - DNA, 172 bp, Homo sapiens
ctatatgggcgagctctaactcagggcgagctgtactcagggcgagctgcataaggttacttcatttgtcaacgcacacacaactagtagaagtggagccggagcgggctacaggcagtctgctaacagagtctgcgcaatgctgcctctttagtaagcaaggacagaaaaa

SEQ ID NO: 526051 - DNA, 106 bp, Homo sapiens
cgggtgacacgtataactactgaattctcttctggcagtgtgggtcatatccacggtctgggatttcaaaatgcctcttcatgtgtaaggcgaggtgggaggagag

SEQ ID NO: 526052 - DNA, 343 bp, Homo sapiens
caattagtctttggttgcattaagctgcatacttttcataagcaaaccaagcaagcaaataccaaaacccagagaattcagtgtgaatagagtgaagaatagttgctccagggtcttaacagtacctatgtggtttttttcttgtttttttgttttttttctttttttgtgagacagagtctcactctgtcgcccaggctgaagtgcagtagcatgatctcagctcactgcaacctccaccttccaggttcaagcaattcttgtgcctcagcctcctgagtagctgggactacaggtgcatgccaacaggcacagctaatttgtgtatttttagcagatatgg

SEQ ID NO: 526053 - DNA, 318 bp, Homo sapiens
  misc_feature (18)..(18): n is a, c, g, or t
  misc_feature (249)..(249): n is a, c, g, or t
  misc_feature (292)..(292): n is a, c, g, or t
  misc_feature (317)..(317): n is a, c, g, or t
ccctggtaatcccagcanttttgggaggctgaggcaggtggatcacctgaggtcaggagttcgagaccagtctggtcaacataacaaaaccccatctctactaaaaatacaaaaatattagccaggcgtggtggcgggagcctataatcccagctactcgggaggctgaggcaggaaaatcatttgaacccgggaggcggaggttgcagtgagccgggatcgcgccattgcactccagcctgggtgacngggtgagactccatctcaaaaaaaaaaattatttgtatatggnttcccttatttctttgaacatattng

SEQ ID NO: 526054 - DNA, 138 bp, Homo sapiens
acgcaggcggaccgtttgtctacacctgcaatgaatgcaagcaccatgttgagacacgctggcactgtactgtctgtgaggattatgacttggtgtatcacctgctataacactaaaaagcatgaccacaaaatggag

SEQ ID NO: 526055 - DNA, 432 bp, Homo sapiens
  misc_feature (192)..(192): n is a, c, g, or t
  misc_feature (332)..(333): n is a, c, g, or t
caatagtgctctacctcagcactgttggcattttggactggaaaattccttgttgtggtgagagccacctttttgcactgtagaatgtttgcaacatttgtgatctctatctacaagatgccattaccgtcttccaagtcatgatatccaaaaatgtctgtaatagcaaaaaggtggaagcaagtaaaatanccatcagctgatgaatggataagcaaaacatcatctagccatatagtaactcttattcagccataaaaaaatgaggtactggctgggtgcggtggctcatgcctgcaatcccagcactttgggaggctgaggtgggcagnncacttgaggtcaggagttcaagaccagcctggccaacatggtgagaccctgtctctactgaaaatacaaaaattagctgggcatggtggtgtggatgcc

SEQ ID NO: 526056 - DNA, 575 bp, Homo sapiens
gggtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgacaggaacctagggaagtgtggtgttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaagtaaggactggggtgaaagagctaagctccatttggaaggctgagaggaccccagggattatcttctcgttttccctctaaagaaccctgggacttctgagaacgtgaagttccaaccttttggcggagggacccgaaagcactgtaggagctacagtcccaacattagtccctctctggcttagaagtcaatgggcgtactgtgcagctacattaa

SEQ ID NO: 526057 - DNA, 1215 bp, Homo sapiens
atgcaggtgtctatcgcgtgtaccgagcagaaccttcgcagccggagcagtgaggaccgtctgtgtggaccccggccgggccccggaggcggtaatggtgggccggccgggggggggcacgggaatcctccggggggtggagggtctggccccaaggcccgagctgcagtggttcccggacccccagcgcccggtggggccgtccgagagagcaccggccgaggcactggcatgaaatacaggaacctagggaagtgtggtgttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggcttgcgaggatccctggaacgcctccagctgggatacgtggacattgtctttgccaatcgctcagaccccaactgtcctatggaggagattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtag

SEQ ID NO: 526058 - DNA, 358 bp, Homo sapiens
gcgttgtatataagcgcacaatgaaaggcttcccaaatacatctacccctccatggacatcaaagcccacagcaagatttaatgtgtaatgtccgaaatgagacaatttaaagtgtacacaggaaaaagaaaaagagagaaaccctcacctcaccttcgataacactgcagctggtttcactacttctcttagaagagaaatgtcggtagagacagagtggacaggctccccacctgggctgcttctgtatctctgacatattgttctctgcacctcgcagctcaggaaagtccagcgtggtaccatcaaactcaggcttggaggtagactacactttctcgcactgactcctggatt

SEQ ID NO: 526059 - DNA, 750 bp, Homo sapiens
ggccgggcgcggtggctcacgcctgtaatcccagctctcagggaggctaagaggcgggaggatagcttgagcccaggagttcgagacctgcctgggcaatatagcgagaccccggttctccagaaaaaggaaaagaaaaaaaagaaaaaaaaaaaaaaaaaacatgtgtgtgtggggcgcgcccgcgggccccggagaaaaaggtttcataaaacaccatgcgggtgggggcgcggcggggcccacagatgaggagaacagtagagaacatgtggggcgcaaaagcggtggtgtctccaagagagagagacactcgcggggcacaagagagacaatagggcgcggggagatctctctctaactaatatagaaaaaaaaagcgcgccgggggggagaacacccgagaggcgtgtctctggagagacacaatatctccacagagaggggagagcggcacccagggaggggcgccacaataaacgggggagagctctatatatacacacaggggagagggtccacaaagggggaggacggctgcgagagagatatctctataaatatatacacgcccccgggggcaccggaggggggtggacaacaaagaggaagcagaaagagaagagaagggagatgaacaaaagcaggacacaacacacaaagagacgacaacaaacggaaagagcaagcacaacaaaagaagagagcaaaaaagagcaagcatgacaaaaaatacaagaagaaaaacgt

SEQ ID NO: 526060 - DNA, 822 bp, Homo sapiens
agcggttcggatgcttggagtcatgagccgggagggcgcgggggcagcttggtagccgaggtgatcaaaggaaggaacatgcaatttttccatttcagatcgccttgtttgccattctctacagcagaccaaagagtgcatcaaatggtacatatattagcagcatagatgaagagaacttgagatatgagaacgtaccaaggcgaagagtagaagaaagcactacaatacaaagcaaaaaagaacggaagaatgagaagcagagaacaaaaataaaaaaaaatgccaaaagcaaaatgaaaagaaataaaaagaagcagaggacgaaggcacagaacagagaagacgagcaagaaacaaccaaccgaagagagaagaacaactaaagatagaaagaaaaaagaataggaaccccgattaaaaatctataaaaaaataatggaacatatagagaaataacatactcaagaagactcgaagactagaggaaaggaagcgcgaaaatagagaaaaacataaatgcaagcataatactaccgatacaaagacaataggacataagcatttaaaaggaatgatcaaagagcaatgaaaatcatacctagaaggagactacacataagaatccaaagaaaaagaaaaaatgtcgaataaataaatgcatgaaagtaggagataaagaagagaatcaaatagaccgaaatcgaaaatagaggtctgcaagaaaaaccacaaacaataaccagacggaagaataagtaaccaacagtcaatccccgaaaaacagaaaacatgaatgggaggcaacaaagaacaaccaaa

SEQ ID NO: 526061 - DNA, 106 bp, Homo sapiens
tccttatcttgacgccaactaatacagtgataggacagagcaaaatcttcttcctgtactggctgtcctggcccacctagaggaggagcgagatttgaacgatcac

SEQ ID NO: 526062 - DNA, 291 bp, Homo sapiens
ctcaacgctttatacttcacatataatattacttccatgagcaatattatatgtgaagtgtctaatagcagcattaggcacctagataagttgcttaatagagatgtcagctagtattgattattttatctaaaatcgacacatgtatagtagtaatatttaagcaatttaatttaaaaatctgaaagtttaaagcagtctgtaaatacccatctgctatgggtagattgccatgtgtaccattataaatgaatgtttatttctttttaaatgtatattttgtttcagact

SEQ ID NO: 526063 - DNA, 299 bp, Homo sapiens
ctggatcgcaccatatctgactcagaaaactaccacactgaagcagactctccccaggtcacagctctggacggggagggagatcagactgcttaggacctaaatggcctcatgtggctagacagatcctgacagaatggagcttggggctcacaaacctgtagcacataactggtaagaccaagacatcttgggggggatggcgcagagtagcaggggacaaggagtccacttagtaacgagaggacggactaatctagatatcgacatgtaatagcacatatttcctctagttctta

SEQ ID NO: 526064 - DNA, 664 bp, Homo sapiens
  misc_feature (44)..(44): n is a, c, g, or t
  misc_feature (86)..(86): n is a, c, g, or t
  misc_feature (111)..(112): n is a, c, g, or t
  misc_feature (114)..(114): n is a, c, g, or t
  misc_feature (128)..(128): n is a, c, g, or t
  misc_feature (161)..(161): n is a, c, g, or t
  misc_feature (164)..(164): n is a, c, g, or t
  misc_feature (170)..(170): n is a, c, g, or t
  misc_feature (176)..(176): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (203)..(203): n is a, c, g, or t
  misc_feature (232)..(232): n is a, c, g, or t
  misc_feature (247)..(247): n is a, c, g, or t
  misc_feature (252)..(252): n is a, c, g, or t
  misc_feature (262)..(262): n is a, c, g, or t
  misc_feature (268)..(268): n is a, c, g, or t
  misc_feature (272)..(272): n is a, c, g, or t
  misc_feature (298)..(298): n is a, c, g, or t
  misc_feature (302)..(302): n is a, c, g, or t
  misc_feature (318)..(318): n is a, c, g, or t
  misc_feature (326)..(326): n is a, c, g, or t
  misc_feature (368)..(368): n is a, c, g, or t
  misc_feature (370)..(370): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (386)..(386): n is a, c, g, or t
  misc_feature (389)..(390): n is a, c, g, or t
  misc_feature (393)..(393): n is a, c, g, or t
  misc_feature (401)..(402): n is a, c, g, or t
  misc_feature (406)..(406): n is a, c, g, or t
  misc_feature (434)..(435): n is a, c, g, or t
  misc_feature (442)..(442): n is a, c, g, or t
  misc_feature (446)..(446): n is a, c, g, or t
  misc_feature (493)..(493): n is a, c, g, or t
  misc_feature (557)..(557): n is a, c, g, or t
  misc_feature (643)..(643): n is a, c, g, or t
gggccgggcggactcggggaccggcggaggacgccgggcgcgcncggcccgaggctgggggagcggggcctacatgcgctttgatntgccgcggccaagggtccagcgcanncnccaccttcagagcnctgttactgctccgctacgtggtggcgcgggtnatntgggcngacatnctntncatcgcngtganctncttnttnacgctgtgcctgttccccggcctcgagtntgagatccgccactncttcntgggcgagtngctgcncatnctcatcatggctgtgttcaacctgtnaganttcgtgggctagatcntggcagcnctgctcgtggactggcggggcacccacctgctggcttgctcntncttncgtntngtcttnttnnccntttttttnntgtncgttttctccagcggcttgctcgctctnngttactncgcntggttctgcttcttctttttgcttatgggcatttgctacggcttttnggctgcgtgttcttgttcctggcggcaggcaaagtgagctccaagctgcgggagctggcagggnaaaccatgaccgtgtcctacatgtcagggctgacgctggggtctgccgtggcctactgcacctacagcctcacccgcgacgctcanggcagctgcctgcacgcctcc

SEQ ID NO: 526065 - DNA, 309 bp, Homo sapiens
acaaacttgatagaccacgagcaagactaataaagaaacaaagagcgaagaatcacatagacacaataaaaaatgataaaggggatatcaccaccgatcccacagaaacacaaactaccatcagagcatcctactaacacctctacgcaaatgaactagcaactctagcagacatggataaattcctccacacatacactctcccaagactaaaccaggaagaagttgaatctctgaatagaccagtacccggagctgcccttgtggcaataatcgagcgttaccaaccaaaaagagtcaggaccagat

SEQ ID NO: 526066 - DNA, 266 bp, Homo sapiens
tatatcgtgcggcgccgcgtgtctgacgagacgggagcggggtagtatgttgaaggagggaggtggagaggatgatcgcgggcgtgtggacttgccgagccatcatcactcgcgatacacgtccggccctctccaccagacccagaaccccccggagtccagaataatcaccaccaacttagccacctttaccgcgccctaccgctccaacccaacagcctccgccgcgccccaggcctcgcacctccgatacacaagccgcttca

SEQ ID NO: 526067 - DNA, 427 bp, Homo sapiens
ttagcaatacacggatcatacgtacaatagtacatgacacagcctctattactgtgtcccactgaagtccagtgctcgttacgacacttatgcaccatggcagtggtataaggggtgctttccataaccatcttctatgcagatctaagtctagttaagagtacctgctcttccatgtattcatatttatgcatgctccttgatcagacacatgtatgtcactgcagacattggcagtggctgatctgatctcgaattcagacagaatagtcattagatattcggcacggtgcgcagcaaacccatgtccttgaacagtagaaggagttggttcctcatgtagtctcacggcagcgtcctcttaatcagtcaggctggcaccatgaatcaaggctcctcgtcgagtactggatacactacagtcgat

SEQ ID NO: 526068 - DNA, 320 bp, Homo sapiens
  misc_feature (220)..(220): n is a, c, g, or t
ccctactcagcctctcaagtggctaggactataggtatgtgctaccatgcccagccaattttttttttttaaatttatgttttgaaatggagtccaggctggaatgcagtggcatgatttcggctcacggccacctccatcccccaggttcaagcaattctttgcgtcagcctcccaaagtgctgggattacaggcgttgagccaccgccaccagcctgnttcacccattttttaagccagatttgatgggatttgtttttttttccttgtgctatttggttgtgagtctccctttctcagatctcgcggaattactcgt

SEQ ID NO: 526069 - DNA, 524 bp, Homo sapiens
ctccatgaggacatcgtacatatcatatccgccatccaaattgaagcaaatggtatccattgtcacagctgttccctgtggttaccacactcatcaatatcttcacacgattctccacttggtgaaaacatcccattgtcatggtatccatctctgcactcacagtggtaccatccaggcaggttaatgcaattagcacgactgtcacattgaacaaaaccatcagagcattcatcaatgtccgtttcacagctgggtccagtgaagccttgtgggcaggcacacacattagcggcaatacaggctcctccattcctacagccatctttgcaaaatgctttgcatgtcgttccattccctgtatagcccggcttgcaaacacagttgtgtcctccaacagtgttgaagcataaagcattttcatcacagttgtgctgatttgtgatacactcatcatgttctgtacatgaataatcatcaattctgatgtatccagttttgcagatgcacataaaagaacccgg

SEQ ID NO: 526070 - DNA, 890 bp, Homo sapiens
tgaaccggcgcttattggctcggcgcggccgctgcaatccgtggatggaagcgcgccggcgagccaccatcatgcctgggcgtcttacaggaaggcttcggctgcgtggtcaccaaccgattcgagccaggttatttgacagacgaatcggaccccttcgagggctgctgaaggcagcagagaacaagaaaaaaggaagccgtgcgggtggcgggtcgttgtgtgggtcccgtgggtgcgcgaaggaggcgccacgtgtcaggcctgcgtgaccagagcaactccaatgcggcaggcagaatcatgctgcgcaatggagtctccagagaagaccgcaagaatcccgctggccctccagcgttggcgtggttgacggagaaagaggagaccgcacgccgctccgtgggtgctttaaatggaaagaatggagtaagacgacgttggaacgacgacctgatctaacaacttacagggtgaaggggacaccataccttgactagaagaccaagagaaaggcgatcgacgctcgttgaaacgactgattcggggaaaaggcccactttggacaaggaaacagcggtgtgaaagggaaggcgaacatcttgcaagtgggattgagacccggatttaattgggacgctgagcgttattcccagagggtacagaagagagggtcctttggtacagaagtggtcgccgggggggcccgtgaggacagttgagaaagggggcccggcgggaagaatgggaaatcggagtcctacgttgccgaagccgtgactatagacatagggcatacctgggagataagatcaaactctggccatgagcaggaggaccaaacgtgagtaatgactccacaactgtggaacgggaaagacgaattactg

SEQ ID NO: 526071 - DNA, 2862 bp, Homo sapiens
  misc_feature (2854)..(2854): n is a, c, g, or t
gccgcccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatggtacttgtattccattgatggtgtgtcttcctcccacccccttatctcccatgcactcactccattttcatcttcactatgaaaaacaataccaaaagtatctggaaattgatatatatatatccacatatatatatcatatatttgccatatatatatatatatatatatatatatatatatatatatatatatatatttgccctgtctttgatcctggggaacaaaagaaaaaagtcagaaagggaaaaaattacactcattgccctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaacctttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgatggggttcgagtcatctttgttcctgttactattaaaatatccgggatagtctttccnaaaaaaaa

SEQ ID NO: 526072 - DNA, 388 bp, Homo sapiens
agctcacgccgtgtgcgcttcagtcactctccaccacacaggtacagcatcgctcttctggtatcgcccttagtgtcttgctggatataatagtacaggtgacttgccgtactcttctctgtgaattcagacctaattttcaacatgtccacttcactgcgggagaccatgattctgatcaggaccttatctcgcgtccccttgcccttcatggagtcatacagccgatcagcaaaatacaggggcttgttctgaatgcactgaaccaggttcaggaaagcattttccaggtctcctttaacctctttcctgatgctttccaacatgtcataagggctgtaactcttgtacctatcaaatactttctggaggtggggcacgctccgca

SEQ ID NO: 526073 - DNA, 1668 bp, Homo sapiens
gccgcccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatgg

SEQ ID NO: 526074 - DNA, 230 bp, Homo sapiens
gctgagtctatggaattaacaagaggtctcctaaaaaagaagaagaatcacactggcatcagatgaggcacagcgaaatggagggagaagacaacagagcaagaccttcaaagttatgaaaggactactatatccagtcaaactgttaattaaataagaaaacaaaaataacctattttgagacatgtgaaaactgcagaggtttacctctcatgcagccctttccatag

SEQ ID NO: 526075 - DNA, 335 bp, Homo sapiens
cggcctgttatagcacaataaggaagggtcccaggtttaggagagccccaagttgagaacaataatgaacaattatgtatgaacaatagttagagacagctaatcacaaacaaactgcgggcacaatgacctcattccacacgtagcacccttcagcaggaccctataaaactttcctccagcccttgcctctttgcaggtagccccttctctgctgagctgcccactacaacatattttcacaatttctctaataaatctgcccttctttacctacaactatcttggtacatggctttaccacctgcaaaactgaccctaggttgttgctaccc

SEQ ID NO: 526076 - DNA, 278 bp, Homo sapiens
gaagaagtacctgtcgtagggagatttgggtgcaagccctcatgctgaggtttgaaatgggaagaggggggcacgaccgctgctgcggaagagaatgcattgagccaggtgcggctgccagtacccacctggcatgggtagttaacgcctgcactctcactactctaggaggtctacgccggagaggctggccaaggcacggtgaccatattggaatactcgaggctggacggtacccagtagcggattctgtctagtgtgccctatgcggaatttat

SEQ ID NO: 526077 - DNA, 126 bp, Homo sapiens
taaggacccaattctgagtccccggccagccgaatccaagccgtgtgtctgcgtgctcgacgtgcccacagtcctgctaaacttcgccaactccgcgcgttattgcctaatgcgggtaccgagctc

SEQ ID NO: 526078 - DNA, 2042 bp, Homo sapiens
ggcacgaggccacctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggtggagcaggcggaggagctggaggagggcgctctcccgtccgggagctggacatgggcgccgccgagagaagcagggagccgggcagcccgcgactgacggaggtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgccctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatgg

SEQ ID NO: 526079 - DNA, 188 bp, Homo sapiens
gcgttccttgcgttgcactgaaggggcttctacggatggggtgagggatgggtgcaggatgcgtcgtgactggtgcaaaaacatggttcatagcttgtttccacagtggtcgcgcatcctgcagccatcctcacccctccgtaagccctcgtgcaatgcatgaatggacctcctgtcaatctgcaaga

SEQ ID NO: 526080 - DNA, 855 bp, Homo sapiens
  misc_feature (17)..(17): n is a, c, g, or t
  misc_feature (26)..(26): n is a, c, g, or t
  misc_feature (33)..(33): n is a, c, g, or t
  misc_feature (77)..(77): n is a, c, g, or t
  misc_feature (83)..(83): n is a, c, g, or t
  misc_feature (94)..(94): n is a, c, g, or t
  misc_feature (100)..(100): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (142)..(143): n is a, c, g, or t
  misc_feature (159)..(159): n is a, c, g, or t
  misc_feature (163)..(163): n is a, c, g, or t
  misc_feature (167)..(167): n is a, c, g, or t
  misc_feature (192)..(192): n is a, c, g, or t
  misc_feature (198)..(198): n is a, c, g, or t
  misc_feature (214)..(214): n is a, c, g, or t
  misc_feature (221)..(221): n is a, c, g, or t
  misc_feature (232)..(232): n is a, c, g, or t
  misc_feature (234)..(235): n is a, c, g, or t
  misc_feature (238)..(238): n is a, c, g, or t
  misc_feature (242)..(242): n is a, c, g, or t
  misc_feature (273)..(273): n is a, c, g, or t
  misc_feature (286)..(286): n is a, c, g, or t
  misc_feature (291)..(291): n is a, c, g, or t
  misc_feature (300)..(300): n is a, c, g, or t
  misc_feature (324)..(324): n is a, c, g, or t
  misc_feature (337)..(337): n is a, c, g, or t
  misc_feature (343)..(343): n is a, c, g, or t
  misc_feature (363)..(363): n is a, c, g, or t
  misc_feature (370)..(370): n is a, c, g, or t
  misc_feature (372)..(372): n is a, c, g, or t
  misc_feature (399)..(399): n is a, c, g, or t
  misc_feature (406)..(406): n is a, c, g, or t
  misc_feature (523)..(523): n is a, c, g, or t
  misc_feature (546)..(546): n is a, c, g, or t
gcagggctagcactgangtgtctctnggcggantgctgtgagtggaacgcgctgggccgcgggcagcgtcgcctcangcgganagagctaagcngaagcnggacccggagcacgaacagcagcngcnatggcaatnaaatanntggaagtaatcaagcncttntgtntaatcatgcaggaaattcagaagcnagaaangaagattcaatttaangagaaantactgtggacngnnatnaccntctttatcttcttagtgtgctgccagattcncctgtttgggatnatgtnttcagattnagctgaccctttctattggatganagtaattctagcntctaanagaggcacattgatggagcnagggatntntcctattgtaacgtctggccttataangaaaatnttggctggagcaaagataattaaagttggtgaaaccccaaaaaaccgagctctcttcaacggagcacaaaagttatttggcatgatcattactatcggccagtctatcgtgtatgtnatgaccgggatgtatggggaccnttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcat

SEQ ID NO: 526081 - DNA, 1921 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526082 - DNA, 3258 bp, Homo sapiens
  misc_feature (3250)..(3250): n is a, c, g, or t
ggcacgaggccacctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggtggagcaggcggaggagctggaggagggcgctctcccgtccgggagctggacatgggcgccgccgagagaagcagggagccgggcagcccgcgactgacggagggtagaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgccctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatggtacttgtattccattgatggtgtgtcttcctcccacccccttatctcccatgcactcactccattttcatcttcactatgaaaaacaataccaaaagtatctggaaattgatatatatatatccacatatatatatcatatatttgccatatatatatatatatatatatatatatatatatatatatatatatatatttgccctgtctttgatcctggggaacaaaagaaaaaagtcagaaagggaaaaaattacactcattgccctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaacctttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgatggggttcgagtcatctttgttcctgttactattaaaatatccgggatagtctttccnaaaaaaaa

SEQ ID NO: 526083 - DNA, 1415 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggaggccctgaagtcgcggggaccaagggggagggccacacagtactgcgcgatagaccggaaaatgtggcccggggtggccactggacaggttatcccccctaacgtgtgaccgagtggcacacaaaaggcgagcaaagacaaccgactacgtgaagccgccaaaacacacgtagacaggtagaaacggtaggagtacggccgccatcacaacggtgt

SEQ ID NO: 526084 - DNA, 1649 bp, Homo sapiens
  misc_feature (4)..(4): n is a, c, g, or t
cgtnggttttcccacatggtggtgccaaagaatcttagaatgtttgtgttttaaatttttaaatttttttttgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctacaacgatggactcttgcatagaaaaaaaaatcttgttaacaatgaaaaaatgagcaaacaaaaaaatcgaaagacaaacgggagagaaaaagaggaaggcaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgttttaaaaaatgcgctaagaaggcaaagcagaaagaagaggtatacttatttaaaaaactaagatgaaaaaagtgcgcaggtgggaagttcacaggttttgaaactgacctttttctgcgaagttcacgttaatacgagaaatttgatgagagaggcgggcctccttttacgttgaatcagatgctttgagtttaaacccaccatgtatggaagagcaagaaaagagaaaatattaaaacgaggagagagaaaaataatggcaaaactgtctggactgctgacagtaaattccggtttgcatgg

SEQ ID NO: 526085 - DNA, 1186 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtgggtggtggccttctctgcccctcccccgctgctatgagcagcacgtggcccactttccagctcagtgttctggcttgttatgctgtttctgagcacataatgatgtacaaatcaaactagcctacgccttatgtaggtgagacgtccaggagcctggtcggctcaggtatagctggatctagatgctccctgccagtgggactctgtgttctctctggtctttgctttctcttgtgttgattctgttctcagggacacacattcttgcaggtggcacagtggcggccgcaatgtctgctttcgaacctccaatcaggctcactctgaggcagatgtacttgtgtggctgccaagggccagagagcca

SEQ ID NO: 526086 - DNA, 1132 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtcaggatctcattctgttgcccaggctggagtgcagtggcatgatcatggctcactgcagtctcaaactgctgggctcaagcaatcctcctgcctcagcctcccgagtagctcgtgcttcagtctcttgcctcggcacctgggtggcttaccgcccacaaccaacgtttggcagacgggggacggcagagccggtgagaacagatagctttctgtgcccgtatgaggcatccgtgacgtgattctgtcatcttggccttcgagtgctggtcgtacctggtctcggtgcgaggttgggccgttgaaatatttgcgc

SEQ ID NO: 526087 - DNA, 721 bp, Homo sapiens
ttgttgtatcccgcgccgccccaattttgggccccgtgtgtcttctccccccccgccctgtcggtcgtcggtggcccctggaagctccgtttgtgttcccgggagtagatcccggcccccgataaatgttctgtgtgtgtttgagcgcggcgctcgctcttgttactcgcaggtggtttctcactcatgttgctcgcgggtgggctcctgcgcgacatatattcgccccgcggggggtttctcgccggcccctcttctcgcgcgccgcggcggccctttggtgtcatactcccgcggggagtgctcccccgccgactgtcttggtgggtggcctgctgcgctcgtcgggtggcatctcctggtaggccaccagcagtgggttgtccacactcccccggcttcggcgcgccacactctgtgggcgatcccccggtcttcccctcgagtgtactacccccacgttctttccccgcgcgttgctggtggtgcgacgccgccggttcagtccccaccaaccgcttctcgcgcggaggcttgtggtgcccgcgaggagtttcacctgtggagaaccccgggggccaccaggggtcgcgccagtcccgcgtgggtgtgacgccccgtcggtgcgcccccgctctcgggctcgccacaggcctcaacttttgttgctcgcgaaaacaaaacaacccacacaaacacccaaactaacaaacaaagacaa

SEQ ID NO: 526088 - DNA, 199 bp, Homo sapiens
cgcttccgtgaactccgtgagactcactactaagtttcttgctgtcatttagctacatttttacgtctagtaatctggcatgaccagaagctcctcaaagtcaaacacaaaattccatactactttcagacaccccaaaggccaagcacagtgcctaccatgaaaagtggctagagatggattatgacagtttcttatt

SEQ ID NO: 526089 - DNA, 1034 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcctcctgagtcactgggattaaaagcatacctaattatttatttattgatttattttggagacagagttatcctctgtcacctaggcgggagtgcagtggtacattatcagttgcactgaacctccatcttcccaggttcaagcgattctcctgcctcaagagtcccgggacaagcacggctaatttgggtagttgagtagagacagagtttcgccagtgttggccagactggtctccgaaactaccgtgatctcaagtgatccacctgctcgggctctccataagttgctgggattacagtgttgttgagccactgcagctgggcatagattgagtttatagtgcagatgtgtttctgaacaaggtatacggtcagcacccaacggcaactgcattttgtacactgacacgattgtgggacgcacgggtgttgccccaggttacaaacaacctgtggttgatcaatccgaaaaca

SEQ ID NO: 526090 - DNA, 2337 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526091 - DNA, 246 bp, Homo sapiens
acatgatacaactcgagctcggtacctgaacattcgtgtccgaactcctgactcaagtgatgctgcctgctgggcctcctaaagtgctgagattacagatatgagcctagtgtgcccaggtcctcaccttgagccactcttaaaatattttctactaaatttatatttgtcagtggttttatccattcgttttcttgtttctctttttttctttttttttttttggggagacacagaatggtccag

SEQ ID NO: 526092 - DNA, 1945 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526093 - DNA, 2447 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtcaggatctcattctgttgcccaggctggagtgcagtggcatgatcatggctcactgcagtctcaaactgctgggctcaagcaatcctcctgcctcagcctcccgagtaggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526094 - DNA, 321 bp, Homo sapiens
  misc_feature (23)..(23): n is a, c, g, or t
  misc_feature (68)..(68): n is a, c, g, or t
  misc_feature (273)..(273): n is a, c, g, or t
  misc_feature (307)..(307): n is a, c, g, or t
atttcagttcatccagatgtttntagaacattgaatagctatgaatggactggatgcggtatgtgtgngaaaaaaagaggactcccaaggtttgtgattgaatattaggaagaacagaattgctgtgaattgagatgtggaagaatgtagaagtagcaggttttgaggggcagggaaattcaagagtctggctttggtcatattaattttgagatgcctgtttgacatccaaaagacatagtaggttagtatctggagttcagagagaggtcnggcctgaaaatatacagtagttgtcagcatatanatttgaagttgtgg

SEQ ID NO: 526095 - DNA, 2236 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526096 - DNA, 446 bp, Homo sapiens
tgacaccatcgaggagtgatggtcttatcagtcaggctcttcatgtaagtatctgcatcccacctgctagtagacggatgtaccacggtgcaaggtggactctttctggatgttgtagtcggacagggtacgaccatcttccagctgttttccggctaagatcaacctctgctgatcaggaggaatgccttccttatcttggatctttgccttgacattctcgatggtgtcactgggctccacctcgagggtgatggtcttgccagtgagtgtcttcacgaagatttgcatcccacctctgagacggagcaccaggtgcagggtggactctttctggatgttgtagtcagacagggtacgcccatcttccagctgttttccagcaaagatcagcctctgctggtcaggagggatgccttccttatcttggatctttgccttgacat

SEQ ID NO: 526097 - DNA, 1392 bp, Homo sapiens
gtgatatttccagtcatgtataaagaatcaaatagggccattagcataatatatccatcactccaagcatgtatcatttctttgtgttggagacattccgtatcttctcactattggaaaattacaataaatggttgtaaattcagtcaccttatagagcactgcacctgtccctcctgtccatcgtcctcctgtgcctgttccccagcctgtggctgccccctccccagagaagccgatgcttgctggagcttggtcggtgctctgggtaaggagacgctggggctcacgccgtgctcaggctgctccctggtcatccaggcacttctcacctgcctttctcctccctgaccacctcccccctaggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 526098 - DNA, 146 bp, Homo sapiens
ggtggagcaggaccaacaaaaactataactgctggtccagatcaaacagaaatgactattgaaggcgtgcaggcccagaggggagtatggtggttaggtctatgctcagaatccaagcggagagagtcagcctcgggttcagactg

SEQ ID NO: 526099 - DNA, 979 bp, Homo sapiens
ccctcaaaccatatataatggattaaatgataacatctctcccaaacttcatgtaatataaggatagagagcatctgaatgactagcttcttacaggacatttctagtgaagtaaaccccgcgtcagcgatgaaacagattcatcctctgctccttccaagagaacgaggtgggaggcagcgcaccaacacaactactactatctttcaagccagtaatgcagaaattactgtcatgatcacgttgatcgtagcgaagtcagctgcccgtggtatgctctccaggtgcactgtctattacaccagcaacttcccaaaaggcatgttactgtcgcatgtagtttgtgcacgttctatagacatgggaaaattattgaagaagaagctttcttggcttggaaagaagatataacccaatgagtttccgggaaaaggcaaggcttatgttccaggtgaatcagtggctaacctggttagaaactgctgaagaagaagaatcagaggaacgaacgctgagctaaagaagcaggccaacaggccttaaattgtgcaaaacatactgttgctatgatgtacactgcatatgacctaaccactgtcgaaaattcattccgctgttaactgttttcacgggttatttaacagcagaaagcacgctccgctccagagaatattgcgtgtccaggccataaagggttacactaggtaagttggtaaatggtcccctcaagttaatatggtccaaacccagtcgaaaattaattttgtcacggaggtttatccttcacccgggtaaagaaatattggtaatcattaaagcacagacttgttcgaaacatacaatgcaataacgttttctccacaagccgagagagccacgcccacaaaatgtgaaggtgaccttcctgtcaacagcccagtatatcacaagaccgtaataaaggcgtgacagcatgatcatttatacagcgccactacga

SEQ ID NO: 526100 - DNA, 160 bp, Homo sapiens
cgtactttgcaggatgcggaaagtcacgatagtaaaccatctaccatcacatccatgatagccatccgtccatcaccctgtatctcaggaacaaatgtacaatagattacctttaaagcatgcatagtacatttgttcctagagatacaggttgctggac

SEQ ID NO: 526101 - DNA, 346 bp, Homo sapiens
ggcgctcggcgccgttatgcgaaccgcgtcacccactacgtcaaggacggcctcgctggacctcggtccgaagggcgcggcctggtgtcacggttggtaccggtgacgggggcatccccgacctggacaagctgcccgcaccgttccgtacggtcgtggagagcgcctacggacacggtgtcggcgacgtcttcctgttcgccgctccggcggcgctgatcgccttcctgatcacgatcttcatcaaggaggtcgcgctgaagacgaacgccgcgaacgacgccccggcggaggccgaggttcctgccgcggtgctcgccgaggtcccgtccggtgccgccgcgct

SEQ ID NO: 526102 - DNA, 306 bp, Homo sapiens
gagagtataaataatggagagcacagaattgagacagtaaaggagactgaaaggaaacaaaagaaccaatttgaggagagccagggataagctctatctagctgaagatggggtctgccagttccggagattggaggacctggccttgaatttctcctgagtgcaaagtgagaagctgaggacactgaagaccaataattccactgtcctttcaggtttcatgccaaaccccttaaatgacaattgtatatcaaatgccctctgacttttttgatctctctataaattgcaactcatatcttcaaa

SEQ ID NO: 526103 - DNA, 199 bp, Homo sapiens
cgtgcgacctcttagcaggataactactctcacccgggagtctccgtagaccttaccatctgctccttacacctagcaggtgtctcctctatctctaggggccactcgaatttcatcacaacaattatcattataaaacccccctggtttaactctgtaccccacaaccctcttcgtctgatccgtcctaatcacagca

SEQ ID NO: 526104 - DNA, 118 bp, Homo sapiens
  misc_feature (62)..(62): n is a, c, g, or t
gcggccctgcacgttacctaggaccgctcaccggtcgcttgtgctcctctgtctttcctccncccggtgccatcatgcggacgggccagtcagtgctcctgggctccgttcaccatcc

SEQ ID NO: 526105 - DNA, 366 bp, Homo sapiens
ccttgcccagaggctctgcggagggctcagggaaggaaacgcagtccgcccctgtccctgcggctctgggttggaaactgtgagaaaatgggtcaaagtgggtctgtaggagtgtccacccgccccgccggataaagcgccgctcccccgtagtgaggatcacgctcttggggagagttgaggccccaagaaagtccataaccactgggctgggggtttccacgacggtatagaaaccactcagatcacacacatcagctgacacacacagtgcgctcacgtggaaacaccacggaatcaagtgagcaaatggacttttccctaaagccagaccacaggctgcggaatcctgccttccgcagggac

SEQ ID NO: 526106 - DNA, 219 bp, Homo sapiens
  misc_feature (8)..(8): n is a, c, g, or t
  misc_feature (83)..(83): n is a, c, g, or t
  misc_feature (182)..(182): n is a, c, g, or t
ctgtcggncggagacggatcgagggcagtgaggggcgcatatgatctaggcataatattcggagtatacgtagcggtaagtanaacgtactctagaatatagtagcatggcaattaaaggtgaatcgatcgcgcgcagatctgtcatgatgatcattgcaattggatccatatatagggccngggttataattacctcaggtcgacgtcccatggccat

SEQ ID NO: 526107 - DNA, 1660 bp, Homo sapiens
  misc_feature (555)..(555): n is a, c, g, or t
  misc_feature (1236)..(1236): n is a, c, g, or t
  misc_feature (1468)..(1468): n is a, c, g, or t
cttgtttcgacaggtttcttgtgctctcatctggtggttgtcctcccctgctcggtcgcggctcccccaagtgtgctggtgaatttacaacagggtgttggggaccacccacacgaggcccccttgtgtggccacaccggatgaataaaattgttgtgttgacaaacgagagggggatggggcacccccaagttgggtgtgggagaagaccgcacggatggcgggttgtatgtcccgtttaaaattcctgtgttgcccagcctgtcaccacgttgcgcccgggtgttccccccttatcggtactcccgtctctgttgtgaaagtcgtgtggtgaaaaagaaaaacactcgttgttgggccccgtttggtgggagaagaagccctgttgtggttggccagacgtttgggtgctcccgcgtgaggagtcctccccccccctgcgaggtttgttcctgggaccccacacgggtctgctgttctcccacagggttttgtcctcccgcccccaaaacgccgccccgccaagtgttgtgaagattgtggtaattataaggngcgtttttggcgtcctcacattggcgccgcttttcccaaattattttaaaagtggtaaacaggaccgcccccctatgtgttgtttttaaaaagttgtgtaaagagggttattggtgatagctcccacggaagaaagaatctgttggtgctagaatttttctccctcttatagtcctctcacggcgagaataacactatacggcgttgttcccaccccgcctctgtttgttgtgcaccacacctcgcccacgcccacatatattatcgcaccgcttcttacacctcatagcgccttttatattgtataaaaaatgtctaacacacccaacaatgtttgcctcttcttttgtgtaaaaaatgtttatatccccacgggagatatatatatcttagaggttttggtagaggtggtgagatattttgttctcacgcgcacagagttatttcccacgctgaaacacctctatttgtgtccccgccgctcttatattattatgtgggtacccaccacatgtgttatagacagcttctcccacacatttctccgtcgtataccacctccgcgtgctatagtgatatgtaaaattgtcccacagcgtgagactctaaacgaacactcttatcagagagtgtatagtgtttttatgaagagcgccccactcgtctctatatgatcttctntgagagagagcccactcagagatagtgtgttgtggagagatatgtgtgtcacacactcacacacagtttggtttcgagatatatacgctctcgagagcccacacactctgcgcacacactcgtgagatttgtttattaaaatgtagaaatatgagatatagaggttctcttttgtgagagtataatattatgtatactgccacctcgcctatttttggcttgagatatatanggaaatgggtcccaaagtgttaactaatatttcccacgtacccacaaacactactggagttacccattgagggaatgttgaatacgcactctcactgaatggctttgttttggtttggggcacgctgtcacccacagctaaagcccaatgttgctttaaattagctccattaaaatgtcttttaaaagtata

SEQ ID NO: 526108 - DNA, 369 bp, Homo sapiens
aaaaccccaggttcaatttgctattcctttcacctgcccctagaaggggcaagaggcgggtgagcaggacagatggggctattgaaatggttgctagaggaattacaaaaatacactctgatgtagcaacaggggtggggtgaaacatgccagggggctggggaggctcaatcagccgggaaggttcttgggggcaacgaaggcttgcggggatctgcagggcgcttaagaggcctttgggggaagtaagggattacctggatttccccagggcggccagggatcttgggggccttggaagcaacaattgcctggtttttgggggggggaattccatccctttgggtacttgacaccttgggggcgtgg

SEQ ID NO: 526109 - DNA, 544 bp, Homo sapiens
acaccaccacatcagtgctgaggacaaggccaccataagtcagccccctcgtggcgtagtgggggcacagcgtgtgctccaatgtggcaaggtaggacggcatggacgtgtggagagaggcagcaggcgctgaaggactggacagagccctgggaggcgggcagaaggctacgcaggactgaggatgaagatgcagcccctggatggtcccagactctcccgacatgcccagctcaggagcttcgagccacaggcctggcctcatatggcatgagggggagctggcataggagcccactccctgctgtggtcctgccctctgtcctgcagactgctcttagccccctggctttgtgccaggcctggaggagggcagtcccccatggtgtgccgagccaccgcctcaggaatcaggaggccagcctggtaccaaaaggagtacccagtgcctggtacccaggcccactcgagaatggtctctggactcaccttgagacggcggagctgctgggcctaaagaccactcctgggggtctcctgctgc

SEQ ID NO: 526110 - DNA, 135 bp, Homo sapiens
gcacctatcggggtcggcccaattcgcaaaaagacggaaggaggagagagcttctgaagcttcttccaggcattctcaaggcccagagacggcttcacaccagtggtcgcagcagagatcttcacacacgttaga

SEQ ID NO: 526111 - DNA, 1061 bp, Homo sapiens
gggagtcggaaccctgaacggaagcgggctctcgccgtacgagtgtgcctgctggaggaatgccgcgtccgatgccggacagatgatgactacgaggactacgtgccctttgtgccgttaccgggcagcgccggcagactacttgctccatcagagctgctgcagcgaagcactgccacggggactctgcgagacggaagacgtcacgcagcgacacgcggctacgtgaatgcccggtgatcactgagtgatcgacatcccttctaaggcccttcagatcctacgtcagcctcctggatcatttctcagcacctttcgatgacaaggctgaatacgtcgcaaacgaggtctgcccatggagcatgcagcgtgaacgcgaccgaaagagaagatcctgtggaggagttgttgccgtagggaccgtcgcattggtgtcacgatgaagggagtctggtgtacgcgggcaatcactgccctgtggcttgaggcgcagatccaaagcgcccgcggcattggagaataccgtgccaccagtatactggttcattgtcgcctactgagtatggaacgaactcctacattgaggcccgcggattgcctcgtactggtaaactaccctatagtcgatcgcatgcgaaggcgcgtaggacgtgcagtatggtcagacccgcaagtaaatgcatctttaacagggctcccgtagagagatctttctttgcccaccaggcccttgagtatagccctcgacgaaacgcaatttgggctaacagcgcaatcgggtcaagccccgttgacacaattccgagggtccatttcgtgacacgctcctatctcgtccattcgttccttccgtaagctgtacgcagggcaccgcgttcccgggctgttaggcgttgctgttcccccgtggccccgtggcttctcgcacctgcctggtccgcagcgaggacgttcgcgctatgctcgggtgcagccggggggcccgtctggtctcttccccctgccgctggagggagggtgcgcccggtggcccctttagcggtttggggaaccttttggcc

SEQ ID NO: 526112 - DNA, 353 bp, Homo sapiens
gctcgacctggcggctttgaaacgactgactttcttcactttgccatccctttcttccataagctccccgatgccttcgtcttcgttgcccgttggactttgaagccgccttgctccctgaccatctcgttgcgccggcgatagtagtctgcagccagctcacgacgtgcaagaaggggatcgtgcgagtctgtcgaaggcgcatggtaggcgcggcggcgggtcgctcgacaagcgaatcagctaaaatcgggccctctcccgcagccggcgcttcctcctcgtttgtagcgcgagagcttcggctttgaatcgcgaaggtctggccggctttggggcagataccgtcgacg

SEQ ID NO: 526113 - DNA, 314 bp, Homo sapiens
  misc_feature (20)..(20): n is a, c, g, or t
  misc_feature (33)..(33): n is a, c, g, or t
  misc_feature (100)..(100): n is a, c, g, or t
  misc_feature (115)..(115): n is a, c, g, or t
agggaagagccccccgggcnagttcttgacctntttaagatctgcatggaggaactcttccattaccagttccttcttgcagaaggaaggggaaaccttncatttatcatgccantctgtttcatgcaggttttttggttccttacttgcacaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagag

SEQ ID NO: 526114 - DNA, 706 bp, Homo sapiens
gtaagaagaggaggaggaagatgaggaagaggaggaagaagaggaggaggaggaggaagaagagcctcagcagagagggcagggagagaagtcagaccacgccctcacggaagattctggaccctaacactggggagccagctcccgtgctgtcctccccacctcctgcagtacgtctccagccggttcctggcttttccctctccatgagaagcgtgcgtgcgccgtagggcccaagagctccgctgctgagtagcccagcgagactgacaagcgtctgaccccgagaaggtggtctctggacttcctaaaggtgtcatctgtgttcaaggacgaagctacctgtgaggatggcagtgcaggatgcagttagatgccctgatgcagaaggctttcaactcctcgtcgcttcaagtccaacagcttcctcaccaggctgtcgtgacacatgggtctgctcaaagagtgaagcagacaggtacaagagcatatgccaagccatgtactggaacgcactgatggctgactgaacgcaacgatggtggcaggaacggactatttaacccaagggcccttgcacccccatgaatgcatggcgtacgtgacacaaagaaccaaacagagcactggaaatactgactcacttcgacgagacaagatctgtgcgaaccgctgtacacaggctctagaatcaaagccacatcca

SEQ ID NO: 526115 - DNA, 539 bp, Homo sapiens
ataaggaagtaaagaatcgctgggactatcataatcttgtgcagaacctgatgcgtgaaaaggccaagaacacatgataaattgggtggagaagccgtggtgcaaagcatctccccccagcaggaaaaggagacaattgccaagtgcattgcggccctaaagctgctggcaaagaagggtcaagcccagccagttatgtaaatggatttatcccaattgagacagctagaaacagttggctgactaaatggaaactagtctatttgccaaagtctttttgggttggggtctactgaagttatagtttccccttcctaaaaatgaaaagtttgtttcaaatagtgagagaacgaaatttttatcggccagtcagatgttttctccccctttttggccccgcctttgggggggcccggggtccacttttgaaaaagcggttggcctttataaaaacttggggcctgactaaaaattaacagggtatagtttaaatttggaattaattttccccttttgcaaaaaagggcccattgaatgga

SEQ ID NO: 526116 - DNA, 495 bp, Homo sapiens
ctttgttcacaggacaagtacagagaaagaaaaagggggcccaggtgaccggtgttcagcatacggaggatccacgatccacgctggcctctgagttcccttagtatctattgatcattattgggtgtttctcggagagggggatgtggcaggatcataggataatagtggagagaaggtcagcaggtgaacacgtgaacaaaggtctctgcatcatgaacaaggtaaagaattaagtgctgtgctttagatatgcatacacataaacatctcaatgccttaaagagcagtattgctgcccgcctgtcccatctccagccctaaggcggttttcccctatctcagtagatggaatatacaatcgggttttacaccgagacattccattgcccagggacgggcaggagacagatgccttcctcttgtctcaactgcaaagaggcgtgccttcctcttttactaatcctcctcagcacagacccccctgtggaaaag

SEQ ID NO: 526117 - DNA, 284 bp, Homo sapiens
ttctatagacgctatcccctatatagaagagattataacttaatgatacgcctcataatcatataccttatctgctacctagtactgtatgccctttacctaacatcacaacacaactaactactactaccatctcagacgctcaggacatagaaaccgtctgaactatcctgcccgccatcatcctagtcctcctcgcccttaccacgcatcctattacataccagacgcggtcaacgatccctcccttaccatcaaatcaattgaccaccaatggtactgca

SEQ ID NO: 526118 - DNA, 279 bp, Homo sapiens
ttagctgatctgcgtaccctttgctcggcgcggagtggctggctgtacgctgcactctaagtgactccactcatactctcctcctataggcgcaagggggattctcgtcctcatttacagcccttcttcgagcatcctgattgctgtcaacaaacatattcaggaacgtctttagtcctggtgcaggatagaaaccttcaactagtttgctgttatcaacaagactataggcaccatcccgtattgccacaacacctcgactccagcgtgctgatacaa

SEQ ID NO: 526119 - DNA, 267 bp, Homo sapiens
  misc_feature (3)..(3): n is a, c, g, or t
  misc_feature (50)..(50): n is a, c, g, or t
aancagcctttccagcatgcggaagaaggaggaagaggagctggttgccnttatgagcgcattgagcggcgccggtcagagagagtcgagcaacaaccccttcaaaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaa

SEQ ID NO: 526120 - DNA, 161 bp, Homo sapiens
  misc_feature (92)..(92): n is a, c, g, or t
agtaatatagaggatactaaggcactgctaaggatagaacaggtaaaagagaggggcaggcagttacaggaggctaatagggaaagtacagngcagaggggagggccctactacagtaccccctatacccacgctaaaccgcccgctacagtaacacacgg

SEQ ID NO: 526121 - DNA, 322 bp, Homo sapiens
agagtgctacaggcccataataatcataaattatacatacccttacgaaccaaaatgaactacaatttgtccgcttcattcattgtccccataatccttggcctacccgccgcgatactgactcattctatttccccctctattgatccccacctccatatatctcatcaacaaccgactaatcaccaccctacaatgactaatctagactaacctcaaaacaaataatgtccatacactacactgtgcggaatgtgtatcgtacttttattgactctgtgcatcaattttaggagtattatcttagccatctgcccctggt

SEQ ID NO: 526122 - DNA, 1161 bp, Homo sapiens
  misc_feature (455)..(457): n is a, c, g, or t
  misc_feature (535)..(535): n is a, c, g, or t
tggaaaaacaaaatcagggagggtctttaatggatgcgcccacagagccacccacaattgggaaggcatgtgagtgatgtgtctcaaatacagataatctcatctcaccaaagcaaatttaaaatatacaaagttttatctcgtgcaagcggctttggcaggtgacatgtgagtgccttcaataaattataaggaaacgtgtggcacaccccgtgtcacacagaggggctctcaccttctcaggggtctcttctcacacagaaaatcttcttctcccccttctctgtgtgagagtgagaggcgcgcttctcaggctctgcgggagatgtgtgcactctctcagagagaactcacactcttctctctctctctcataaagagagagagagagacactatgtgtgcgcgcgagagtcgccccagaaggtgtctctatctctctgcgagagtgtcgcnnncttttttctccacacagaggcagagcaagagagcgcgtgtgtgtgtgagagaagcagagtgagggctcacatatctcncgggtatctcactgtgtgtgagcactcttatacacagacagagagaacacacataatctcgcacagcaacacacactctgtctctctttatctcgcatatctacagtgtggggcattccacacacagagggggagaaaaaagaaacaacaagagcgcggggggcgcgcgcggcgacatatagcggccacagtgggagagagagggggggtggccccagaaaggccgcgtgggctccgcggggcattatagcgccttgagatgcaccaccaccctccgcggtgcgcgcggggcctctcgcggtgggagatctcgcggaccccgagtgtgtgagtgtggctgtgtttccgagggcgtgggtctccccgtggggggacacaaagtctctcacacactgtggggggggggggtgtggccccactgtgggagaagaagagacaaactaccaaggcggggggagagaagtcgggaagtggggggcgtccatttccccacaagagactatgggggcccccaaaccacaaaaaagtggtgaaccgaggggggaaaagccgtgatgtggaaaccctccggagaggcccggtgggaaatccacaaaaaaaccccccttatacaaggccccccgagg

SEQ ID NO: 526123 - DNA, 902 bp, Homo sapiens
atccaagatgagatcagcacaatcttcgaatgattatatcccatatgtttataaatggtagaaagacaacctatgcctctaatcttcataagttcattgacttgattcataacacgagcttcaggaagcttctacaacgagttgacaggcagatccgactcaataacattagtggcccttcgtgaaggaatatactgatccaacgtactagttggctggacagtgatcatattatgaacgtctgacagagtgtgatagtcggtctgatcacagaacctgttacttgctcttaaggactatccattctgaatatattgtacagatgtcctctatattttacttcaccagactctcaggtcaagttgaggcaatttctggcgcagaaattattcaggaatatcttgagcatccttgccgatccaggatggtaaccagggatacggagcgaagatagtagagtcttactgtccactgctcagcgaagtgattcatcagccgggccatgtcgcacgcaggaatacaataattgtgcgtggtattgacccaccgagacaagtttgaggatcattacaccaactgctacacgatttttttcagaagcaactctctgtatttactgaagttggaccacaggaatttagcgtcttgaatccacatagaattgattgagctgttccatctcaatattatctcacatttctgatatacgatcgacggagtgactgggaaaagctgcagatctaaccgatagtcatgaaccccctacattgaagcttgctccaggagaacttactaatcattcctcctaattggtaaaagaaagtcttcatgattccttcttttcaattggaactttcagatagcaggaaaaaaattcaattgctattttgataaaacatgcg

SEQ ID NO: 526124 - DNA, 223 bp, Homo sapiens
ttagatcgactctagagatccccttaaatgggcacagcaattggggagataggggaggggagggacaagctgacccaactatatttcaaattggatgtgggcagaggggcagattacacagttaggatcttactttaaaacgtagatacttagctctaatcccactgagacgtgtactaaaagcagaaaataaatttcacatactacatcagcacaggttcaa

SEQ ID NO: 526125 - DNA, 758 bp, Homo sapiens
cggctgggaaggtcagttcgttctctcctctcctctcttcttgttttgaacatggttgcgcgcactaaatgcagacatgttgttccatggcacttactgaacacgtgggttggcctgctcgatgcccccagacacacggtgctctggttccttccgacctcctgccactaatctcgacatcacgtctcatctgaggaaatgctgcaaacataaatatgccaggagggaaccccggttgtgcgtgcgcccaactcccaagtggcaaaaacgggattggacgaattctttagcgtagtcccctaacgcattctgaaacaacgacgaactcagattcctgaagaggcaggaagcagtggcttagtgaaacagcaacagacgcaacagcatgtcctttgcaacctgatcacacaacatgatgcccaccgactagaacctcctcattcatctccgacgtaaccgtctccttgattcaaccctggctatactacgaactgtcacacttacactaaactgatgtaggtcccaacttatcgcttaggttgaacaggcatctaagtcaacaacatccacggttctccactctacgatcggttcccaacgtacgtcgctgacactctgccgaacactccgcaacacctaacccactgcctaccctcaacccccaacacatccacctcatcctccctcggcctggccttccccacccccacctcaccaagtccaacctccgctcctccacatccacctcccgccattgc

SEQ ID NO: 526126 - DNA, 402 bp, Homo sapiens
  misc_feature (73)..(73): n is a, c, g, or t
gtctccaagataattaattccatggcctccccaaaatttcctctgcctcctagcactgattcttaaccccacncagcactttctatttattagggaaattaaaaaaaaaaaaaaaacccaggccaggcacagtggctcacacctgttatcccagttacctctgggaggccgaggcaggcagatcacttgagcccgggagttcaagaccagcctgggcaacatagtgacactccactctctaccaaaaaactatttaaaaagccgggcgtggtggtaggcacctgtagtctcagctacttgggaggctgaggtggaaggatcgcttgagcccaggaggtcgaggctacagtacaccatgattgcaccactacactcaagcctgggcaacagaatgaggctttg

SEQ ID NO: 526127 - DNA, 403 bp, Homo sapiens
  misc_feature (4)..(4): n is a, c, g, or t
  misc_feature (34)..(34): n is a, c, g, or t
  misc_feature (74)..(74): n is a, c, g, or t
  misc_feature (94)..(94): n is a, c, g, or t
  misc_feature (117)..(117): n is a, c, g, or t
  misc_feature (191)..(191): n is a, c, g, or t
  misc_feature (195)..(195): n is a, c, g, or t
  misc_feature (220)..(220): n is a, c, g, or t
  misc_feature (283)..(283): n is a, c, g, or t
  misc_feature (386)..(386): n is a, c, g, or t
  misc_feature (390)..(390): n is a, c, g, or t
  misc_feature (398)..(398): n is a, c, g, or t
aacncgaacaccgaaaatcggccggttttgcggnacgttcggcgaagcatcgccccgaggaagacgatcactcngatgtcttcggcgagggcgngatccatgatctctgcggtgaantgcgccagctgcgtgacggctccgtgccgagcagtaggaagatattgcccgcgttgtagccggtgatatcgagnttgncgtcgccggcgagcgcataccccgnagcgcccgggtcgcgcgggacccattcatccaggcgacggccagaccagcggcgtcggccgtnctcgtcggagacgacagggcggttgaactggaagtcgaagtacagctcagggtccacttcggcgatcgggacgacgtcgagctgctccttgagtgtcctccanccgnccgcttgngcctc

SEQ ID NO: 526128 - DNA, 513 bp, Homo sapiens
ccccccccccggggttttggggtttttggattttgccgggccccgggggccttaattttttttgcccctttcccccccttttttttttaagtttttttccccctttttggccttttttttgggttttcttttccccccttttccggtgatttgttcatttcccgggaaacgggaaagggggcccatttgcccaccccccctccccggggggggggggttttttttaaagggggggggcgccggggttttccccttttaaaaggcccgttgggcccccgggttttttttttttttaaaggccctttgggccccccctttttttttttgttttggttccctttttggcccccctggtttttttttttggtttttcctttttcccccgggggggttttttttttggtttccgctttgttggggtttgccccttttaaaaggaaaaaaaataggagaggattcccctttgggcaaggttaaaaaaaaagggggtcccccccccggaaaaaagattta

SEQ ID NO: 526129 - DNA, 197 bp, Homo sapiens
gcaagagcatgctgatggaccaacgtcggtcttgaactcttgagcttttcccagaaggctggacgagagaccttctgtacccgggccagagggggaacccttgcactgggccagcagcctcttctctgaggctccatgtaccagagttaaccagtgccaggactgagaaaggctccccaagaggcctcttgtgggct

SEQ ID NO: 526130 - DNA, 338 bp, Homo sapiens
ctaattggttcttcgatgacgaacatttggtatcccgccctgcctgcccgccacaccccacgtcacggtgcttcgactggccctcgcatcaaaagcgcagctcgaactgatgctggcgctgctgagtgatacctgccatcgcccgattgacggggtgttgagcgaaaaccagcacctgtggtgcctgagcctatcgaaggcactgaatccaaacacggtactgtcccacgacgacgatccactgcagctactgcgtgcgtgggtcgaacccactgtctggcagcgacttcgcctgcgctttgcgcgtcatcgaagaaccaattaggaataccgagctg

SEQ ID NO: 526131 - DNA, 750 bp, Homo sapiens
  misc_feature (442)..(442): n is a, c, g, or t
tggagatggagtctctttctgtcccccaggctggattgccgtggcccgatctcggctcacgtgcaaccctccggcctccgtgagtttcaagagattctccgtgcctcagcctcccgagttagctgagactacgggcgctttccattttgcccagctaatttttggtacttttagtagagacggggttttcgccagtgttggccaggcctggctctcgaactccttgacctcagttgattccacccccccttccgcaaggcctccataaaggtgcgtgggttaacaggcctgagccaccaaacccggccatgggaggcattttactcagtgacgtgctttaaaccttttttcaaatcccttgaattccttggccatctgagggttggtacctattcattatctttttaaaaaacaccttttaacagactttatttcctaaagncatttttgttcaaggcaaaattgagcccaaagtcctgagaggtcctatgtttcctctaccccttctccaaattgcggcagcctcaccaatgtgtcacctcctatttacggcgtccctgggttccccatcatgcccttaacctggaccttttttttgaccagagtccatagtttaccttgcggtcccccgtgatgttggctattcttgtaactctggcacagtctctttctgcctgtttccccttatagtttctcacggattgttttgtgacccccaaagccttgttttcccctgtttatccctattgc

SEQ ID NO: 526132 - DNA, 660 bp, Homo sapiens
  misc_feature (16)..(16): n is a, c, g, or t
  misc_feature (25)..(25): n is a, c, g, or t
  misc_feature (37)..(37): n is a, c, g, or t
  misc_feature (45)..(46): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (58)..(58): n is a, c, g, or t
  misc_feature (64)..(64): n is a, c, g, or t
  misc_feature (75)..(75): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (93)..(93): n is a, c, g, or t
  misc_feature (96)..(96): n is a, c, g, or t
  misc_feature (101)..(101): n is a, c, g, or t
  misc_feature (110)..(111): n is a, c, g, or t
  misc_feature (114)..(114): n is a, c, g, or t
  misc_feature (130)..(130): n is a, c, g, or t
  misc_feature (140)..(140): n is a, c, g, or t
  misc_feature (154)..(154): n is a, c, g, or t
  misc_feature (156)..(157): n is a, c, g, or t
  misc_feature (159)..(162): n is a, c, g, or t
  misc_feature (164)..(164): n is a, c, g, or t
  misc_feature (167)..(167): n is a, c, g, or t
  misc_feature (176)..(176): n is a, c, g, or t
  misc_feature (180)..(181): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (206)..(206): n is a, c, g, or t
  misc_feature (234)..(234): n is a, c, g, or t
  misc_feature (237)..(237): n is a, c, g, or t
  misc_feature (245)..(246): n is a, c, g, or t
  misc_feature (252)..(252): n is a, c, g, or t
  misc_feature (258)..(259): n is a, c, g, or t
  misc_feature (261)..(261): n is a, c, g, or t
  misc_feature (269)..(269): n is a, c, g, or t
  misc_feature (443)..(443): n is a, c, g, or t
  misc_feature (479)..(479): n is a, c, g, or t
  misc_feature (484)..(484): n is a, c, g, or t
  misc_feature (549)..(549): n is a, c, g, or t
  misc_feature (552)..(552): n is a, c, g, or t
  misc_feature (586)..(588): n is a, c, g, or t
  misc_feature (595)..(595): n is a, c, g, or t
  misc_feature (649)..(649): n is a, c, g, or t
cacagctgtgtttggntgcaggganaagagagctgtnaagaaganncanangcncccntccagnagctgaattcntgaagctnagnagcngcngcnagagnaggaagaanngcnaatcgcaaggcacctntgagaaattnaggatgcagatgtntnnannnntnaantgcatagtnatgnncatgaaaattgtatttgntnaangntatgatgtgaaaaataaaaaataataantgnaaaaaatnnaataanaattanncntcaccctntttaacaacctccacaaccaataaaaccaaacaaaactccttttataaaaatatcccctccaatacctcttccaaatcataaacatcaaaaaaccaccacaaaaaaacaacaacattaaacaacatatcccattaaacattcatcaaaacccaatccaaaaacaaataaccaanatctaaaaccacataatccccgaatccaaaaaccancacanatacaaaaaaacaacacatattactgaacacccatgtgaacatgctgaacccattgatgaaaatngtngacctgtggaaccacaaccgaaacaaatgccatnnngaacacngccacacacaaacatgatgatgaatgcatgcccgcaacaaaaaaaaaaaaccgngctgaacaaat

SEQ ID NO: 526133 - DNA, 307 bp, Homo sapiens
  misc_feature (43)..(43): n is a, c, g, or t
ttttctttttaggttttccttaaaaaaaattcccatctccccnctataaaatcaaaaaaaggggtttttttttcccccccctttaaccttttttggggaagacctttttggttttcagaaattaacataaaatcccaaagcaagattccgtaaattgaaaactttgggcagttgatcagctttccctaaggggctttgcccttaaataaagggggggatgggaaattatttcaaaaatggatggaaaactgtttcctgacccataaaagggatggacggggccgaaaaaaaaactttttttatatta

SEQ ID NO: 526134 - DNA, 177 bp, Homo sapiens
aagtttccaaaattttattgggatgaaatagaacatggattgagataaaccctcaaaacaatttttaaaaaaccaaaaagtacacaaaaaaacctgaatacaaatcttaacttttgaccagctcctaaggaagtactgacttaggaggctataatagatgccaatcagtaattagca

SEQ ID NO: 526135 - DNA, 551 bp, Homo sapiens
gccgtagtggcactgttgcgctggttagcgcccgtgagttctaaaactcaagttactgtgcagatatatgcaggatcgaggtgctgtgcttcccatcagagtccacacaattgttatatctgtgcagcatgatgaagaggttcgatctttgatgatatatgatgggaatgccctaagaggagaaagtcatcaagagcatgttgtgcctgcgaatatacctttgagtgagtgatacaagtctaccatgctacaggccaagtggcagagttgttatgggtgggcctcagggtgactgctggttttgactggaccgcacagatattcactagtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtg

SEQ ID NO: 526136 - DNA, 1981 bp, Homo sapiens
gcaagttattgcactggttggcttgattgatcctgattacaaggaaaaattaggtcactactccaaatatgtcagcaaaccaaaaagattacctaggatgcctccaagtccaactgcaaagattaatggaaaattatatgtgtgtgcgtgtgtgtatgtgtgcatgcatgcatgtgttatatatatgtatatatttatatttatatatgttatacatttatatatgtaaaaccactgaggatttgaggattcagatatcctaggagtaaagatttgagttcattccttttttccaaggacaaaagacatatgacattgataataaaataaagaagtgaaaaattctactgtagcttttgttattaactataaaataaaaactctactctgcatatttttatcatatatttgggtatgtgagtatatatgtgtatgtatatgtttgtatgtatatgtatgtattgactaatttctttttctcttccctcatttcatttattattttatgtaaggcttggtggtggtggcttacattaggatttagtcttgaggttgcagagtattccagtgggactgtaactgaaatagaggactactgaacatcactagacaagtataaattatggtcaattagagatgaatacgtgagagtttagcttttataccacccttgttagggagaaggtgagagtgatttcatttatacagctatacatttaacttgttatatggcagcataaaactggtattgttttgaatggaagttcaagtacgtatacatgaccaccaaggatgaactgtgtcccaaagccactcttatatactcttcttggagaggctgagcctgaggatctgagaactaccttctcttttcagctgttagttttacctaattggggacactgaggaaaatgaaaaggcagggagaaaaattttgtttatatcaacatcattctagcagatggtgtttcacacaatcaaactgcagttggtttacatctcaagctggtatagtcatttccagaaccagccttgatgtgcacacacagagataccaaaagcagatgggtagtgcctgctcccagaggcctcagtcccaggtcacaatgtctaatctccacaagcttgaagtaccatcattagccaagcatcacaccatcctcagagatctgagcctcagctcctagtgtgctcctctctgaatttctcaggtacaagaattagtcaaatatatttgggttctcaagagaaatagaagcaacagtatatatacaggcacacctcattttgttgaggttcacttttattgtgtttcacaatgcaattttgttgtttttacacactgaaggtttgtggcaacaaccctgtgttgagcaagtctatctgcactgttttttcaatagcatgtgctcacttcaagtctctgttacattttggtaatcctcacaatatttcaaactttttcatcattattatatttggtatggtgatctgtgatcagtgatctttgatgttactgttggagttgttttgggacacccggaatcatgcctacataagactgttgtgtgcgttctgactgctccatcgtcaggcccttcccctgtctctctccctgtcctcggaccttcctattctctgatacaccacaaaactaaaattaggccaactaattaccatacgatagccactaagtgttcaagtgaaagaaaaagtcacacatttctcaatttaaatcaaagactagaaataattaagcttagtgaggaaggcatgttgcaagttgacataggctgaaagctaagcctcttgtaccagttagccaagttgtgaatgcaaatgtaaagttcttaaaggaaattaaagttctactccagtgaatccatgaatgataagaaagcaaaacaccagcatggcacatgtatacatatgtaactaacctgcacaatgtgcacatgtaccctaaaacttaaagtataat

SEQ ID NO: 526137 - DNA, 426 bp, Homo sapiens
  misc_feature (41)..(41): n is a, c, g, or t
  misc_feature (43)..(43): n is a, c, g, or t
  misc_feature (76)..(76): n is a, c, g, or t
  misc_feature (108)..(108): n is a, c, g, or t
  misc_feature (136)..(136): n is a, c, g, or t
  misc_feature (149)..(149): n is a, c, g, or t
  misc_feature (162)..(162): n is a, c, g, or t
  misc_feature (210)..(210): n is a, c, g, or t
  misc_feature (220)..(221): n is a, c, g, or t
  misc_feature (224)..(224): n is a, c, g, or t
  misc_feature (226)..(226): n is a, c, g, or t
  misc_feature (260)..(260): n is a, c, g, or t
  misc_feature (277)..(277): n is a, c, g, or t
  misc_feature (288)..(288): n is a, c, g, or t
  misc_feature (297)..(297): n is a, c, g, or t
  misc_feature (303)..(303): n is a, c, g, or t
  misc_feature (305)..(305): n is a, c, g, or t
gacaagggcaagaaaaatgctggaaatgcagaagatccccncncagaaacccagcagccagaagccacagcagcancgacttcaaaccccagcagcatgacagacacncctggtaacccagcagcaccgtagcctntgccctgtaaaantcagactcggaancgatgtgtgctttagggattttagttgcatgcatttcagagactttangtcagttggnnttnantagctgcttggtatgcagtacttgggtgaggcanacactataaagggctanaaggaaatgangctttctcnatatcntnctctgtacaataagagtgcttgttgttgagagttaccccttgctgtgtctcagcctgctactggacccacactgttagctgggtgtcactgctttgagcctgactgagggtaatggactat

SEQ ID NO: 526138 - DNA, 642 bp, Homo sapiens
  misc_feature (25)..(25): n is a, c, g, or t
  misc_feature (30)..(30): n is a, c, g, or t
cctcgtgggcaggtatagccgcacnacacncccggcgtatacggtgataaagaacaggccaaatgccgcgacaatgagaatgcccgacagcaggatgaaatcctgaggccagaacgtgcgccgaaaataaagaatttacgctccggcaggttccaccacaccgcctggtgaccgccccaattcagccacaccgtgccgaagtacaacaggaacagagcggcaccgccgaccatgcgcaagttgcggaacaagccagtgaaggcgcgggtgtagatcttctctctcgaagcgtagaggtcgacggtcttggcaggcggggtaacgtcatgtaccggtatctggtcgctcatcattgcatcccacggcggtggagatttgcctcggccagtacgtgccagccggggtcaaattaagggtgttgcagtggcctaatgatacgcccccgatggtgcgcaaagggtgcgacctttggtcgcgttgggggaaatcaattgatggtgtacgtgacctggatcaattgacttggcaagtatggacggtttttgtcggtaagccggtcattcgtcccatggattgatcagtgcaacgccgctcgattggaagtcgctgatgttgcgcgtgacgacggtgagcccatgaacc

SEQ ID NO: 526139 - DNA, 226 bp, Homo sapiens
tcaccttcatcgctggtgcagaagaggcaccacacccggctcttctgcactgacatgaacgagcgggttgggaaaagtggaaacattccagcaggcacgactgttgacgctgaaaatcacccaccccactgagttcgacttctacctttgtagtcccgctggcctcctggggacaagcaggccttcgctctatcacgtcctctgggacgactatcgtttctcctct

SEQ ID NO: 526140 - DNA, 676 bp, Homo sapiens
  misc_feature (102)..(102): n is a, c, g, or t
  misc_feature (115)..(115): n is a, c, g, or t
  misc_feature (146)..(146): n is a, c, g, or t
  misc_feature (221)..(221): n is a, c, g, or t
  misc_feature (224)..(224): n is a, c, g, or t
  misc_feature (234)..(234): n is a, c, g, or t
  misc_feature (240)..(240): n is a, c, g, or t
  misc_feature (242)..(246): n is a, c, g, or t
  misc_feature (248)..(248): n is a, c, g, or t
aggatgtctgcctcgctcagagaagaggctggcgtcgatccgagaaaccgccgatgtacaagcaggtattctgcgcctccgccgacctcgctcgatcacgcngagccaccgcatntgccgactcactcaagaggcgaatatcttgntgcgctcctcgatggagattcaagggcgtgacatccttggcccgcaatggcgcctcttgctgatgccagacgtantanaaaacattgncaaccntnnnnntnaaaacagccagcgcataatcacctcaagacaaaggacacgccatcgccaaaccaacaaacaccaggtccgggaccagccgagcctgcggcgcagcatccctgaccaggtcggcatcgcctccagtgaggaagaccgtgaaatcctccccccaatagcctcgcgccaactcgagctgagtcagcacgaaacctctaagcatgagcgtacaaccacgctcgacggcctctacggtcgtgcgacctggagagagacgctccagcgcccgctcagcggccgcgtcgtcgtagcgtatcttgcgagtatgggttcgcagttgattacgcataagcggcatacccggaaaaataaaactacctcaggtagctacccactggttggatcggttacgaagaagcaggtcagcgttcaccaaattacgtatgctctt

SEQ ID NO: 526141 - DNA, 117 bp, Homo sapiens
tatcaacgaaatgtgggatgtcaaaataaacagcttcatattcctctatgtacctagacatcaacaacatcgtagagttacttcaggaagtcggagtccaagttgattgttcctgct

SEQ ID NO: 526142 - DNA, 242 bp, Homo sapiens
cccgagagaatacctgctgctcccgcgagaattcctagctgcacccgcgagaattcctgctagctcccgcgagaattcctgctgctcccgcgagaattcctgactgcccccgagagaatacctgctgcgcccgagagaataccagctgctagggctgcaataatgaagggcacgatgaagtgaaaggtaacagactcgtgtaagggtgggactgtctactgagtagcctcctcagattcatt

SEQ ID NO: 526143 - DNA, 426 bp, Homo sapiens
ttccaccaatcagtcaagccaggtgcatcaagattatgagtagcatggtaaggccagtgaattccatgagcaaaagtccattgtcacacttgtttgagtttgaagtaagttccttagtcagaaggaatgctgtgtggaatactacgacagtggataaggcattctgtaagtccaaggatgacatttttggaagaaactttgcatacagggaacataaatctatgtccagggtaagtgtctgtttcagtaagaacaaaactctgtcccttccatgatggaatcagtccaatgtaatcaacctaccctcaggtgtctaactgatcacctcagagaatggtgtcatattgtgggctcagtgttgttctctgctacagccagattgggcattcagaggtggctatacaaataaattatatatcagtttta

SEQ ID NO: 526144 - DNA, 107 bp, Homo sapiens
agcagtccccgtgcaccctgtctctggcccatgtaggggctgcagcactgtgggcgcctagtagcacagattaaactctcaaacccacggtgtatcctctagtagtc

SEQ ID NO: 526145 - DNA, 188 bp, Homo sapiens
gttcccatcaagacttactcgatctggccaccaacaacaactacagcatgtggatagcttacagaaaatacagcctgctgtggaaatctctagccattcctctggcactcccttgatgtgaggttcttctgatcgtcttggagtgatggtgtcgatgttgccattttccaaagccacaaaatccccgt

SEQ ID NO: 526146 - DNA, 350 bp, Homo sapiens
  misc_feature (37)..(37): n is a, c, g, or t
  misc_feature (280)..(280): n is a, c, g, or t
  misc_feature (320)..(320): n is a, c, g, or t
tgtacctcaaaaaatcctttccgaattgtgcctaagnctccttcagattgtcccccttttaaaatttgaaattagcccagatgtggtggcttacacctgtaatccccagcattttgggaggctgaggtaggcagatcgcttgaactgaggagttaagagaccagcttgggcaacatggtgaaacctcgtctctacaaaaaatacagaaattagccaagtgtggtggtccacccctgtagtcccagctgctcaggaggttgaggcgggaggatcgcttgcncctgggaggtcaggactgcagtgagccatgcctcaccacntgtaatccagcctgagttacagagtgagac

SEQ ID NO: 526147 - DNA, 977 bp, Homo sapiens
  misc_feature (39)..(39): n is a, c, g, or t
  misc_feature (48)..(48): n is a, c, g, or t
  misc_feature (262)..(262): n is a, c, g, or t
attcacaaatcacaccatacatgcgcgtgtgcatgcganacgagcgancacacacacacacacacacagtccagcaccctcatcagttctctggtttaggttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagnacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgaagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatcaaaaaaaaaa

SEQ ID NO: 526148 - DNA, 447 bp, Homo sapiens
  misc_feature (8)..(8): n is a, c, g, or t
  misc_feature (25)..(25): n is a, c, g, or t
  misc_feature (50)..(50): n is a, c, g, or t
ccaatttnccccaactggcgaaaanggggatgtgcctgccaaggcgattnaagttggggtaacgccccgggttttcccccagtccacgacgttgttaaaaacgaacggcccagtgcccaagcctaaaattaacccctcacctaaagggaataaagccttgcggccgcaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatcaaaaaaaaaa

SEQ ID NO: 526149 - DNA, 368 bp, Homo sapiens
cgagcggccgcccgggcaggtacaatggaatggaatggaatggaatggaatggaatggaatggaatggaatgatacggaatagaatggaatggaacgaaatggaatggaatggaatggaatggaattgaatggaatggaatggaatggaatcgttccgagtggaataggagggaatgtattcgagtggaatggaaaggaatggaatcaaccagagtggaatggaaaggaatggaatggaatggaaactaatagaatggaatcaacccgagtggaatggaatggaaaggactggaatggaaaggaatggaatggaatggaatggaatggaatggaatggaatggaatggaatgaaatcaacgcgagtgc

SEQ ID NO: 526150 - DNA, 897 bp, Homo sapiens
  misc_feature (39)..(39): n is a, c, g, or t
  misc_feature (48)..(48): n is a, c, g, or t
  misc_feature (262)..(262): n is a, c, g, or t
attcacaaatcacaccatacatgcgcgtgtgcatgcganacgagcgancacacacacacacacacacagtccagcaccctcatcagttctctggtttaggttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagnacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatcaaaaaaaaaa

SEQ ID NO: 526151 - DNA, 794 bp, Homo sapiens
caagatggccgcccccgtggatctagagctgaagaaggccttcagcagagcttcacagccaagagattattgacactcaacatgaaggtgaagctcgcagacagtacagattgaacagctaaacagaacgaaaaagcatgcacatcttacagatacacgagatcatgatcgttgtggtagatgagactagaccatgtactgaacggtgtacggaaggaactgtcttcatctacttgcatgttgccaagggtagaggcatattcagcacgtcacgctcgttagagaagcagacatacatagcagaagaacacacagattaaagaactagaacagaaaaagtcctacctggagcgaagcgttcaggaagctgaggacaacatccgggcggatgctgatgtgcactgaagggcccaggtagggagcctctctgggaagctcttcctcctgcccctcccattcctggtgggggcagaggaagtgtctgcatgggaaagcagcgttctgcctctgctcccgatgggagtgcttctatcttcgcgatggcctggcaacatgcacattatttcgtgcatcaccctagagacccccattatgcttccccagcccgtggcagttatctacccgacctttgaccatgccacgctctggccaggaaacgacttgccgtctcgggatgtgtgatgaacgcccaggagcagggaatgatgggagccagggcatagataggaatgctctgccgtgagctttccagctaggcacgccagtcagagcaagtaaaaagcgtctgttccagt

SEQ ID NO: 526152 - DNA, 222 bp, Homo sapiens
cgagctcggtaccccggcaactgcttcggatgctcaaaaaaaaaaaaaagaaaagaaaagaaaccagtgcagtggctcatgcctataatcccagcactttgggagactgaagtaggcgaatcacctgaggtcaggagttcaagaccagcctggccaacatggtgaaaccccgtctctactaaaaaataaaaaagttagccagttgtgggggcgtgcgcctgt

SEQ ID NO: 526153 - DNA, 172 bp, Homo sapiens
ctcactcccacccccagccaatattctgcataagcaaaaattatggttaagctaagctgaatggggtatattcaaagtaagtacagacggcaaataggcaggcaaatacaggaatactttacaattagcccaccatggactattttgagtctctccatgggttccataattc

SEQ ID NO: 526154 - DNA, 925 bp, Homo sapiens
ttatttgctgaaataggtataacacttaaataaaaattaggcaaatgtagaatatctccttccatgaaatagagcagcaagagatagcaagtgtgcgggagaagtcctcgaagccatgatatgcctgatgaatcggtgaagaaggaacgtgaacctccggccggggggattcgctcatatagatacctaaagcagctgcactttacctagggcgataagacagcaacaagcggagcacaccgcgcagcgagctccgacgaacatgcagccaacgaatccaatagagaagaagggaagcgaaaaagcagcgaacaaagaacaaagcaaaaaaaaaaataaaacgaacaaacacacggccaagcaacgcccaaaacacacgacaaaagaacaacacgagcacacaacagacccataacgacaaggagaacgaacacgcgacacatacagtcagcacgcacacacaaacacaatgagcacaaaatatcgcaccaaagaaagcaaagaggaagaagaataagcaacaagaagagcaaagcacgccacggcccacagaacagacaacaacacacacacaaaacacaaaacaacaagatgagccaggaaggacagccaaaaacagccacgacccgcaacaacacacgccaacacaacaaaccgaaccacgcgcgagaaagccagcagcaacaaacagaacaggagggcaaggacgagaggcacgaaacacagaaatgacgagcacccggccaccgaacggacgagacgagaagagcacagagaaagacgacagacaacaagaaaagcagagagaagaagggagagacagatcgacgacaaagagacagacaagaaaagaacgacaaggaaggacgaagacaaggaccaagaggaagaaaaaagacaaaaacagaagaggagagagaagcag

SEQ ID NO: 526155 - DNA, 146 bp, Homo sapiens
acttttccctcccatctcatcttgtgactctcaccagccatggtgagagaatcgaccctcaggggggtgtactctcttataccctcctggtacagcacttggtgaggtcggatatgggatggtcttatcatggcaggagcgtgtgg

SEQ ID NO: 526156 - DNA, 770 bp, Homo sapiens
  misc_feature (290)..(290): n is a, c, g, or t
agcgggttggtgatctgtggatgttctggttagctagtacacgaagcgagagtatgaggtcgagctccgagcccgggctgcgtgccgggcattgcagggtgccgcaggagcacagcgtgctgttcatcccaggcatcataacgacttgcgaccactggaaggcccggacgcgcggactggtgcctggtgcgagctcgggctgttgaacacgggatgtcgcagaatcctgagaagaaaagagactaactgcttgaccttcgtgatctcacaggttggtctacgatgcatancttctagactccgggaagacgatttcctctccgagctgaggaatgtcctatgctgatgacctcttggtctaaactaactgcttcgatatactcgaccacgatccatggtgcccatccaatggggtctaggctgatagccaaggacactccatagtaagaaagcaaccttcttggctctgagatttgctcatacgcgctgagcgaaacgtgctctatcgggtactgtgtaatgctgcctgcgtaccttgaccgctgcatgcgggggtctcaaattccgttaccaagacggtaggacgaggggtgggcgcccctcgcattcccttggaacgccttgcggtcccgatccgttcaacggctcaagagacagctccagcgtcactcattaattcgagggacgcgggggaacttacgtttaactgggtacggtgggcgtgttcgtcgtccagaccgtctctttgaggaggggcgtacatggtttgc

SEQ ID NO: 526157 - DNA, 1029 bp, Homo sapiens
  misc_feature (101)..(101): n is a, c, g, or t
tgtagtggtcttccctcgcacacaggccctgggcggtttgctgtcctcttcgttcgtcgcgcctcgcagtgtttgggggccccaaaaggtgtttgggtaanttatggaagctcccagcccgtgttgtagttttgcacagagctggtacaggccttctcctttggggggtgtaccgccttcccttttagtgctcttggagaaatctcggaaaaaagtgtccgccgcgccaaccggaagttcccagaaggaggaacctgtgtcggcgaggccggggtagaaaataaggagatttccgtgagagactggatgttcaaaggcttctgagcctttaggtaagataagcctaatatcccggactgatgaaaatgctcttttctggaaatgaggaactacccgtcccaaattaagtgtgataaggagaagaacctgctgcacatgtcacacgagccccggtttaggaatgacccacgaggaagagttggtttaaaacccttggtgacccactagccccaattctgggacccaggcgagtttttaaacccaaatgactgaagcaccacggaagatggcccgtcacaacttctgaattgattggccacactttggtttcgcgtttctattccgccctctccttgtaccacgataaggttattgtcacacttcactaccacccacccaccgaatactcacgccaccacttctgggaattctgaactccacactgagattttcctgtaattgctgaccccagaggaaaccactcttaggacggggaacgcaccaattaccccttgtctttaaaagaagaagcatcttgattacccttgaattggacaccaatttaaaatctctgtccaaaaaatattccccagttctataaactttcctatttatgtatggagccagccagactgaaactgttgaggagcccctggaggaagaagaacgccagccccaagaagagaaagaagaatttgatgatgaagctgcagtagaggaagaagaagaagaaaagaaacccaagactta

SEQ ID NO: 526158 - DNA, 329 bp, Homo sapiens
ccccccaggggggggtccccccccgggggggcccctttttttaagggggcctttgggggggtttttcccccccccttttgggggggcccgggcccccttttcccccccccggggttttccgggggccccaaaagggggggcccccttttcccttttaaatttttttttttcccccggggccccccccccccccttttggggggcccttcccccccgccctggggggggttttattttgggggggggggttttcccctccttttttttttggggggggggcccccaattttttttggggggggggggtttttttttttttttaaaattta

SEQ ID NO: 526159 - DNA, 90 bp, Homo sapiens
  misc_feature (50)..(50): n is a, c, g, or t
atgttaattagcttgttttaatcattccacattgtatacaaaattatatncatgtcaaaacatcacactgtatgccacaaatatatgatc

SEQ ID NO: 526160 - DNA, 935 bp, Homo sapiens
ataatctcccatattgtaactgactactccggaaaaaaagaaccattaaggatacagtaggtatggtctgagctatgatatcaattggcttcctagggttaatcggtgtgagcacaccataatattgtacagtgaggaatagacgtagacacacgagcatatttcactccgttaccataatccatcgctatcccaagcggtcgtcgaagtattcagctgagtcgccacgagtccacggaaagcaagtatgaaatgatctgctgcaatgctctgagccctaggactacatctatctgtaacaccggtaggtggcctgcactggcacttgtataagcaaactcatcactagacatcgtacatacacgacacgtactaaccgtagtagctcacgtaccactatgtactatcaataggagctgtatttgccattcataggaggcttacattcactgatttcccctatatctcaaggactaaacccctagaccagaactacgccaaaatccattatcaactatcatattcatcggcgtaaatctaacttgctgcccacaaaactttctcggctatccggaatgccccagacgttactcggagtacccgatgcatacaccacatgaaagatcctatcatactgtagggctcatgccattgagtctaacagcaggacagtatcaataatatcatgactctgagaggcctcggtacgaagcgaaaaggtcctaaaagtagaacaaaacttcacataacgctggagtgacgataagggggaagcccagagctacacaacatacgaagaaacccgaaaccgtaagatctaggaagagaaaaggacaggaccgaaccccaaaggaggaacaaggcaacccatgcacacgaaataacaagaaagaaaagacaaaaaaaacaaagaggaggacgacctaaaaccaaaa

SEQ ID NO: 526161 - DNA, 365 bp, Homo sapiens
gcgtcgactatgaagttctccaaccaccatggaattaagccagaaatgaacagaagggaaagttgggaaatccatacatattcagaaattaaacaacacgactggacacagtggctcacgcctgtaatcccagcactttgggaggccaaggtgggcagatcacgaggtcaagagatcgagaccatgctggccaacatagtgaaaccccgtctctactaaaaatacaaaaaaatagccgggcatggtggcgggcgcctgtagtcccagctactcgggaggctgaggcaggagaatggcatgaacccaggaggcggcgcttgcagtgagccaagatcacaccactgcactccagcctgtggtcgacg

SEQ ID NO: 526162 - DNA, 132 bp, Homo sapiens
  misc_feature (86)..(87): n is a, c, g, or t
gataacatgggtggatttattcttagattgagtgcaactaaacagacaacagctttcatcagatacacaatctaacatctgcatcnnttacagagtcaatatgatactatatgtactgcatatatttcatca

SEQ ID NO: 526163 - DNA, 265 bp, Homo sapiens
gtccacttcagtctcttcagcagagaacatggctcattcactggtctctgtttgtttcttcattcaccccaaaggtcgcgattaatattattgacctctctctctatcatgccacaatatctcagtgcaattcagacaattgtgtcacacaatcttctgtatttgactacagcagtcataacaacaaggttgtcggaacgtcggcaggtctaaaggctagtaaggtattcacaggggcttccaattaggccactcaggtttgtag

SEQ ID NO: 526164 - DNA, 913 bp, Homo sapiens
  misc_feature (355)..(355): n is a, c, g, or t
agcgggtgggtggatcggcgggtgctgacgagtgcagccatggacaccgaggtgaacctcagccgcgctgaagcggttggatctgcgcgaccctgcgagctcttttcgagaggcatggagtggcaggagatccgcgggctggagcgccgggttccgagtgcctggaggatcgatgcacacatgcaaggagtgatctgccgagcagagtggtgggcgacaacggtacctgcagaccttgatctgtaggcgggacgacactcgatcggacgagaatgcgccgaatgctgcgcgtgggagtctagtgtagcgccgatgaataggcacatcgatactagtatcatgcagtccgcgactnctccgtgctaggaccagggcgtcgagcctgacgcccacggcttcaaccgttggcgccctggtcgggcactcaaggcaaggcatcccaaagagaatgttgtaccatgcattggagtagtgctcagattctaacgctacctcttatgacaagttccggagtaatgattctggaagctcgagtaaggagagcactctacagttgtcttccacgccataacagagttatatccgtgcatccgttgcggaccggacctccagcaggctcgtgctccaggctgtgatatgctgctaggtttagccgaataacagatcgacgttgctactcaccgggtttccatattactcaatccgagtgcaggatggtcggctcggcattcacactgtccgtgtacaagctattctgtcttgacaaagcaagcatgttggctcaagatgccagagggtgtgctctgcacgaggcatggtggcacgaggtgccttgtgtctctataattgctccttacgaaagggagttttcactccttaaggcctccaccagactttcctggctgggctgaaa

SEQ ID NO: 526165 - DNA, 322 bp, Homo sapiens
tcactctcatgtgtgcacgcatgacatttaggcacttttaaatccagtacgtagcggaatagatgatcttcattagactcatggtgtatctgagctctgctgccaaagggcctatagatgattttgcctccagaaaagctcttcgtttccaaatgcttcattactgagagacgtgcttatatccagaccgaagccttctttttgcctccaaggcataataaatgggaatcagggacatgagaacagaagcgactcccatttctgtcctaaatgaactagatggctattctaagatgtccgacttccgtattgtcagtgagca

SEQ ID NO: 526166 - DNA, 246 bp, Homo sapiens
aggtttgacctttgggaggtgataaggttgtgagggtagagccctcatgaatggcatcagtgcccttacaaaacaagccacagagagctccctttctgccttctgccatctgaggacacagtgagaagacagctatctgtgaaccagggggttggccctcaccagataccaaatcttctgggactttgagctaggacatcccagcttccagaactgtgaggaataaatttcagttattgataaaaa

SEQ ID NO: 526167 - DNA, 148 bp, Homo sapiens
tgctgggattacaggtgtgagccactgtgcctggccagtttttcaggtttcttgggcatcctcttggccaagggggaagggtctattcagtgggtggggggtgcttaagagtcactttgggtttacataccgtatcaatggctgtgta

SEQ ID NO: 526168 - DNA, 271 bp, Homo sapiens
tgccgttggggctcgagagcggttggcccaccctggctcgggcagctctgttctgctgcattctcccgtctgcctgtcgccacttgtcctgcaggtgccgtctggccccgcggcagtgtcacaggacgtgggcagtggagacgccatgtctgcccgtgggcgctctggagtggagcctacctggcttcttgcgggccttggcgcttctccagctaacctgtgggttctactgagactgcagtacgggctggatggtccgacgagagcgata

SEQ ID NO: 526169 - DNA, 448 bp, Homo sapiens
  misc_feature (1)..(1): n is a, c, g, or t
  misc_feature (352)..(352): n is a, c, g, or t
  misc_feature (376)..(376): n is a, c, g, or t
  misc_feature (388)..(388): n is a, c, g, or t
  misc_feature (428)..(428): n is a, c, g, or t
  misc_feature (437)..(437): n is a, c, g, or t
naaaaatggtcaatatagtcttcagttgtttaaaggcattatttttactcattttctacaccccttcctttttatattactttagtcatgtcaaagaatttttagaaaaagttgcttcttctgttatttttaaatgatgtcttatttttcagtgataattttaatataattttaaattatatatcctcctgggattctcatcaaaattattttgtcaagtatgccacaattgtcagaaggcacaaaatacaaatagttatggctccataggacataaaggaataggacctggctaggttttatgatctgggcattcttcatttcagtaactgtgtgaggtcacctactgggnatggcctccatttttctaggcggntaaaattagggntaatggcatttttggtaaagggttccaaaattccctggantaggggtgngtttgccatat

SEQ ID NO: 526170 - DNA, 89 bp, Homo sapiens
ctttaccttttctataaggtggaccaaaacatccccttaagttttttgatttggacccattccttcaaaataaagaaatttggtaccca

SEQ ID NO: 526171 - DNA, 140 bp, Homo sapiens
agggggctgggggggggggggggggggggggccagggggttttccccccgggacccccggggggggggggggggggggcccctttagggccttttttcccttgtttcccccttcccccaaaaaatatttgggttttccca

SEQ ID NO: 526172 - DNA, 982 bp, Homo sapiens
  misc_feature (588)..(588): n is a, c, g, or t
aactatggtctaggtcgaggctggttgggagcggagagcggaccagagagcctagcagccacgccgcgcggcttagttcccatcacaccccgggaggagccgcagctccggagccggcccagtcaccatcaccgcaaccatgagcagcgaggccgagacccagcagccgccgcgcccccccgcgccccgcctcaggccgcgacacaagcccggataggaggggcaggagcggtgcccgggcggctcacatcggcggcgcctgccggcggggacaagaaggtcatcgcaacgaaggtttgggaacagtaaaatggttcactgtacggaaccggatatggtttcatcaacaggaatgacaccaaggaagatgttttgtacaccagactgccataaagaagataaccccaggaagtaccttcgcagtgtaggagatggcgagactgtggagtttgactgtggtcgaaggcgacacaggggtgcggaggcgcaattgttaccggtcctggtggtgtccagttcagggcaggtaattcagcaggaccgtaaccattatgacgctatccacgtcgtagcgggtcctccacgcanattaccagcaaattccagaatagtgagagtggggaacgaccgacgggctcggagagtgctccgaagggccaggcccaacagagcccggccctaccgcaggcgaaggtcccaccttactaccttgcggagacccctattggcgttcgacccacagttttcccacccttctgttcagcgcgcagtgatggcggctgctgacacccaggtgctggagaccgggtacaccacgtgggccgcactattttcgggtctgccccggactcggggggcctcttgcaagaagcctaagaggacgcctgagcgctagacactccgggttgacccaggtgcgccctagtggtcccgcattttgggggggcgaactacagtggggaaggccccggatccccgcggg

SEQ ID NO: 526173 - DNA, 277 bp, Homo sapiens
gggggggtaaaattttttttccccggggggccccctaaacccccttcccccctttttggaaggcttggggcggggggatatcccctttccaaaagggggaggttttagggggggggttttttttcccctttccccccccagggggggggtttcccccccaacccctttttggaaccccccttttggggttttttttttgggttaaaaattttgggggggggccccccccccccaaaaaaaattttttccccccttctgggggggggggtccccccca

SEQ ID NO: 526174 - DNA, 329 bp, Homo sapiens
ccctcaggagggtccctgctcctgtttgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaccatatgtcatgctgagccgcggtgggtcacgcgtgtatttccgcaccctttgggaggtctgggtgggagcattgtttcaggttttgagttccaggccagggtgtcctaaatagtgagaccccatttttgtttttgaaaaaaaa

SEQ ID NO: 526175 - DNA, 244 bp, Homo sapiens
atctcaggcagggacgacgtctttcatctatctctcctgcattgtgctgtttggggcctgcattgaaggcgtggtcttacgagataagttcggggaggccctgcagggaacctggtcatcggcatgctggcctggccctccccctgggtcatcgtcatcggctccttcttctccacctgcggtgccggcctgcagagcctcacgggggcaccgcgcctactgcaggccattgcccgtgacggca

SEQ ID NO: 526176 - DNA, 1173 bp, Homo sapiens
cggttggcaagaacaagcgccttacgaaaggcgtgcaaaatagggagccgaagaagacaagtgtgttgatccattcttctaagcaaagattggtatgatgtgaaagcacctgctatgttcaagtataagaaatatgggagaagacgctcgatcaccaggcacccaaggaaccaaaattgcgatctagatggtctgcaaggagtcggtgctgttttgcaagtgcagtcttgcttgcatttgcgagcaatgcatgcacgagatctgccattctcagcacaacatctccaaggcgtgccattactgcacagcatggttccacgggtcacacaacagcttgcctgacataaccttccagtggaccatggactcttacaccgatgaacaaacagtgtgattccagtggctcaataaacatgggcagacagatgacttgaaggctcactgttgcatgtcgaagactaccggatggttactttgcttcgttctgttctggtgtctggttttacatacaaaagacgcaacagatcagatagcggaacgacctcttcatgctcagacagcacacaggtccgacaaatccggaagaacgatgatggcacatcatgacccgagaggtgcagacacaatgacttgaaagaagtggtcaatcacattgattccagaccagcattggacgcacgacatataacacggcttgccaatctactcaagtcctacttccaagaaagcaacgcaggaagaagcgtaaacaactgcttgaagaaagctcccacgcgtcgacattgggcacagcgtcacgggacgctcccagggtgaaaagccagaatcctgcgaaacgagcactcgcggcacaagaccggggacaacctagcacgagccgcggaataacaccaacagtccaacaatcgccaagcgcaagactcccccgtagcccaaaacaggcgaccggaggagccacaaacaagaaaaaccaccgacaacaaacggggagcagaaagcgctccccacgccccagcgaaaccaaagagaccaagccaagaggaaaaggcaacaacaggacgtaaccgccgcaccacgcaagcggaccagcagcaacaacacaaacccagcaaacagcggccaaacccgagccacagcacgcaaacccagtagcgaaaacaacaagacagcaga

SEQ ID NO: 526177 - DNA, 314 bp, Homo sapiens
actggatttggggtatatgggaactctttattttcataatagaatttcatactactattggaaagacagtttattcctgtaagagataattcatgcaattatcataatagtatttcataacactattatgaaaatagtagagttctataaatcaaaaactattttaaaataaaaaaaaatttttaatgtttatgtccctaacaggtgggagagaaggtgaaaaagaccaaggaaaccctcaaggtttcaggttctaggtaatgacgaggaactctgctcaggggacgggagggctgggctctgtacccgcacag

SEQ ID NO: 526178 - DNA, 278 bp, Homo sapiens
  misc_feature (15)..(15): n is a, c, g, or t
ctaactccttctgtngcctatgccttcttcctgtgactgatcagcccttctttcccttcctccaaaaaacttatttcactccatactggtgtgccacccttgtcttcagatgagaatggagtctgaatggccttcctgagaacgagttctacccgttcctttgtttccttgcaaccacccttgttcctgactcagataacaatctagcctttgtggaatgtgatctacctgatgcgacccttagttctccccagagccttctcttgccccaccagctt

SEQ ID NO: 526179 - DNA, 114 bp, Homo sapiens
tggcagcaacaagtgtttcagaaatgtttaggtgccagcacaagcacaaggcagagaaaacatttcccgactgagaggaattaaggctgctcttccaagaagcttactgaaatg

SEQ ID NO: 526180 - DNA, 629 bp, Homo sapiens
gtctgaatgttatgaggcttccattcatgagaaagttaatattgaagaatttgagtttagccaaatcttacctgtttttttgggacaaggttgaacgctgttatttcttctttgagtgcttttggttgggaaccacaggccccagaacaaagggaagccttgagggattgggacgctggttggcagtttttggctataatgaaccctgcaaaattgatgggtgggcccaaattggggattattgctttggtttaatattggtgtggaaaaataattggtgtttatccctaaagaaaatgctttccctgaatctttatacaacagaggcaccagaaggatgaatgatattctgaatcacaagatgagagaattctgtatacgactgcggaacctggtacacagtggagcaaccgaaaggagaaatctcggacacacaggacgtcactgatggaggagatattccgagtggtgtgcatctgtttgggtaatccaccagagacattcacctgggaatatcgagacaaagatcaaaattatcagaaaattgggcccataacacccttggagttttacagggaacatgtcaagccactcttcaatatggaagataagatttgtttagtgaattc

SEQ ID NO: 526181 - DNA, 579 bp, Homo sapiens
agcggaaggaggtggcgtcctccgcggcattgcgagcaccgccagtctgcgccgccaggcgtaggcggggtggcccttgcgtttcccgcttccttggaaaaacccggcggcgagcgaggcttgcgggccggcgctgcccttccccacactccccgccgagatttctcggtgggcccaacatggcgggtggccgctggggcccgataagggctcctggccgctggatcgcggctggggggggaaggcaggccccgaggaggccggcgccgccggagacagcagccgggtccagcccaattgaccgcctccaaatgtgaacgctggtcgatcaaaggggccagattagacgatggcttgacattatctaccgcccccaatgggatataccaatcctgccaaagacaagaactgaattccaataaactggggagaaggctttttcgaacaagtactcgtgtgagaattaactttcaaaattcaactctgtggcgcgaaacggtaagcattgtccaattacatagaaaccaacactttaggaagagcccgctcacttaggcaccaactcctcccaaattttca

SEQ ID NO: 526182 - DNA, 245 bp, Homo sapiens
ggccaggagaggtgtcaagcctgtaatcccagcactctgggaggctgaggcaggcagactgcttgagctcaggagtttgagaccagcctgggcaaaatggcaagacaccatctctacaaaaaatacaaaaaattagctgggggtggtggcatgtgcctgtagttccagctactcgggaggctgaggtggaaagagggaaagagacagaaagaaagaaagagaaagaaagagagagagagagaaag

SEQ ID NO: 526183 - DNA, 134 bp, Homo sapiens
aaccatttaccccaaataaagtataggcgatagaaattgaaacctggcgcataagatattgtacccggcaagggaaagatggaaaattattaccaagccataatatagcaaggactaaccccaatgagagattt

SEQ ID NO: 526184 - DNA, 1088 bp, Homo sapiens
gtaaatactggcacggactgatggccgtggtaacctcgaccgcggctctctctctctctctctctctctctctctctctctctctctctctctctctctctctctctctctctctctctctctctctcgtggcgtgcgcgggggtgcgcgcgcgctgtgtgtggtggtgtgtggccgggggcgcgcgcgctctctgggggttggggggcggggggtggggtggggtttttggcttccccgatcatgtggtcatcatcatcatcgtatcaaaatataatgctgcagcagcatcatgtgcgaccaccacaaccaacagcagcatcatcatcactcagtgatgatgattatgtgagcagcagcactcagacgagaagaggatgagatgaggagggaagacagcagcagcaggcagacaactaatcgatcaaatgtggtgtagagcaggcagatgcgactagtattgtatttactgataatagtaggttgtatgtgtgctgccactcagtagtggtggctcgaagccgcacgcagcacagtgatgcacaaaacagcgtgcgtgcatccatcgtccttcttcgtctgtacatagagaagcaacgcagcagctagtagttgcttgcagcgaggatgtgtgggtcagtcaataaatataactaagctatgttcatcactgttgctgttgctcatactgcttggttgacgtcacagttgttggtgattgaatggctggtttgataggtatgcgaagaatagagaaggcaatcattcaatccaatccatcaattccatggtcgctgggtggattgcgatagatagttgagataaatacgattaacttagtgaaaaaaagaaaggaaacaatacaagcagacgaagacagacgaacgacagatcatacatcaatacatacatgacaaaacaaagaacggagaagagggaggcagaagacagacggggagacgacgaactacaagagaagcaagggaagacgacgacgacgacggaggaggacaaaaacaacatcaacaaacgaccgcgaagaggagcagcgacgacgacgagacgcgaagagaagaaacacaaacaaa

SEQ ID NO: 526185 - DNA, 204 bp, Homo sapiens
  misc_feature (1)..(2): n is a, c, g, or t
nntttagtttgcatagcacggtaagcgaacctttgtgagacagaacatgtcttatatctggcactgatatgaagagggatgtcagctatcacttgatcctcaaaccagtaatagggagagtttcttttctctcgtcaaattgcttaaaggattctagttccgtttggcgcggacactcacatttgaattctaatactctatgtg

SEQ ID NO: 526186 - DNA, 304 bp, Homo sapiens
tagtcctgatttggctccttctgacttctttttgtttcctaatctttttgtttgtttgtttttgagatagtgtcttgctctgtcacacaggctggagtgcagtggctggcacaatcttggctcactgcaaccttgacctctggggctcaagcgagcatcctgcctcagcctcccaagtagctgggactacagggtgtgccaccatgcctggctaattttgtatattttttgtagagatgagatctcagtatgttacccagaatagactcaaactcaagcctgatgacacaatgagactatgtct

SEQ ID NO: 526187 - DNA, 1136 bp, Homo sapiens
  misc_feature (9)..(9): n is a, c, g, or t
  misc_feature (99)..(99): n is a, c, g, or t
  misc_feature (212)..(212): n is a, c, g, or t
  misc_feature (362)..(362): n is a, c, g, or t
  misc_feature (373)..(373): n is a, c, g, or t
  misc_feature (485)..(485): n is a, c, g, or t
  misc_feature (488)..(488): n is a, c, g, or t
  misc_feature (496)..(498): n is a, c, g, or t
  misc_feature (603)..(603): n is a, c, g, or t
  misc_feature (645)..(645): n is a, c, g, or t
  misc_feature (731)..(731): n is a, c, g, or t
  misc_feature (748)..(748): n is a, c, g, or t
  misc_feature (769)..(769): n is a, c, g, or t
  misc_feature (774)..(774): n is a, c, g, or t
  misc_feature (779)..(779): n is a, c, g, or t
  misc_feature (815)..(815): n is a, c, g, or t
  misc_feature (847)..(847): n is a, c, g, or t
  misc_feature (850)..(850): n is a, c, g, or t
  misc_feature (880)..(880): n is a, c, g, or t
  misc_feature (934)..(934): n is a, c, g, or t
tgctgcttntaactgcttgttaccaatagattgacctgtatggatttcctggagatgtggtagctacttttcctattttgaagccattttcgtagaganatatccttcactataatcaaataagttttgtcccatcaattccaaagatgtttccagtggtgctcttgaagaggaatgagtaccagttttaaattgcccattggcattgaagntagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacanacaatgatganactcagatggagcttcctactcatgttgatttatgtctcacaatcctgggtattgttaattcaacatagggtgaaactatttctgataaagaacttttgaaaaactttttanacncaaagtgnnnctcaaacaaaagaaagtcataagactcctgaatttaatttccccacctaagtcgagacagtattatcaacacacatgtgcacacagattattttttggctccaanactggattgcaaaagaaagaggagaagaatattttgtgtgtncctggtattcttttataagtaaagtttacccaggcatggaccagcttcagccagggacaaaatcccctcccaaaccactctccacngctttttaaaaatactnctactcttaacattaccttanggctncctcnactgccccaaatctcttaatagcttctagtgctgcnacaatctaagtcaggtcaccagagggaagagnacntggcattaaaagaatcacatcttcagaagngaagacactaatattcttccccatatacatgatttcagaagatgacataagatncctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaattagtaaaatggcttcttattcaaagcatcaataattaaaagaattattttaatg

SEQ ID NO: 526188 - DNA, 135 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (35)..(37): n is a, c, g, or t
  misc_feature (110)..(110): n is a, c, g, or t
catncncnccaaggccacacctgtttctctggccnnnaacaaaccagtgaggatgtaaaggtttgttgaggtggaggaacagaagtgaaatgagcaatctgctccatttngaagtcagtcgcttcggctgttcat

SEQ ID NO: 526189 - DNA, 296 bp, Homo sapiens
gagatggagtcttgctctgtcacccaggctgggatggaagcaggccccctctgtattcgtttgctggggctgccataacaaagtctcacacactgagtgccttaaacaacatcaatttcatatcttacagttctggaggccagaaggcaaagatcaaggtgcgggtggggttggtttcttctgagggtcataagggagggatctgtctcaagcctctctccctggtttatagacggccatcttctccccatgtctttacatggtcttcatttctgtgtgtgtctatgtcctaatct

SEQ ID NO: 526190 - DNA, 151 bp, Homo sapiens
  misc_feature (14)..(14): n is a, c, g, or t
  misc_feature (53)..(53): n is a, c, g, or t
  misc_feature (141)..(141): n is a, c, g, or t
ggaagcctccctgnccgacttctgttctgactccattgaccataaccacgatnaacggcctcctgctgctgcggggaggtggggcgggggggtctggggttgaaggtttcgcctgctggtctcaactgtgggcaagccagngagaagggac

SEQ ID NO: 526191 - DNA, 180 bp, Homo sapiens
atcccccggccgcacagcttctcctctcctctcctcttttctctctctcctctctctctctctttctttcttaacatgagcgctcgctttgtctgcccaggctggacgtacatgtggcaaaatctctaatctcggctcactgcaagctctccctcccaggttcaagcaattctcctgcct

SEQ ID NO: 526192 - DNA, 1081 bp, Homo sapiens
tcagacccgacccagatgtcccccccgactgcgccagtgacttgcagatagcatagcttcaaatttcctcacctggtctggggcggtgaacagtcaagatggagagtgtcaagagagacttttgctttgtctatgatgtttttatatacacttgctaattaaatgaacgcatatgtttcctgtgtaattttgtataggggaataggggccgtgggaactggaagtaaacagccagtgtgccagcagctcttgactctaggtggtgggaataagtgccgttgtaaccacagtaccagcccaaacggggcttactctgtttgtaacaatgttgagttaccttgcaggtataacagagccaaaaactcttaagtcacaaagcccaggcatgcaccatagaaaaagatttgatctctaacaaacatccagaaccaactattcgtctccttggaacgaagaagactgggacatgactggaacccgaacattcgaactctcagaagggaagggtctcttggcccagaagataggggctaaaatccacctcaacataccgtaccataaatggccaaatttgaaggccttcaaacagatcctgcccagccaacatttctaagtcctttcctttgccctctgcttccttagaacttgccccagaccccaaatcagggaggaagatttgaacctgcctcctgtctccttgctggctggtcttgcaataaagtctttcttttctcaaaggcagtaccatggtattgcttccgtgtacattgagcagtgagcctgaggcaggaaaatagggtcaggaggcagggaacataaggccaattcacacttcggctgtaacaggaaatatccactccatagggcgtatgctgtaagtgactttgtaactttacttcatcctctgcatttacgtagagggtaagtgaagtaaacaatggaatcatctaggggatatttaaacttccaaaaattctgtaacggggcctttgagcccctatgttcgggccgctcccacactgtggaatgtaatttcgttttcaataaatcccttcattccttccttaaaaaaaaaaaaaaa

SEQ ID NO: 526193 - DNA, 1099 bp, Homo sapiens
  misc_feature (277)..(277): n is a, c, g, or t
tttgtgttcgttttggtctgttttgttcggtaggaggtattaaaggagtgtaaaagaagccgaaacatatgatcgtcagacatttgccggtgtgatttttcctctgtcgtgatggtcccgcatctggcttcatctgtgttgtggtgtaataccccgttcttccgtcctccgctgtggagcaccctcttccctggggtacccccgaagagcacagtccctaatacgtggccctaattctctttttttggggcgcctccccccttcgcctgtttcgacngctcggcggcccgtttggcccaccccatttggacccgcgtggcccgccgagccgcccacggtggggaccattagccttttttttctctggccctggggaccaactttctgggcttcaccctgggcgtctcacgggcttcttgtctttgggaacacaaacccggtgcccatgggccacaccacggggccttaatgctctgtcgccacttgagggcttgggtctatcacccaccaaaactgacccggtccctagggttgaaaaactctaggactcctccttagggagaaaatgagggcccacccgtgtgcccttggagaggaggatatataggagcctcttggtggatcacaaatagaggcgttttaactggggtcagccccaggccctattccacagaggacacaagctgtgtgagtgagaaccaagacctgctacttctcaggccattttagacaccaccgtgggtaataaccaagaccaccactgggggcactcttgggaaaggagtttggaaccaataatcctccaagtgggaactgtgtttcgtttaggtcttaaacccctgaccgaattttgtgatttccatgttagcaccatcttgatgtttttggatgttttatgcaccagtccacgccatttctttgtgaatccaggaaaatatttagggtataatccattctataaagtgtttgtgtattgtaaaagtacagccaaatgaagatatatgtagatcctccccctataagtccaaaagactgtagctcttttctctccccccctgagtccataaaggactgatatttactaacccttttatagcca

SEQ ID NO: 526194 - DNA, 111 bp, Homo sapiens
tgtcatggagccgtattctggtacgtgcctgccacagcctgcacatccacattccagtggctgtgcaggctgtggcaggcacgtaccagaatacggctccatgacactgca

SEQ ID NO: 526195 - DNA, 480 bp, Homo sapiens
tcgctgtattaataggttaaaaccaggcttctagaaagaataaacttacatatttatttttaggacatgaaaatagcaatattcttggagattgataaccatagcattaatacagcccattatggtcatttacatcggggtctatttcagcaaacttgtgacatctatctttacagacaacgaacatactgtatcgggaagttactgttacttgcataccaactgtttctaacaacgaagcaactgttataaacgttagtttcagtgcattatctacttgtgtagatcctatgcaataacaagtagtgttacatgtatcaagacctagatgttctatacagcatgccatatagtggtatgagccaggctgttcgcatgcgaattctcagtagcagctacaaatggatagcaagtggcatcaagcatatccattcagaatgacgtgccttagatatagcacagaaggcttttggactaaca

SEQ ID NO: 526196 - DNA, 232 bp, Homo sapiens
  misc_feature (46)..(46): n is a, c, g, or t
  misc_feature (96)..(96): n is a, c, g, or t
tctctagcacgatcccccacacttcgatcgcggagaataatgtttncatatttacttatactaacattagcttcttctatagcggttgatagattnggtccatttgtgcgtagtagaggagttcagtctatataattatgggatataaataggtagttgagtgtattagcttgtaacgctattctataattaggtcggctgcttttagcgcctacatatgaggtgtttaaat

SEQ ID NO: 526197 - DNA, 1157 bp, Homo sapiens
aggtgtcgtgcaaaactacccctaaaagccaacaatggtgaacgcgaaaagactcatatcaacattgtcgtcattggacacgtagcattcggcgcaagtccaccactactggccatctagatctatacaatgcgtgttggcctctgacaaaacgaaccattgaaaaattctgacgaagtgaggctgctgagatgggaacgggctccttcaacgtatgcctgggtcttggataaacctgaaacgctgagcgtgaacgtggtatcaccacttgactactctcctttgtgcacacttagagacccagcaccctactatgtgactatcatttgatgccccagtgacatcagagactattatctaatagaaatgcttcaccgtggcacatcttcagtgctgcactgtgcttgttcctgatttgtctgctgctaggtgtctgtgtcgcatctctgcctttctgggtactcctccaccgactctggtgcctcgatccccggtacgtatgttttgctcctttcgtggtcttatgctctgcttcgggtgttcgcttgcatatcatcggcctcctttttgtcctggcctcgtttcgtcccctctactcttgcgcctttccccatcttgctgtacccttctccgtgcccctgcctcctccatcttagccatactgatggtgtccatcttttggtgtcacttgcgacttctctctctcctctcttcgtctattcttgctgttgtaatttttggtgtttattcttttttctcctggatctatcgctcgttcgcctatctccttggttgctcctgcctcgcctctgttcttttgattgacatttgaggtcaggaattcaaaacataactagtaccgttggcggatgggccaccacgtattgtgtcgcgactaaaactgttatattcacgccaccatctgtggatcattattctcttcggttcgtacttggcgccccgcttctttcctgcttccgcgtttttgtggtggccttttggtgctcccgttggcccttcctacttggtattggtcttcactgtgcgcttgtcgccggcctctctgagtgcttatgtgttggttactctttgcctgtttctcctgtctgccgatcctctcacccttccgtgccccctcacgcgtttgccgcttccgt

SEQ ID NO: 526198 - DNA, 344 bp, Homo sapiens
tctacaggatcttagttactggcatttgttggatgcatatgtgggtaggttagtgaatctaaggaaaactacacccccaagctggagaggttgagagacagctccaggcatattgggaagagaggctggacaggagaaaaggcaactggtgctcaccagcccctgctacattcctcgctaaccctggtctaatgctcaaggtctttgtactgcagccattgaacctaagacctgggcccagtcctggtgccaccttcagtggctgtgtgactttaggcaggtcccttcccctctccaagctcagtgtcttcagcttgggttgtgagagtctaatgccatagagg

SEQ ID NO: 526199 - DNA, 662 bp, Homo sapiens
aagcattctcagaaacttcttggtgatgtttgcattcaaatcccagagttgaaccttcctttgatagttcaggtttgaaacactctttttgtaggatctgcaagtggctatttggaccactctgtggccttcgttcgaaacgggtatatcttcgcataaaatctagacagaagccttctcagaaacttctctgtgatgattgcattcaactcacagagttgaaccctcctatggatagagcagtgttgaaactctctttttgtggaatctgcaagtggatatgtggacctctccgaagatgtctttggaaacgggaatatcttcacataaaaactaaacagaagcattctcagaaacttctctgtgatgtttgtgttcaactcccagagtttcacgttgcttttcatagagtagttctgaaacatgcttttcgtagtgtctgcaagtggacatttggagcgctttcaggcctgtggtggaaaacgaattatggtcacataaaaactggagagaagcgttgtcagaaacttctttgtgatgattgcattcaactcacagagttgaaggttccttttccagcagtttccaatcactctttctgtggaatctgcaagtggatatttgggcctctctgaggatttcgttggacacgggatcgcacg

SEQ ID NO: 526200 - DNA, 107 bp, Homo sapiens
aagcaggtccgccttgggcaggcctacgttgtggtgcagtgcgagacccaggctgggcaggcgcaggttgctttatcagcgcatgaagttacatagagtgacgcgca

SEQ ID NO: 526201 - DNA, 159 bp, Homo sapiens
gtctggtgctcttgagtcatgcatctaacacacatgcaggacatcaagaaatacttgacaaatgagagactggtgtggcagctgaggatctctgctcttcaagtgcacatggccaagctctacacacacagaactaccgtgcacttgcccgtgtgtttg

SEQ ID NO: 526202 - DNA, 133 bp, Homo sapiens
cgacggccgcccgggctggtacgggatgctgatcacatgcatcatgttcatgacgcttgtcaggatgccatgccagagcccgacgtccttcttgaaatccagcacattcacaatggtttcagcttccgtgtag

SEQ ID NO: 526203 - DNA, 258 bp, Homo sapiens
  misc_feature (230)..(230): n is a, c, g, or t
  misc_feature (240)..(240): n is a, c, g, or t
ccttcttcatatgttaaaatgaaagggagatacttccagggtgataaccatgtctaatcgtttggaaatggagtttaagaccttcaataggtccgggtttttaaaaaaaggcaccaagacttgactgattttgttttctcacacttaggatttctattacttaccaacttattcatatttttaataaggcaggttagcactcctcattcgtttgctcaatgagcactggnaggcatcaancacatgcatgcaccccgg

SEQ ID NO: 526204 - DNA, 747 bp, Homo sapiens
  misc_feature (629)..(629): n is a, c, g, or t
gcggcagaggctcctaacctatgaggaccacggggcaccctttgccggtcacctcccacgaggtgtcgccgtgaccacgcgggagcccacgccgcgcctgcaagagggtgagtggcgtgtgcatgggcgtgagtggggtgggcgcctgtctggagaagctgtgcctccccatccaccattagcttaccttgcacctgggatatgactggcacccgatttccaccacatacgaaccacctgcaggcccgtgtgctttgtctacgattccaaaccctgtacagctccttgccacctcccagatcaccgtggtgtctcacctagcttaccgcacgcccctacatcttactgctgtaatccagtctgccagctacccggatactttctgtgcatatcatattattgcactttcctggtttcatccttctagcaacttcacacattttgctatggccttgtggcgcctgcctgatggggccctgcctgcctctcattcaaccggattgctacgtgctccacagacccagactctgtgccctctgtctctatgttccatggccatgctgagctaggtcaattcactctttgctggtggcctttgcgtggctactactctctgtctgccatgtccncgccttgcagatctgtactgagagggtctcttccatccctgaagtctttgttgacatattacatacttggagaggcttctccagaccccctatctgagttatatacatgctgcacttg

SEQ ID NO: 526205 - DNA, 434 bp, Homo sapiens
aatgtgcgtgttcccgatggctggtgatgctgaatacctttccgtgggctgctttgacatctgcttgttgtcttccgtgagacgtctgctcgtgtctgttttctcactggagtgtttgtacttctaacaattgagatttgagagattgcagtacacattctggatgccagtcctctggtagcatatgtggtttgtaaaacttctattccagtctgtggcttatcttttcctccactccaagtgggtgtttgcagagcaaaagtctttcattgatgaagtcccttaataacttctaataacctgtgattttacctccagaatttccctggaatgcacccactttccccatctccacagacgcgccttccagggcactgctcacatgctggtcggtagcatcccctccattccccctgggggtgttggtggaactc

SEQ ID NO: 526206 - DNA, 369 bp, Homo sapiens
tccatgagcaggtacgattccatgaaataccccttagtaacagataacattaccattgccatccagtgaaattactacaaaaaagccaatcacacccttctttggggaccaggatttaccacaagacatatatgatactacaaaaactgcctcccacagttcctgcttcttcaatctattcccaagtacaatccctgtgtgaccttgaatagcatgctatgttgtcctcccctggtgtgtgagtatatgtgtctaataaactgctgctgatttcttctgcccagggtcagatgtcatgggttcagccatccccataagtcgagggtgagaagctctttctcattgtaaagcagcctggaagggcatttt

SEQ ID NO: 526207 - DNA, 165 bp, Homo sapiens
  misc_feature (3)..(3): n is a, c, g, or t
  misc_feature (16)..(16): n is a, c, g, or t
  misc_feature (28)..(28): n is a, c, g, or t
  misc_feature (38)..(38): n is a, c, g, or t
  misc_feature (44)..(44): n is a, c, g, or t
  misc_feature (90)..(91): n is a, c, g, or t
  misc_feature (132)..(132): n is a, c, g, or t
  misc_feature (140)..(140): n is a, c, g, or t
  misc_feature (142)..(143): n is a, c, g, or t
  misc_feature (161)..(162): n is a, c, g, or t
  misc_feature (165)..(165): n is a, c, g, or t
ttnatgccccctttgnggaaacatgtcnaggtgatttnatttanaggagctacacccaggctccctcattcctaggaaggaaaaagaccnnaaactcacaaggtctgctaaaggccaaagactatttaggcnaaaaggantnntgcaaccaaaagattgcnngan

SEQ ID NO: 526208 - DNA, 200 bp, Homo sapiens
gacagtgaacaatgaaccacattgcctctgcctatgaacacaatctcttaaaagtttagtcgcaggactccagtactcaaaccataaaagaagtggcctatggaaataagctttaaagccacattccatgaacccaaaggacctcttaagcttgggagtggatagtgggcacagcagccccagctctccctctcagttga

SEQ ID NO: 526209 - DNA, 199 bp, Homo sapiens
  misc_feature (65)..(65): n is a, c, g, or t
  misc_feature (79)..(79): n is a, c, g, or t
  misc_feature (120)..(120): n is a, c, g, or t
  misc_feature (129)..(129): n is a, c, g, or t
  misc_feature (151)..(151): n is a, c, g, or t
  misc_feature (162)..(162): n is a, c, g, or t
  misc_feature (174)..(175): n is a, c, g, or t
  misc_feature (182)..(182): n is a, c, g, or t
acagctcggacccccaccacctgagtccttgcacaaagattgtgttgttatctgaattatcagantctgaatcagcatntgttctgggtccataatccctgtgaccaccaaaatttttgnagccaccgnggtcaccaccacttgatcctgncataggacctnttccatccttgnnatatccnccacgccctctacctcc

SEQ ID NO: 526210 - DNA, 905 bp, Homo sapiens
  misc_feature (298)..(298): n is a, c, g, or t
gtcgctcccttggggtgttcgggtcgccacagggacgtttgtgatagttttcccccccggcccgggcttggtctgtgtaaagctaacaatgggcgcttggcgccctcgtggaaacccacttgcgttgtttgctggatacgaaaaagtcgacgcctcttgttgttcgtttctccgctgcccgcgaattaccttctctctgcctgtgttgggggcaccctcgcgcgcaccctcgtgtttgttgcacgcacgagccacgacgcgttggtaccgacactcctcgggagacagtcatgcctcnccttgggtgcgctactatcgagcatacatactagcgctatgatatagcggatgaatggctctcccccgctctttcatctcgatatgttggttccaccccaaacagttcctccttaaatccaggtctatcacgtttccaccccacccggatgttacacaaatattgttggttcccatggttacccgtgcattataaaaaacgcccccccttacctcttgtggtcccctaactacaatcaacaaagaggtgctatgaacttctcctcccctcatgattttatatacacgggtgcagactccctctttgtatcgactcctaaaacatggtcgtcgcccctaactcggggcaccctctgttccccgccccccacatttatgcggcaatacttcatgcaggacccctacatattttctaatgcctcccagccactaattcgttagaccatacctgaccccaccctcttccctggtcaatatatatataatgccaatgatcatccccacacgctgttaatcaccgagcaatactgctctgaccactatcagtcttgtgttattactttttattgcccctaaaggcccaatagttcttaagcccccacaaaaca

SEQ ID NO: 526211 - DNA, 193 bp, Homo sapiens
gggtgttctggaggatcccccagagctggttggatgtgtgagtatgaagccagagaagcccgctcatgagcagtgactccccaggccctgtgacctccctccggtcttgcagctcctccgggcaccagtccccagggctctcctgtgggtagttcctgcttttcttctgggaaattcctccggtccctctcca

SEQ ID NO: 526212 - DNA, 803 bp, Homo sapiens
aaattaatctgaaaactggacaaaaatctgaataggcatttctcgaaagaagacatacaaatggcaaacaggcatatgaaaatgtactcaacatcattgatccattagagaaatgcaaatcaaaactacaatgagatatcatctcaccccagttaaaatatcttctgtccaaaagacaggtaacaacaaatgctgaagaggatgtggagaaaagggaaccctcgtgcactgtggaagtgtatattagtacaaccactatggagaacagtttgtaggtacctcaaaaactaaaaatagagttaccatacaatccagcaattccactggtaggtatataccccaaagaaaggaaatcagtatattgaagataaatctgcaccatgtttactgtagcactactcgcaatagccaagattcggaagcaatccaagtgtccatcagcagatgaatggataacataaaatatggtacgtatacacaacggagtactattcagccataccaacagaatgagaatcctgtcatttgcaacagttatagatggaactacagatcattaacgtgaacatacgccagggcacagcaagacagacatcacatgtcctgacttatatattgggagctcaccgactgaaacacactgaaagttctagagatagagaggtagaagaaggtataccatgagtgctgggcaaaggtacatgcggagcattgttgacgggggtaattggggaatgctacactgggctcattaaagggttatacttgataagaagctaggtatatggatagtagaaccatgg

SEQ ID NO: 526213 - DNA, 154 bp, Homo sapiens
agatgacgaagggaacgtcatcgttttgaaagcgtcgcaataagacgcacacgttgtccgccgctgttgctctaaggcttaccaccttcagaagtcgacctttggcaaatttggctacctttccaaggcaaagaaaaggtttaactggattcca

SEQ ID NO: 526214 - DNA, 365 bp, Homo sapiens
atgctgatgagtcatggcacaattgacttccctgcacattactgacaatgatggcgagaaaacaatgaacgacacagacagtgaagcagaaattagagaagcactccgtgtgtttgataaggatggcaatggctatattagtgctgcagaactacgccatgtgatgactcaccttggagagacagttaacagatgaacgaccgttgatgaaatgatcagggaagcagatattgatggtgatggtcaagtaaactatgaagagtttgtacaaaatgatgacagcaacgtgaagaccttgtacagaatgtgtaaaattacttgtacaacatcgtatattagccttttctttgttcgtaacttatctg

SEQ ID NO: 526215 - DNA, 220 bp, Homo sapiens
  misc_feature (76)..(76): n is a, c, g, or t
  misc_feature (106)..(106): n is a, c, g, or t
  misc_feature (161)..(161): n is a, c, g, or t
atttttatttttattttgagaggagtcttgcctgttgccaggctggagtgcagtggaccatctcagctcactgcangctcacctccaggctcaataagtctcctanctcaccctcccaatagctggggacacaggtgcatgtcaccacccccagctacttntttttgttttctgtagagacgggttttgccatgctgcctgggctggtcttgaataccta

SEQ ID NO: 526216 - DNA, 211 bp, Homo sapiens
ataataacagcctggaggcactggaagctggaaataggcgaggagggatcctcccctgtgaggctttggaggatgacatagcccttgttgtaaatttgttttccggaaaactggccaaaagtgaaataatacatttctattcttttaagccaccaagtttgtgggcatttgttacagcagccacaggaaaataacattggcccttatcgag

SEQ ID NO: 526217 - DNA, 902 bp, Homo sapiens
gcgaacccacctccaccttactaccagacaaccttagccaaaccatttacccacatataacagtatatgggcgatagtaaattgataggaccgttggcgcacactagactatagtaccgcaacgggaaacgatagaaacaacttataaccaagcataatatacgcaaggactaatcgcgctcgtatacgctttctgctctacatgagattaactagaagaataactttgcataggagagcccaagagtctacggaccccccgaaaaacaggacgagcgtaacctaaggagccagctataaagagccacaacccggtctattgtaggcaaaagataggttgcggacaaggactcttactcaggcgtacgcacggcccgaacgaaccactcttaccactggacggacgtgcggtcgacatacatcgatgggttcggctccacaggagtctacggaacacttcgttacgatcatgcaaacactattgacagaattctcggcgccgcatgacatcccctcatacaaatccccactttcgttaaagacttcgagagcgatcgtggaggatccccacacattcactgggccccacacgcacatacatatggagggaacgcacattaatgcgagacacaaataaccgttggctcctcaaggcagcacgcttcagaggaaactcttaacgcaccccccaatcagcatacagacccatacaaccacgccagatatcccaccgaaatttacaaaaaacgcggcctccaaaggctctcaccaccatcccaactaaacccctactaataaatgccacaaaacaacttattcaaaccttgcaaacaatccttccaacaccaccaaatatgggcaccccaaaatcctcaataccacccccctaatacccaaacgac

SEQ ID NO: 526218 - DNA, 628 bp, Homo sapiens
  misc_feature (593)..(593): n is a, c, g, or t
tgcgtcccaggaaaaacctcctctagtcatgcccagatctgcctggtctaaaaaccacaaaaatagcaggactttccactgagtcaatgcttgtcacgtctagagacctggatcgagctgtttccttccattcacagagccgtcctgcaggagagatgttacttttaccatcaatgtaaaaactgagccttaaactgcttcagaaactgtttagattcattcaactgaatattcacactggagtttgaatcaaggcctacgtggctttagaaatttaagatccaaaccgtaccactgtggtacctgacatccttcgtgcacctccctcatcttcagagaaacaattctaattcttcactttaaagcaaggtagtgtgactttccaatgacttcagggcattcggtaaagaacagcttggttcaaagtaagttgatgagcacagcaatttcttcataatggcaacctggttaaaaaaaaataaaataaacccatacctggctttgggaaggaagttgtttgttttaatgttttgtatttggacttgcatcacatagagtggagatttttttcaacattttgtgtgtcacttaanatttttaaaaataaagtcttacaagctgtgaaaaa

SEQ ID NO: 526219 - DNA, 518 bp, Homo sapiens
ggcctatctgtgtcgggttgcattttaaactggggatgtctggatagattccatgtgcaccagaagggacttaccttttcttccaggtgtgaggttgaatagttgacagaagtgaggctgccttttcctagagttagtttccctagagttagagtttccgtaggctaaaacccagtgatctattcctaatgctcctgccagttaggtccctgcaccgccttccccaggtgtgtgactcaagttgtcacaatctgtttacgaggctggagagaactggtcttattgccctaggtggtcagaaggtgcctagcttctccctcaacacctcccatcggcccttttccctttgctgtatgcacccccatccctacctccctgacccctctcctcagtgacctcctctctgtggaattgaagagaggaccactcagacccgtgtccctggcctgactgcatctgcatgtgctcccacactcccagtgcctccctggacatctctacttggtctcccaaccccg

SEQ ID NO: 526220 - DNA, 743 bp, Homo sapiens
gtatcaacgcagagtggccattacggccgggagtgcgccccggctcgggccggcccgaggggggcgccgacggagcggggtcggggcgaggccgagctccaggccaaccctttctacgaccgctaccggacaagatccagctgctgcgcagggtcagacccagctgctttgtgagtcccgcctggagaaacgcagtgaatttcggaaagcagccagtggggcattccagggcaaggtgatttttatcaaatgtgtggaaaccagaagacagatggcctgtgcggggaaaaacaagtcgtgtgaaccagaggattcactagggacaaagactctcagttcaaatctttaacatttgagatggtaaaaggaaaaaacctgcagaagaaattaaaaccagattgtggcagcaatattgtgcagcaaagggatacagtctacgcagttattccgtgcagaaaagttgggattctgatcgtgaaccggggctcagtcctgtccaacatttctattgtgctctgccaaggaagggaaggtcattgagttctggtagggacaattggaccaggtacgtgaatttccatttcaagtggcatttattaaattattcagacccgaggggaagctgaggcaagccagctggatttatattactatccgtgaactttaaggaaggaaaggggcatagtgctgatgactggggaaatggtttccacaattcttgaattgtggtggaggccagggtc

SEQ ID NO: 526221 - DNA, 503 bp, Homo sapiens
tctctttcctcccgccgcccaagttgccgaagggaaagagggccagggaaagaaggtggtctccggccccagttgtcgtgaagaagcaggaggctaagaaaggggttgaatccccggtgttggagaaagggcctaagaatttgggcatgggacaggacatccagcccaaaagagacctcacccgcttgggtgaaagggccccgcaatataagagttgcagcggcaggagagccatcctctaaaaggcgggcgtgaaaggtgccatccggggaatatacccaggttcacccaggcccgggaccgccaaacggatactcagcgtggcttaagcgggtcccacaagttacagaccagaagaacaaagcaagaaaaagaaagccagaaaacgtggtgggcccgggggccgaagaaaaagagggctggcgggacaaggggggacgtcccaacgaaaaggaaccaacctggtccttgcgagacagggggttataccacgcgttcacaca

SEQ ID NO: 526222 - DNA, 290 bp, Homo sapiens
ggggctcatgtggactaccatggggcccggctaaagcccgctaaaatggtttttaaaacgcttaccctacgcgaacccccgggggaaaccctgtggtttacctttgaggtataaaaagggtttttattcccttttttttccccccggggtgtgggaattttcggggcgccccccttgggtgcccccttatataaaaccggttatataagggggggggagaaagggtgttctcaccccccccccccaccaaacaaaagagtggttaaaggatgggggagaaaacccctccc

SEQ ID NO: 526223 - DNA, 1365 bp, Homo sapiens
  misc_feature (882)..(882): n is a, c, g, or t
acatttataaaaaaggggcccacaccgccccctgtccgtatatagcgcaaaattggggggtacaacaatcccgggtataactccccctccacccactggggggagacccctctgggggagcgcctctgttctgcgccaaacaccttgggggtgcaacaatatatttggggcaacacggaagaggttccttctgcgccccgcttcgtgggaggacgcctttctagtaagtttgtcccccttggcggggaaaaaaaaaaactgcgggcgggacaaaaccacacgtatattacaacacgacggggggacgcacacgcaaaatataatttggggggaccccttgcgagaaaaaaatgtggttgtggcgaaaggcaacaatattatagaactcccgccccctaatggggccgcctccgcaaccacaaccgttagaagggtgcccgtaaacatgggggtacaaaacatgggggccgcctttcctgggttaataccccctggggggagaaccaccttaatgaagaaaagtgttgtggccctttttatcaggtaataaaaacgcgggttgcaacacaaagaagttttctctaataacccctgggcccctcggacaaaaaatataaaagggaattttcttcccggcggttaaaaaaaaaatctgtgtgtagcgcgccaccttgtcccgccctcagacaaataaatgtttttcccgcctcggaatttgggagagaatttgtaaaaggagaagcgcggagaatacctcgcccccccacagcacacagaagatttttggtatatatggagatggagaatacacgcctcgttgtttacacaggcccccgggggtgggccgcccctctgttaagatgtaacacacatatgtggccnctaaaacacatgacttttggagagacacttggatcacagagacacctcgtaaacacatatatctctctcgttggagagcctctttcgaatggaggccccacgagagtgaatatatatcatcttagcctcccccgcgaaatccacatatctctgtccccttgtttcttatgtgcaccacaccgcaaagttcacacacacacatggtcaattctttgttacaaaggggcaatataagatatatattgcacgtctagatatcccccacttgaaattttgtctaagaaaaattacccaccacttaaaaataatggaggttaagtaagattgggagtattgctcgaaattcggtttgtggggcataattagcccaaataatttcttaatattgtgggaattcgattcttttttacgaaataatttccccagttattttaagatgtctgtaaaattaacttttattaaagtctttgtcaatctttgtga

SEQ ID NO: 526224 - DNA, 117 bp, Homo sapiens
agtgctacctccacgaaacagaagccaccacacatgaaatacacctacacacgcagcacatcaaagataaaccacacacaaaatacaccacacacattccacgtgggttatacacgg

SEQ ID NO: 526225 - DNA, 555 bp, Homo sapiens
tgggttaagaccccctgggatgcgcccccgccaaaaccattgagctttccaattttaggggaggcccttttctacaggtaaattattctccgataaaaagtaaaaaaaacttttcgacctagtcaaaaatttggttaaaacataaaaaaagtcccaagtagattgggtattacagggggcttgttgattaaagcccccataatagaacaagggggttctctctttagcccagggctttttagcaaatcatgtcatgaggagttacccaaggtttttttttttaaccccataaaattttttcaagggaaattcttaaattctcttaaacctttttctcgggtataaaaacatgttgaacaatctcaagttttaaggattgcagtattgtccccccaaattcatgtattttgggacccaattctttaaaccttctttgacagatccctttaactggcccatgtttcttttttttcaaaaagggaattaatgtgaaccccccccgctttttttttttatggggcccaaaattgaatatcccagccaatatagttgttt

SEQ ID NO: 526226 - DNA, 388 bp, Homo sapiens
  misc_feature (380)..(380): n is a, c, g, or t
caaaattctaattgaagtaaatgaaacaccaaacagtagcaggaaaaagttccatcagcccttaacacctacaataaatgtacagtaaaaagcctcaagatacatatctaaaaatagcttgtatccaaaaatacaattcgttctctctttatgcaagaacctccctcattgaaagatggggactatccctgcagtccttcatatatgactggcctgtgacttctctgaccaacacactaagatagaattgctactgtgtcagttcaagacctaatctttagctttatgcttcttggaacctaagttgtaatataagaagaatcacagataggaggtggggccaagatggcggaataggaacagctccagtctacagctcncagcgtga

SEQ ID NO: 526227 - DNA, 101 bp, Homo sapiens
gagcggtctggtctttctgattcccatcatggtcctgtccctatacttcattggcacagagggtgctggttagatttaaaatgacagagaccgctcttacc

SEQ ID NO: 526228 - DNA, 277 bp, Homo sapiens
aaacggatttttttttttccccccgggggtttcagggtcctggggccaaaaggcccccccccccccccttcccaaggccccgccccagttttggttttttccccccccccccaccccccccaaagggttttaccccttttaagaaatgcccttccaaaaatgggtttggtgggggggcccattttttaaaggggaaaatgtaaattcccccccaaaattttttttcccccctcccccccaactaaaacccccaaaaaggggggttttgggggcccca

SEQ ID NO: 526229 - DNA, 222 bp, Homo sapiens
tgaagtatggtgacgcaatcgccctgccttctctgcagaggacattcattgctgggagccgtcgcaactcagaaaggactgcaaactcctggtgaaggagccctcaaactgctaggagccaaagactcgagggaccccgtgactatttccccctacccctatacctgagaacatggaatagggaagtccagacatccagacccaagacacatccgactcacc

SEQ ID NO: 526230 - DNA, 249 bp, Homo sapiens
ctctaagacctgtgctcctcttcatgttgagcttgcggaagttcttggggtagtcaatatatgagccaagtgtgctcactaaggagtaaggaaaaaaatagttctgaaccccagaagaagagaagtattcacaggcaccatttatctgtatttgtctggtctcaccctggttataaagacttacttagactgggtaatttataaaggaaagccgtttaatggactccccattttccccattgtaaggga

SEQ ID NO: 526231 - DNA, 306 bp, Homo sapiens
  misc_feature (220)..(220): n is a, c, g, or t
  misc_feature (248)..(248): n is a, c, g, or t
  misc_feature (256)..(256): n is a, c, g, or t
caggctggagtgcagtggggcgatcttggcttactgcaagctccgcctcccgggttcacaccattctcctgcctcagcctcccgagtagctgggactacaggcgcctgccaccacaccacacctggttaatttttttttgtatttttagtagagatggggtttcaccgtgttagccaggatggtctcgatctactgatctcgtgatccacctgcctcggnctcccagagtgctaggattacaggtgtnagccagtncgcccggccaacagcacacttctaattcaggaggtagtgtcttcatatgg

SEQ ID NO: 526232 - DNA, 682 bp, Homo sapiens
  misc_feature (3)..(3): n is a, c, g, or t
  misc_feature (91)..(91): n is a, c, g, or t
  misc_feature (128)..(128): n is a, c, g, or t
  misc_feature (134)..(134): n is a, c, g, or t
  misc_feature (136)..(136): n is a, c, g, or t
  misc_feature (144)..(144): n is a, c, g, or t
  misc_feature (150)..(150): n is a, c, g, or t
  misc_feature (161)..(161): n is a, c, g, or t
  misc_feature (165)..(165): n is a, c, g, or t
  misc_feature (172)..(173): n is a, c, g, or t
  misc_feature (182)..(182): n is a, c, g, or t
  misc_feature (235)..(236): n is a, c, g, or t
  misc_feature (243)..(243): n is a, c, g, or t
  misc_feature (264)..(264): n is a, c, g, or t
  misc_feature (268)..(268): n is a, c, g, or t
  misc_feature (285)..(285): n is a, c, g, or t
  misc_feature (292)..(292): n is a, c, g, or t
  misc_feature (294)..(295): n is a, c, g, or t
  misc_feature (319)..(319): n is a, c, g, or t
  misc_feature (324)..(324): n is a, c, g, or t
  misc_feature (328)..(328): n is a, c, g, or t
  misc_feature (340)..(340): n is a, c, g, or t
  misc_feature (345)..(345): n is a, c, g, or t
  misc_feature (354)..(354): n is a, c, g, or t
  misc_feature (461)..(461): n is a, c, g, or t
ggngccacttctgtggcctgcctcctcagggtcattaactgtttcctccttgggtgtagacttcttcctcttgggaatactggtgctgccngcggtctcttcaagatcgttactcatcatactcctcntttggnanaagatttntttttnttgggtttggngaangagatanntgggtcttntattctctttctcctgggggatctcctggggcttttggtttttgttttttttnngtttttnactcatctcctcacactcctntggngtacttttgttgttttntgaagangnnagggcaagtgcagccagccgtttnttttncttntttaagcgtttnttctnctgtttctncagcttcctagtaatctcagcagccgcttcctctgcctgaaccattgcttccttcatgacatccagattctttcgtggtatctctccagtctcatagaaggacagtngctcttcaacttgttctcgaagcttctccccgaatacactcgtgggcacctcagagaagcaatcgattcgtgaggcaatactgcatttgtttgccaggtatcgggagatgcggcctttgttcttggcagctgctcggccaatgaaggtggagtggaaaatgagtccatattttggggtgttaccccttgtcttcagggctctgaacagggccttttcagcc

SEQ ID NO: 526233 - DNA, 773 bp, Homo sapiens
  misc_feature (365)..(365): n is a, c, g, or t
  misc_feature (491)..(491): n is a, c, g, or t
  misc_feature (586)..(586): n is a, c, g, or t
  misc_feature (603)..(605): n is a, c, g, or t
  misc_feature (618)..(619): n is a, c, g, or t
  misc_feature (629)..(629): n is a, c, g, or t
  misc_feature (650)..(650): n is a, c, g, or t
  misc_feature (662)..(663): n is a, c, g, or t
  misc_feature (666)..(667): n is a, c, g, or t
  misc_feature (714)..(714): n is a, c, g, or t
  misc_feature (718)..(718): n is a, c, g, or t
agtgaaggctgggcgcagcggctcacacctgtaatcccagcagtttgggaggccaagggggacagatcacttgaggtcaggagtttgatacctgcctggccaacatggtgaaaccgcgtctctaccaaaaaatacaaaaattagccgggtgtggtggtgcacgcctgtaatcccagctactcgggaggctgaggcaggagaatcgcttgaacccaggaggtggaggttgcagtgagctaagatcacgccactgcactccagcctgggtggcagagtaagactctgtctcaaacaacaacaaccaaaagaatattcagtgaaaaaaaaatctccctcccactcctgttctgtagtccctcagtttngctcctatcttagtcaacctatgtgaccagcttcctttttgccttgtcagaaataaagcgagctcctgtatttgctttaattttccatgcaaatgaccacattttatttacactattctgcatttngctttcttcatttacttcattactccctgtctgggaggtccattccatattattgagggagaggacacggtcctatcttcagcagcttctttatnttctttcttttcttgtnnntcttctttatgtnntcatttgatnaatatttccccccaagatttnattgtgaaagtnncgnncaggcgtggtggtcacatctgtaatccagcactttgggaggcaaagntggnagatcacctgaaggtcaagagtttgagaccagcctggcaacatggtgaaaaccca

SEQ ID NO: 526234 - DNA, 140 bp, Homo sapiens
agcgttgtagaggcatcttctaatctgagacatggaacttcattcccggccagactttccgggccctagacacacagaccccatgcgacgacctcccagggtttaacttattcagttacctgtggaaccagatttggaca

SEQ ID NO: 526235 - DNA, 392 bp, Homo sapiens
  misc_feature (59)..(59): n is a, c, g, or t
acagtggacattactaaattttccatctttttcagttttccatgccatatttcatgtcntaaagtttgtatttcttattttccgtgattttcaggtttctcgccatatgccaggtccttcagtgtgcatttctcatttttcacgttattcagtgattttgtcattttaaaagtagacaagtggatattccacgttttccatgatttacattttacttgccatataccacgtcgtttagtggatatttctaaatattccacctttttcaatttatctcgccatatttcagttcctaaagtgtgtacttttcattttccgtgattttcacttttctcgccatattccaggttttcagtgtgcatttctcatttttcacgtttttcagtcgacgc

SEQ ID NO: 526236 - DNA, 133 bp, Homo sapiens
  misc_feature (5)..(5): n is a, c, g, or t
  misc_feature (64)..(64): n is a, c, g, or t
actcntgaggatcccctcatcaaaccctaccgcacgttcgtggggaggtcatcgaaaccctatnattgtgtgaacaatccaacgcttggtgaattctgcttcacaatagggtttgatgaccagggtttgatga

SEQ ID NO: 526237 - DNA, 488 bp, Homo sapiens
tgggatggatgctggctcaatcgcccagactggggtgcagtagagcaatctcgggtcactgtaacctccacctcccaggttaaagcaattctccacctcatcctctcgagtagctgggactacaggtataggtctgtatacctgagattacaggcgcccaccatcatgccagagctaatttgtgtatttttaggagagacacagtttcaccatgttggccaggctggtctgaaacgcccaactttcagtgatccacccatcccggcctccaaaggtagctgggggttatagtgtgtgaggcacttggacccgggcgagtcaatttcttttttggtggctgattggatttcggtttggtgttaacaatgggcttggctggctagaaatgtccggaggttacaaaccatctggggtgctcgcgtgtctaaagaaacggtggttaaagatttgagatggggtagcttgcaagggaacgtgaggctagtttg

SEQ ID NO: 526238 - DNA, 150 bp, Homo sapiens
actgcatccaacgccgccatcacgcccggtgtaattttgtcgaattgttagtagagacggggtttccctgtgtaagccaggactggtctcgatttcctggacctcggtgatccggcgcgcctcggccctcccaaagatgctgggtattac

SEQ ID NO: 526239 - DNA, 203 bp, Homo sapiens
agagacagatacgaatcgagccggtaccgtaagagcttacccacggtcggtagtcgattggtgagtctaaagtcatgaagagcgcaagcggacagcttgcagctggccggtgtggggaatcattctggataactgtgagcgatgactcttttttcaacataaaaaatcaaaaggccatacatcactttaacaaagggcattgg

SEQ ID NO: 526240 - DNA, 462 bp, Homo sapiens
tccaactctagcaccgcggcgatgcagatcactgggtaggcagattctgcccccaaatcctgtcctaaccagttgtttgatcacgagggggtactagagtaggggcagcacggagatgccactgaacagcttccccgtagcacagcacagactacagacatgagtgcctctggggctgcagacactgcatacggacggacagacagatcgacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcatcctctaggccagttcagcagccacaacatctctgacttggataccatctggctgg

SEQ ID NO: 526241 - DNA, 338 bp, Homo sapiens
  misc_feature (100)..(100): n is a, c, g, or t
  misc_feature (217)..(218): n is a, c, g, or t
atatccaccacacagtgtgctagtattaattacttcagatacaaaataaaggtatcaaaataattctttgacatcaactttttacctaaaacccattagnagctgtcagccacataacacagtgtgaacaagagggcagctgagaaacaaaggcttgggccctcatgccgttttgaggcctgcagctctgaactaatgccttgtgccacttcgtggnnagcatgccagggcagctgctgttagtgggtcttcatggatgtacatgccacaggatttgtccaaaaacaaaaacaatttgtctgaatgtaagtgaacttcaaatgaataccataactaca

SEQ ID NO: 526242 - DNA, 1702 bp, Homo sapiens
  misc_feature (72)..(72): n is a, c, g, or t
tcctatagggggggtagtctccgccgcccgacacgcagaagagagtgttttttgttggtggcacaccacacncaaaggtatatatgaactgcccttccgcacaggcggcgtccttctttgtgttttgtatgtaaataataacatgcctcgtgtcgctcctggtgctcggcccccaccaccgaggtgtttgggttatactgcttgtttgcttttatatcgacccgcgcgcggtgtttctcctcctccttcttaaataaaggggggttgtttttatctgtgccgtggagaggaggccctcacctttcggtggtggttttggtgcccgcggcagaaaaaagtctttctggggcgccacaccccgagaaagatggggaggggcaccaccacacaaagggtgttggtctgttgctccccccccctacctgggggtatggttattaatatggcccccccacacatttggtgtctgccacaggagttttttcttccggaagagggctcttgtctctctcccacccaacggagaatttttctctgcctttcgtggaaatatagagcgcccgccccaacacaacttagtgggggcgcccggccgaaggataaagtaatgctcccccgcgcggttatacgccggacaagcgatttttttctcggcagaatattttttccccctggcgtcacaaaatttttcctttcgtcccacacacacgagggctcttcctcttttttcttccttcgggggggaagaacgtcttccgtgggaaaaaggaatattggaatatcactcttcttccgggggagcacccctcttcctccaaaaaaggggtgccttcatcataccgcgtccctcctccaccggcggggaagagctccttcggagaaattatgatttattctcggcggcacaacggcgtcctcataagaaggggaaaacaatatgtggtagaagaagtttgtggtggtttgtggcgtgttgtggttcctggggagaataaagcctttaaatattctacaatagaatattcttctgtgttggtgttgttctccccacgtgtttcctctcgttcactaccctctgatgaaaagatcttggtttcctccacgagagatataaaattcttcacacagattcttcacgggtctttatagttatactcgcgcgagatatttgtgagagagataaaaatagtgtctctacagatgggggagaaacgcgacactgtgtcttgttctcttttataatcgcgctctctacagagagagagagagatatttctgtgcgctcatagagccccacacactctctgaataaataacgctcgctacacacaacaataatatatgctcacaataaggcgcttccacacgggagagtccgctatactctctcgacacacgcctcgttgccaccagaatgtccactccctctgagaggagactctggttctttcccacagggcaaattgtgggcccagaagaatatccgcgcgttcacaacttagataggcacaccgggcttcataaaaggtttcactttggaccaagcacccgccaagaaacacatattggaaccacacacggttgaaacttttttctggtgtctataagaagctcaccgggcaagagatgttaattttgaattccccgagtttccattgtaacacccaaaatgactaaattaaaagtaattattccaccagta

SEQ ID NO: 526243 - DNA, 134 bp, Homo sapiens
acacacactacaccctcacacctacacgttttgcactccggcaactgtcagagggtgtacagagcacagacagactctaggttgcctagaacaggcaacacacagtgcgagtcacctcccaagggccccctttt

SEQ ID NO: 526244 - DNA, 375 bp, Homo sapiens
actaaattcgcggtcttgtcttcttgagagagaagtgggcctgtagttcagaaatcaaagttgggaattggggcctggcacagtagctgatgcctgtaatcccagcactttgggaggctggggcaggtggatcacctgagcccaaaagtttgagaccagcctgggcaacatgacgaaacctgtccctacaaaaaacacaaaaattagctgggtgtggcggtgcacacctgtagtcccagctacaagggaggctgaggtgggaagatcgtttgagcctgggatgtggaggctgcagtgagccatgatcatgccattgcactgtagtctgggcaaaagagtgagactctagcaaaaaaaaaagtcgacgcggccgcg

SEQ ID NO: 526245 - DNA, 942 bp, Homo sapiens
  misc_feature (417)..(417): n is a, c, g, or t
cgcgtgtggggtctccacatctcttctcgttgtctccaaccacggggacacccgttggccccgggtctctcagcctgtgttctgagcgataccccttctccggggtccccccctcctatgtgcgcttccccccccccacatggaactgtgggcggttccgaactcgtgttggactttgttcccttgattggggaaagacttccgtggcgaaggagggtcaacctctgatgctgtgcgtgcccccgtaccgcgggtccagttcaccccacgcgtgtgaagccgtgacgacgcctctcccttttgggtggcttccggaagtgtcaccacctcccttttggtcgcgcgataagtagccggggtgtgtcccccccccggcccccagtagtgttcttgtgcggcattctaggtttttctttnttcccaggccgctccttagatcttggtctggtgtgtccacccgtcggcacccaggctgggtggtgggtgaaggcaccccccacgcccacgcggggtcttcccagcgccccgtgtcgccagacctcgctctgggtcgtatgtacccggcttcatgttttgtagcgataatcaaagagacccgggcgacacggtggccggttggctccttccttgtctcccgcacccctctatggctgccacagcgtcggcgccatctcatccacgttccccggtatgcacccactctttctggctccacacgccgtcgaaacccgcttgcttcctcgtatctgagaatcttcgtccattgtagcgcgcccggaagatggcagcgcgctgcttctttcgccgccgcgtccgggaccgcggaaccgtggaatccttccaccccctgggagcccggcgtcatcctctgccacggtcaggccccaacgaccgaccccgggcagcgctaaccactatcccaaataaaaaactaaaaccaac

SEQ ID NO: 526246 - DNA, 266 bp, Homo sapiens
caggccccgaacaatcagacagtgagagggtggatacaaaggtgtgtggctaaagagggattttgctgtttctgagaatgttttatttctttaaaaaacatctgcatggagttcccgttgtggcgcagtggttaacgaatccgactaggaaccatgaggttgtgggttccatccctggccttgcaatcggggtgaggatctggcgttgtcatgggctgtagtgtaggtcacagacccattgttcggggcctggggtaccgagctcg

SEQ ID NO: 526247 - DNA, 484 bp, Homo sapiens
agacgtgtgtgtgggaaaggagaggtaaaaaccaaataagctgcagcactgttatacaaactgaagaagttacgaacagaagacatttccaaggtacagtgacagttaaaagtactgggaagttgtgaggtaacacaaactcacaaaagcaaagatgacaataaataggtttatctgagaacttttaaaatgattatataactgatgctcataaaaaaatgtcaccatgtttcatgcacactatcattaggacaattctcttaatatttacatagtgtactatttattagcatgacattctccccagacatcacaacagcaccattagactgcgcttaagccatacctttcagacaaccagggggcatctggaatgagttccttgtatccaaacgctattaagcccaagcaataggtaacatcaatcatattaccaaacacctataccagatataaagcaagtaaggaaatatgagtatctgat

SEQ ID NO: 526248 - DNA, 844 bp, Homo sapiens
  misc_feature (256)..(256): n is a, c, g, or t
  misc_feature (269)..(270): n is a, c, g, or t
  misc_feature (281)..(281): n is a, c, g, or t
  misc_feature (290)..(290): n is a, c, g, or t
  misc_feature (323)..(323): n is a, c, g, or t
  misc_feature (333)..(334): n is a, c, g, or t
  misc_feature (336)..(337): n is a, c, g, or t
  misc_feature (348)..(348): n is a, c, g, or t
  misc_feature (360)..(360): n is a, c, g, or t
  misc_feature (423)..(423): n is a, c, g, or t
  misc_feature (437)..(437): n is a, c, g, or t
  misc_feature (476)..(476): n is a, c, g, or t
  misc_feature (484)..(484): n is a, c, g, or t
  misc_feature (531)..(531): n is a, c, g, or t
  misc_feature (538)..(538): n is a, c, g, or t
  misc_feature (542)..(543): n is a, c, g, or t
  misc_feature (545)..(545): n is a, c, g, or t
  misc_feature (552)..(552): n is a, c, g, or t
  misc_feature (567)..(567): n is a, c, g, or t
  misc_feature (575)..(575): n is a, c, g, or t
  misc_feature (595)..(596): n is a, c, g, or t
  misc_feature (701)..(701): n is a, c, g, or t
  misc_feature (703)..(703): n is a, c, g, or t
  misc_feature (756)..(756): n is a, c, g, or t
  misc_feature (843)..(843): n is a, c, g, or t
catcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtnaaaaaagaatttnnccatgaatttnacctctatnaaaacaaagactacattagaaactgcatcattngtaaaggacnnanntacaatttaanattatctatcantaatattttcatcaaatttcatccctttatttccattataccacactaacacatcttttttcnttctatctatcttnttaaatacctacattaaaactactttctaaatcctctantttaatantttttacccttttttttcacaatcaatccatatttactctactaatncttttanattnntnatttttnataatttaaataaancttaattncattttttccattctattcnngctatttttataactttaactcacattaaattttaacatcaactaatcaatcataacaaatatttttttcattcaaattcaactacaaataattatttaaacatntntatacaatttttttaaaacttttttattatcaccatattaattcaaataacanatctatttatcatttttaatttcaacacttccttatacatccctctgtgtgaaattaaatatatttttacttactactttctttatnt

SEQ ID NO: 526249 - DNA, 464 bp, Homo sapiens
  misc_feature (29)..(29): n is a, c, g, or t
  misc_feature (77)..(77): n is a, c, g, or t
  misc_feature (92)..(92): n is a, c, g, or t
  misc_feature (107)..(107): n is a, c, g, or t
  misc_feature (116)..(116): n is a, c, g, or t
  misc_feature (171)..(171): n is a, c, g, or t
  misc_feature (174)..(174): n is a, c, g, or t
  misc_feature (190)..(190): n is a, c, g, or t
  misc_feature (220)..(220): n is a, c, g, or t
  misc_feature (263)..(263): n is a, c, g, or t
  misc_feature (365)..(365): n is a, c, g, or t
  misc_feature (377)..(377): n is a, c, g, or t
  misc_feature (399)..(399): n is a, c, g, or t
  misc_feature (402)..(402): n is a, c, g, or t
  misc_feature (440)..(440): n is a, c, g, or t
ggcctccctagtctccagatcgtttttcnttttctgatgtgcttgttcactcaggaaatgttccttatgtgccagcnctgggccagcgaccncatgctgcttttgtnataagaaanagtgatcggcgaagtgataacgtgactgttgtcatggatctgtggtttgttgtcntgntttccctgctgttccngggttctaggtgcccacgtggtcccctcgnggatcttcttttcagaacaaacaattcctccgtccgctatgtntggcgggcggcacacggtgaccatgatcccaggggttggcatcgggccagagctcatgctgcatgtcaagtccgtcttcaggcacgcatgtgtaccagtggnctttgaagaggngcacgtgagttccaatgccgangtnagaggacattcgctatgccatcatggccatccgccggntaccgcgtggccctgaagggcaac

SEQ ID NO: 526250 - DNA, 134 bp, Homo sapiens
gtctacattttgctttccctagatctcttcgtgtccttcctaaagacatacacatgaggcagatggctgagtggcatgcatcgcacgttagtatagcagtatcctcctttaatgcaatctagaaagttgatctt

SEQ ID NO: 526251 - DNA, 455 bp, Homo sapiens
  misc_feature (34)..(34): n is a, c, g, or t
  misc_feature (258)..(259): n is a, c, g, or t
ccccgcccttttttgtgcccccccggttggcggngggggcccccccccccgtgtttttcccccctttaaaaccccgggggcgtctccccccccgggttttttttttgggggggggggggggtaaaatttttccccggggccccccttttccccttgggcctttttgggggccccttttaacccgttttttccccaaaaccgggggggggcggggcgggatttcccggggaattttttttaatttcccccttttgtttnnaatttggggtttttccgggggggggggggggggggccttttttgggggggggggggcccccctttttttttgttccccccggttttttccgcccccggggattttttgggtttttttggtttttttcggttcccccccccttgaaaaggaacggggaattttttgggtttaaaataaattcctccgttccccccca

SEQ ID NO: 526252 - DNA, 154 bp, Homo sapiens
ggtcagtggtacctattccagttttcaagatgaaaatagttctgccgatagatgatgttgatgtttgcacaacagggtgaatgtacttgagggcactgaactgtacacttaaaaatggttaatctgcagggggtgggtggagagcgggggtacc

SEQ ID NO: 526253 - DNA, 484 bp, Homo sapiens
cctggattgtccatgacaccaacgagctggtggccgcgcacatcaaggtcaagatgcagaccatccacctgatcgagcgttatgccatcggcgacctgtccgaagacatgcagcagttgcccggcgagaaggcggacatcaccgcggcaatgaaccaggtcaagcacaacctgtcgaccatgaacaccgagatcaagcagctggcgcaggctgcggccaatggcgacttcaccgcgcgcggcgatgccgagcagttccagttcgatttccgcatcatggtggaaagcctcaacaccttgatggccaccgccgacggcaacctgcaatcgctctcggccttgttgcagtcgatcgctgccggcgacctcaccgcgcgcatgagcggccaataccggggcgtgttcgcgcagatgcgcgacgatgccaatgccaccgccgaacaactggccagcatcgtcggccgcatccagatcgcggccgatgc

SEQ ID NO: 526254 - DNA, 416 bp, Homo sapiens
ttaagcacgaatgtcatggatggcgcgtggcggcggccccccaaatcactggcggattacgggcacaccgagcctaagcgaggtgccgagtggtggggcaagagccctttggttactttgggctgggccggcattccggcttttccaaagtgacccgccgtcagggcggaaccctaagtggccgttaccgcagcaatggatatgtacacaatccaactgtgttgactgccaggcagccttcgcgagcaagcccgcttgtttggatagcgcggcgtcaggtagataggtgtcggctttcaggccgtcatcgcaggcaagcccacatagggattgcggcgcgccagagagataggcatcggctgtcaggccgtcttcgcaggcaagccagctcccacagttggatctcgccgcacctg

SEQ ID NO: 526255 - DNA, 293 bp, Homo sapiens
gatttcaagtgtattttcagcagcgagtaccgtatacaccagctcaagtactgtaatcacccaggcaccatcctctaacaggccaattgtccctgtaccgagtgcccatttcctcttctgtaacatcttcctaatggacaaaccatgcctgttgctattcctgcatcaattacaagttctgctgtgcatgtaccaggtgcagtcccactcgttcgaccagtcaccatggtgcctagttgtaccaggaatcccaggtccttcctctccccaaccagtacagtctgcgacttgat

SEQ ID NO: 526256 - DNA, 341 bp, Homo sapiens
ctcgagaagtttgaagtggcgcttatctgcccatgaaattgaagaacttcatcgccaatggaaagagttagacgaacaagtggcgacccaccagcgagaagaactgtcgcttgcggcaacgatgcaaaaagaagaagcagcagtagaacagcttcgggaacagttgacgggcgctagaatgaattcgatttgacgggcttacaagcaatgtggttgctttccggtaaagcgaaggaaacttcgaaaaaagctagaaggggtcgggaaaagaaagtattaacaagaggcggaaaaaaaaattgccggcgcattattaaaaaaaacaggcttagaaaagaagg

SEQ ID NO: 526257 - DNA, 118 bp, Homo sapiens
ccttgtaggtgaccccagcgaaggccaaacggagcagaagaaccaccggttgagacctgcgggatgtgtgacctccagaattgtgagaattaataaatcattattggtttaagctacc

SEQ ID NO: 526258 - DNA, 1239 bp, Homo sapiens
  misc_feature (466)..(466): n is a, c, g, or t
  misc_feature (468)..(468): n is a, c, g, or t
atctacttcaacattcctccctgtacaaataggacacgatgatatcaagcctactttcagcaataggacgctcgttacccccgatagcatgagtatcatatcgtcaatccttatagtactgtagtaccccagcatgccgacccaacgaagcaggggcttcgttttagatgaatggcacgacgctcctggataacgtctgcattagatacacttacacacacttttatcatgtcagtaggtttcaattttcccttactttactttaaacccaatcaattaacctccagtgggcgccatatccgtgccataactgcaccttcaagttgctcaccctcaatttacttagcgtgctggccacactcgcgcaataacgcgtaaattgtctctcacgccgataacggaccaaaaattacatgagtgtccttagtactatcatatacatacccgccaatcaggcgctccctanantcgcttgctaacggggccctcttaagcgaggtctatcgtacgagacccgcgatatcagcggtgacagcgcgattagaacactctcttacaccatacaccgatgtccccataggaaaacctcagctcaccaatacctatcgcaatgtcactccccgtctaacaacttcaacaccgcaccccgtataccctcttagtactactcaacgcaaatgcgttcgttcttttccttacctaatgcatatacgcgcgcgcactacttcacatttattcacataacaccccaccatgagttacatacaccgtacatagcacctttaagcgccaccgtgaccgttaataaaaccgcctaatatggacccgagacagtcgtagccctctaagtcgcgtcatgaactttccagaatctccctatctttccagctagagggcttgcagtaccctttacatcccgtcaatccttcgttaccgccacgctttgcatatcagagtggccatgggtgatgcaaggtagtaacgttacccgtaaaaccaagaatctctgccaatacctggtcaagaatcaaccccagctaagttccttatccggaatcccccatgctcaggtgaacaggcaagtgcacgcataaccctcaaagttcgaacttcccccaaatcaaccctatatattcgttgaactttatacccaggggaaccacacccctggaaaaggccctacatgacccttcaaatcacctgcacaatagggtgtatacggcaaagaaggtcaatccc

SEQ ID NO: 526259 - DNA, 438 bp, Homo sapiens
agaggatgtttagattaaatggaaatgaagacataacatgcattgcctgatcttttgattgtgattctgtactatactttcatctttctggcttgtttgaatttattccaatacgtaatttgggcgaccagatgtgaccgatacaattgattaatatattagttgtggcttgttggtggcactttcatagagattaaaactatccctgtgactgaaataaaacgtttatcttaggcagtatagtatggtcattaagaatacaagattccatagccagactatgcttcaatctcagctctgcttatcatgtgccttttggccccttgtttaatctctgttccttggtcttgtcattattatagttactacctttgatgaattttgaggatcaaatgagtcactatcttaaagatgccttgtgcctataaatagcgagtg

SEQ ID NO: 526260 - DNA, 128 bp, Homo sapiens
  misc_feature (4)..(5): n is a, c, g, or t
gtanntgtgtgtgtaggagtgtgtagctaaagtcacgcgtaagtgtgtgcaggtgtatgtagctgtcaagtggtgtgtgtgtcagttgtatgtgggtgtatgtgtatataagtgtatagtcatacgtc

SEQ ID NO: 526261 - DNA, 970 bp, Homo sapiens
tatgaaaactcgtgttaggcccggggaaggccgagggtaactctcaccgtgccctcagatgaagcacagagaaggttgttacttgccggggccatccagtggggctggctgggtctgtgtgtccccatctgtggacccctctagggtctgagaatgagaatgaaaaggtgtctccgtggtatccacctttttccgggcctccctttcccccatttccgtggtcccgtgttccacttcctcaggttgggtgctctcactttctttgaagagctctaggagaccccgcggcttccgcgccagggtctcccccattgggctctcctgtggcatggccacgtttgaaaatttgaacaggacaatgtggagtgcacgtgtcacgcccagggcttgcaacacgcgtgacgggaattgttgagtggccacagggcccctaaatagagggctatccaagcctatagacagggcctctccacagagtcctcagaatatatcatcacgtgacctgttgtgggctccacatcgtgtgattggcgtacccagtcaatcccccgaggataacaggggtccaagaactcagcgaggtgggtcgccacataatgcactccttgttgggggcgtgtcccccccgagataaggccttatagacgtcttccgcacgacaataataaggccgcctgttgtggggggagcaaccgatcttcctccaacaggccacactattctctcaagagtgttgtgacccccgagtcacacaaccgcatttttgttactgaacaacgtgcgtggtgacgcttctaaggcgcgcccgtgttcggggggacagaatctaaacatgtgggtatctccgtccaacacaacctccccaatattttctgctcataacgcacttttaaactcgcatctcgcaggaccacaccactcacgccacgaaccatgtgagtgcaggcaccaacagttgccccccctgtgg

SEQ ID NO: 526262 - DNA, 986 bp, Homo sapiens
gggacgtctcgcggttccacctcgcgggaccgcgagacgtctgacgtcgcggggcacgctccggtcgcgtcacagcgggagcgacgatcgggacgcgggacgcctgatggcggcgagctcccggggcacgccctgtgcgcgtgaagcgggacgttcgacgccggcgacgcgcgcgcgagggccccggcttctgtatgtcccgtttgtggcgggtgaccgcgggacgcgcgacggctcactgacggacctcggacccctgacggcgcggacgggtgcgacgcaaccgaactcgcgccgacgtggacttcctgacggacccggacgaacgcctgaacaccctgtcccccgaatacccttgggaccacccactttaaccacgggacgctgatggctcggaaccattaagacaccttgcggacgacccacactggtggttcgtacctcttccccctcttcaccccctttcaacattgccttctacatgcccgtggtcctagggatagatgacagggccaaaaggctaacattttttcaccagcgtcccagggcggatttattggacaagatccttcaccaggcccttaacgcattttccacaagagtggtcgcccagcttatacgcgcacacccacttgcttttttcaccccttcccaaccacccgatccccatcaaacacccccttcaacacaggctttctttcaccccttgacccatttcccacagaagcacatcctttacttaatgaacttcactctcacaatccccttaagtctggtcaaagaacatccatccaccggctcattgttgttttggaaacgcccccaagagtctatcaagcacacaggcaatgagcacatttggcagaacctggggaccacaggcaaaggaccaccattgttccccggagcaatacttgactgggtacccacttttacccttgtccggggaacaatcgatggatgcactggacactctacgatacagg

SEQ ID NO: 526263 - DNA, 158 bp, Homo sapiens
atacttccacgtatagctagggatactagtgacgaccctttgaaaacagagcccagtctcagtcctggaagtcctccacagagcagctgccagtcaggctgtggtcgagtctctctagcaggcgatcttcgccagcgagagcctctgtccattagtgt

SEQ ID NO: 526264 - DNA, 245 bp, Homo sapiens
gattatgttcttgcagactgtgctgtggagtatcctgggcctactgagtgtgaagtctagtggaggccaggtctggccaggctcgggagagcggtcccccttgcggtgaagtttcaggcccaccgtgtggtgccccaatggtgttacagcagctgggtcaccttcaccctgactgcagggttgtcaaacgtagactggtggcacccacacatctggtcccctctccttgaacaccccatgtgcgg

SEQ ID NO: 526265 - DNA, 183 bp, Homo sapiens
aggctgaacttatgtctttctgtaagagatttgatgatggtgcaggtctcctgtgtgagcctgaatgctttatagctcgaggcgttgagaaaactcgaaatagtccaactcttagattttcagtttggaaaaacacaaacaaaaaaaaaaaacaccccccctcttcctccaagaaaaaaaaac

SEQ ID NO: 526266 - DNA, 409 bp, Homo sapiens
cgaaaatggtattccaatgctgcaggattcaattaactggggttaatgcgagatgatacaatattccaggatgaagatgttaaagaagccataagaaggcttcctgagaacccttataatgacaggatgtttcccattaaaagggcactgggcctgaactttaagcctcagatcttgcctaaagagcagtggccccaatatgaagaggaaaatttctcccctgaaccgtatttgaaaaaggttattcgggaaaaaaaaaaaagagaagaatgggcaaaaaagtaatcatgtagttgaagtctgtggatgcacctgttattaagatggttaaacttgaaacaaacaattttaagaattatttggttttaaaatgtttttctttaaaccaatgtttattgtaatggctgga

SEQ ID NO: 526267 - DNA, 714 bp, Homo sapiens
gtccattatataattcctatgcctttgcatcctcatagcttagctcccacttataagtgagaacagacaatatttggttttccattcctgagtcacttcacttagaataatggcctcctggccgggctcagtggctcaagcctataatcccagcactttgggaggccgagatgggtggatcacttgaagccaggagtttgaaaccggtctggccaacatgacgaaaccccatctctactaaaatacaaaaaaaaaaaaaaaaaaaatttgcccaggcgttgggtggcgggcaaccccagcttacttgtgggaggcttgaagcactttgaccctgggggcagagtgtttgccagttgagcttgaaatcacgttcatgtgcacttttcacgccttgggttgacagagagaattcggtttccccagaaatttgaagagagtggggcccttgcgtcggggtaaggcttggacattaaggaacctgtggtgcgcttggggtccatctggtcccagatcactgaaattttctcccctatcagcaataaggctggttaggcttccttcatcattggtggttgtcccctaaaagggggactttccaaattcccttcgagggttttccctttggcattggatcaactttcgcataaatgacgtgcgccacaagagaggcctgcctttggggcctatctggcgttttggccatggccttcctca

SEQ ID NO: 526268 - DNA, 768 bp, Homo sapiens
aggcgaatgcagtgtgcgagctgataggctctacgctggctgacggtaactggcggcggttgtgaacgggcgagtgtggcttcttctggtggtcagcttgggagagaggggtggccttcctcttgcattgaggccggcgccgagccggattcaggcggatctcgtggcggagccaatcttgctccctctcccaggcctttacccgctccctaagatacccgggccctgtaaggtgggagtggaagacgagagttctctttcattctgcgctctcattggctctctgaccttggtgcgaacgcagtcctttactgacctacagctgcattaatagaagatggagatggaatccacagtgacctgtcagctataaaacggggggaactgaccgtagtgtataaacactgtcgagtatcgcctggcaacagcgccaaggacatttatatgggacaagccactgcttttacacggacgaccaggtgtaaagggcatctcggaaggcacagccaacatgtgtgacctttgacagaaggccaggtaaccggatccctaaatgtgaacctcaatgagaaccagaagtctgtaaaagttggccagaagagtgaccctcgggaagtgaatctgcgctactaagtcagctattggaggccactgtaccttactgcttatgagcaacgaagctgcagatgacgtcggaaggagaaaactcggcacatccatggaacttcaagagcacctggagcaagatatattttgacattccactga

SEQ ID NO: 526269 - DNA, 373 bp, Homo sapiens
  misc_feature (49)..(49): n is a, c, g, or t
  misc_feature (241)..(241): n is a, c, g, or t
ccttttgagacagggtctccttctgccacccagactggagtacagtggncgatccgtgcaacctccatctcccgggttcgagcgattttcctgcctcagccttcccaagtagggggactacaggcacccaccaccacgcccggctaatttttgtatttttagtagggatggggtttcgacatgtttaccaggctggtctcgaacccctgacctcaggtgatccgcctgcctcgtcctcccnaaagtactgggactaccaggcgtgagccaccgcgcccgacctccgcccggcttacttctctatccaagaaatcgccaactagactgaaacgagcctctccccgaaccctccagcatgtgagccgttcaggca

SEQ ID NO: 526270 - DNA, 396 bp, Homo sapiens
caaatccccctccaacacctctggggcctctgggatgcgtccccacaatcccagcaactgcctctccggcctaacctctaaccttcccgactctggatgatttatttccccctaatatgcggcggtggccccaccaaagccaccagcccgcgactctgggtcctttgaccccattggcccgacgccaccatccttttaaccaccaactaagctggtccctcctgacccggggaccttcgcggagttaggagcctgtcctacaggcgctgtttagagttccgattccggtccttcactacttgaggtttatctttcaccttattggaactaatttccacagcttttccatcagtttgaacggattaacagcctttcctcccaaacgctttgtgaatt

SEQ ID NO: 526271 - DNA, 257 bp, Homo sapiens
aaaaaattttttcccccccggggggggggggggatttttttaaaaaccccgcccctttcccctacccttttttttgggggcccgggcccggccccccccctttaaaaaaaccttttttttttgggtttaaaaaggggcccctgggggggggccccttttttttccggccccccccccggtttaggaatttgggggttttttgggggggttttttttttccccccccccggggccccaaaccctttttgggcccccca

SEQ ID NO: 526272 - DNA, 116 bp, Homo sapiens
ctgctaactcatgcttccacacttaaaaatgtggcttttcaagctttaaaggataacagctatccgttggtcttaggaaccaaaaaattggtgcaactccataataaaatgtaata

SEQ ID NO: 526273 - DNA, 275 bp, Homo sapiens
ggactgtgagtatccccaaactaatatcatcaggaaaatgcaatcaaaacagaatgagatatcatcttagcccagttagaatgaccattactaaaaagataaaaaataatagatgctgttgaggatgtagagaacagggaattttttttttttttttttttggaggcggattctcactcgggggcccaggcggaagtgcaggggattgatctcagcccatggaaaccttctgtctcccatttcaaagacaattctctggatatcagccttctcca

SEQ ID NO: 526274 - DNA, 989 bp, Homo sapiens
ccggacggctgggagtgaagagggacgggtcccgcggcgagcgagactcctggagcataagactgatggccatgacatactgaagttaggcgtctgtgtcgttgcatagttgaagaaggcactctgagccaagttcaggcaacagcatgcaatccgaggcaaaaaccttaaagcaagtagccagaaaatccagcagaatcgagtcttcctgatccagaggaggcaacaaaggttcccaggcatactcctgcagctgaaaagccaaagtagtctacgccggcagaagagagagaaggaaacgatcgagagagcagggagtatttactgcggttcataccgtcatgggtataagaagcaaaaggtcatctaccttagatagctgggccaacagatggcaggagatacaaacaagagcctacccaagactgattgatgaagaacaggatacgtaagataagagaggaaccgcatacgagaaagaacagagacaggcctacaggcgtgactgctgaccaagatggctcaggacgacacacaagcgatcaaaggtagcaaggccacggacacgacaacccctcaggagcaaggaagacaaaaccctcagcgcacaaagcggagacgacagcctacatgcaataagagacgaaaaggagagcagcacgaaaagaaaacagaaaacaacggaaagaacaaacaaaaaggacgaaccagaaaaaaggagaccaaagaacagacagaccacagcacagacaagcaacacaagcaaagacaaggtcccaccagaagcacaaccagacaaggtacgagacagagaagaagaaacgaaaaacacaggaccgggcgaaaacgacaggagaaacagaccagaacaaacgagccccaaaaacaagaaaaacaaaaacgaaaaagaagaaaacacagaagacaaagaaaaacaaaaaaagaaacaaaaacacacaaaaaccaagcaaacaacacacaacagacac

SEQ ID NO: 526275 - DNA, 302 bp, Homo sapiens
gccactccacttcagactgggcgacagagcaagactctgactcaaaaaaaaaaaaaagaggctcttactttcccataggcttaatattacatttggacatgggggccaactttatcaagaccacaaataccacttacaattaattttaaattattaatcagtgcatagttgtctaaaatgtatataattcacacagagcatattataactgaagacacaccatatctatgatatcttcattaatccatgcggggaaaagaaagatcagattgctactgtgtctgtgtagaaaaggaagacat

SEQ ID NO: 526276 - DNA, 1685 bp, Homo sapiens
  misc_feature (1)..(1): n is a, c, g, or t
  misc_feature (1348)..(1348): n is a, c, g, or t
ngctgccactccggtggagcctcactagggtgcaatcgaggggcgcgtcagcataggcatcactcgtgggggccacacaacagagcacaccaacgaacacaaagtggttatgtttccagcagaggaccgcccagggggggcaccaacaagccactaaagggggtctgcccccctgcgccgtcccgggggggaagacctcatcacccggttccttataatacggggcacacaccgaggggaaaagcaaccccctgcacacaaaaacaaaggcccccctggtggagcacacaaggccccccctgaaaagcgcaacctcgtggggggcacgaagtttgtcgccgcccacccaggaggaccgttgctgtgtgtatacgaagcaatatccccccgggggaccgacaggagggtttagtgtcccccgctgaggccacagatttgggtgtcccaaatgaacgccacaacgggatgaggaagagggttggcaacaccacaaagacgtgtctggggcccccgccaaataattaaagcgttctccgtggggagggaaccccactgactgtgtcgcccgcgaggaagatctcccacgggccggggggggggcaaacacccctttgtggggcgcgccgcgtgaaacactttgtggggagaatatatacagccgctgggggcaccacggggtgggtgtggaaaaagagattaccttctcccgcggcgcccccaccgctttgagggagcaccgggcgctgggccaccggggggaaacagcgtacggccgctatagccgcgcgctttgggctggcccccagcgataggggtaatctcccgcgccctcgagacacagcgcccccccctatagagagtgcgctggagacacacacacacggtggtgactcctcgcactgtccgcttgcgcacgggagcactcacatgacggcgcgctcgctcgttgcgcctgttcccacgcgattttctcgcgctctctctccaccacgcgctgtctctcaccgcgcgctgcttgctgtgctctctctctctgtgagactctctcccacaagacgcacgcgtggggcccctccccacacgccacacgcttgttctccgcgctctctctcggggtgtaagggctctctctctctgtggggcaccacagccccgcgccccacatgtttaaccctcgttgagagatttgttggcgagagagatggtcaccgctctctcacgagaagggaccacaggtccccccagaagggagggtcaccctcgggggacacacacgtggtggccgcggtgtttctacacccacgagaccaccgcctggggtgtccctcgtctctttgtgggggttttnggggtgtccgcggtgttctcccacaccacgccccactcggtgttcctccctggggccctctcggcctcttccacacccctctgttctttccctctccctctcgcgggggccccctcgaagtgcgtgggcggccaccccacccgcgccctctcgcggcttctttaactcccactcttcccacacccgctgcacacgccggctccaaccccaccacagggtggcgagagagagccacccttctggagattttcggttgttgtaaggagaggttgggtggttttcacaaatggtaaaagaatgttttgaggccaaaaaaatttgcctgagtacccggaaa

SEQ ID NO: 526277 - DNA, 102 bp, Homo sapiens
gttatgatggcgaggtccgtattgttgcgctccagcttcatttattccgaggcgcctacgccacggcgctggattcctcgatcggggccgagcgcaagggcg

SEQ ID NO: 526278 - DNA, 421 bp, Homo sapiens
cactgcatggtgctcggggaggcgaacacgttaaaattacaaagcctaataataacaatgaaagaagggttgtggagagcctgaaccagtggcttctcaatgcctgcaacatattagaatgacctgagaggcttttaaaactactggctactcagctcagaccaacttcagtaaaatctgtggggatgaaacccaagcatttgtagttttgttttccttgaggcagggtcacactctgacacataggctagagtggcagtggcgcaaacaggactcactgcagccttgacctcctagggctcacgcaatcctcctgcctcagcctcccatgcaggtgggaccacaggtgtgtgccaccaaacctggctagttcttttgtcgttgtaagttagttgtatttaactttttgtagagatgaggg

SEQ ID NO: 526279 - DNA, 1408 bp, Homo sapiens
tctaggtccaatgggtagtttttattccccgggaacaaagaatacatgtggtggagaaaaaaatctccaaagggcaacacagagccagggatgtgcaaagaaatgagtgaccacccggggacagccgtggtctcgagggagttcgggtataaatagagtggctgtgctctccacgaggggaccgtggctacgagtggccgcgggatttatctgtgggaatctcacacatttgtgcccgcgatcttcttataagtgtgtgtcacatcttcacgagagggtgggaggatgtggagaaaaggtggagggtggaaacagggtggtggatcatcacacaaagagcacacaagagtgggcaactcttccatattctcccgagagaggcaccgagtggacacaaccaaaaaactctctccctattattcagaaaagtgggaggtttaaaagagaattaaaacaatgtgagagaggggttcttggagcggtgtgtacaacgcagtctcccaccccgagaaacaaacaaaaaataacaaaagggagagactcacaacgcgtggagcaccagtggagaaaaatacaccgtgggatcgcggtgaacacagagcgggcagcaccacaaacagggggtgacacaagagacacacatcatccgaaagaagaaaacacgcgacgaggggcacaacaccactaaaggcaccagaaggaaaaaataaacgagacacacaggaggaggagacaaacaacacataagcaaacacaacacagaaagatgagggagaaaaaactacacaacagggcgacaaacagtcaaaactcaaaaaaacagaggaaccaataagtgggacacaaagagaagaaaacaaccagacacaaaaacaaccaactagaaaatcaactaattaacacccgcacaaccacgagactgacgagagactagacaccaaccgccacacaaaaaataactaaaggagccaaggaggaaacccagcatgagcacaccacataacagaaacgaccgatgatcaacaactatagcaaaaaaaaaaaaacaaacaatggggggccaacagtcagaaaggacataaaaaaacaagcacatggtagagcaatcaacaaaagtgacatagaaacacatgagtgcacaaaagaatacaacatacgcaggagagagacgaaaaacaacaccgacaacataaaaaaaaaaaaattgccctcagatctgacaccagataacaaaaaaaaaaaaaaaaggacccacaccaccgagccaacaaaacaaccaacaacaacacagtagcacataacacacacaggacgagtaaccacaagggaccggacacgtgacacaaataaaacacagcaaaaagagaacactataacagaaaacaacaaaacgaacaaaccacccaag

SEQ ID NO: 526280 - DNA, 687 bp, Homo sapiens
cacaacaaacagacagcacaatgtgggcgtgcaagtatagccaaatatataccatcatccgtgtctatctatgtggagactacgtgcattcgagttcttcggtcacctaagaattacctaacccaggagcctgccttccacacatacattaataagaccaaccaggaatgtcataaaaggatacaaattacgaacccaaaaacatgaaagtcattctgcactcgtcccgtggcttaatcacgtgcattgcagctcatatgcgtcatccattcctcgtgtcctatccactataatagagcatcttacttgactgcagtttatactccaaattctccaggctggtgaaagtttcctcaggattgcttgagaaatgaaagtcctggccatggtgcgcatgtggctcatgcctgtaatcccagcactttgagaggccgaggcgggtggatcacccgaggtcaggagttcaagaccagcgtagccaacatggtgaaaccctgtctctactaaaagtacaaaagattagccaggtgtggtcgcaggcgcctgtagtcctagctactcaggaggctgaggcaggagaattgcttaaattcggaggcagaggttgcagtgagctgagatcgcgccactgcactccagcctgggcgacagaatgaggctgtctcaaaaaaagaaacaagtaaaaaa

SEQ ID NO: 526281 - DNA, 104 bp, Homo sapiens
ttcactactgtcgtcaaacacactgaatgagatacagtaaagtagaagcagtctaaaaaaatttgaaacaataagtgtaaaaaactcaaaaaagccatacaatt

SEQ ID NO: 526282 - DNA, 393 bp, Homo sapiens
aggattcccggcagccccgaaacacgccaccgcgtctttatatcctgaccccgaagactcggtcacctggtctcgcggtctgctgtcgcaacgagtgttgcctggaactttgagaagttcctggtgcgccctgagcggtgtgccccgtagcgcaggatgcagcccgcctgacttccagactcagttgaccatcgagcctgacatcttaaacccttgctgtctctatggcccaggctgtgcctagggcgcccctcctacctccggctgcttcgcagttgccgtgctgccgtcttgcgggggctcgccggcatcccccgcaagacggcgcagccccgcaagacccaattcgtccctttaccattttcactgacttgctgcgtcgggtaccgcgct

SEQ ID NO: 526283 - DNA, 281 bp, Homo sapiens
tagtgagatctctaagggatatcctgagttctaataacattgatgtcaggaaaatgacggacacagaccaggtgaactgccccaagctctcgtgaaccaggttctacagggaggctgcacccactccagtgtgacttctgattcgctttcccctaccccaccccccgccatagggacaaaccaatcaaccacgacaaaggaagttgacctaaacatgtaaccatgccctaccctgttgacctggggtagctgcaaaataaactggtggttgaccttaatta

SEQ ID NO: 526284 - DNA, 854 bp, Homo sapiens
tgggcttgactcaggatttaaaaatgggaacggtgaaggtgacagcagtcggttggagcgagcatcccccaaagttacacaatgtggccgaggacttggatggcacttggttgttttttaaatagtcattccaaatatgaaatgcatggtacaggaagtccctggccatcctaaaagccaccccacttctctctaaggagaagggcccagtcctctcccaagtccacacaggggaggtgatagcatggcttcgtgtaaataatgtattgcaaaatttttttaatcttcgcctaaatacttttttatttggttttatttggaatgatagagccttcgggcccccccttcccccttttttggctcccccaactggagatgtatgaggggctttgggctctcccggggaggggggggaggcagccagggcttaaccggtacacggactggagaccagttgaataaaaggtgcacaccttaaacaatgaaaacaacaaaaaacacaaccacaaacaaaaaaaacacggggggggcgcaaaaaaaacacctgggggcgccagaccacgggctaccccccgcgcttgtgtttttctcaaacggtggcgtccccactagatggtgagctgctgattaaataaaagccgcacgacaacgggggctggtgtatcacacagcttgctggtgtagaacacgtggcaaatcgagcgcacttcttgcgagacaacccccttatttcgggtgcgtggcactttgggaccaactgccacggaattttacaccgtagggataaataaatttaggtgtttatgttgtcacatgcagtattttgttcgtaatttcacggacttttgaacata

SEQ ID NO: 526285 - DNA, 140 bp, Homo sapiens
cttcatggctgacttgcagaaaactcgaaagcagaaaggatggaacagacacctcacagagtggggaggacggaggctgctggcagagagagagagaggactctggagatgccgaagcacacgccttcaagagtcccagc

SEQ ID NO: 526286 - DNA, 536 bp, Homo sapiens
ggtccccctataatgggttgaggaaagctcaggtggaaaaggagggaactgctctcaggctgcgtgcaacaacagggcccaggggtttgatgggtctctcatcccttggaaagcctgaggcaaccgcctgtgtggggtttaaaagcagggttttttcccccctctcccttgtggcttcaagagcctttgggatttctttttgcaaagggccctgaatgggtttggggtcctgttagcctaatgtgagggggtggggagaccgcccccccccggggcccccggggcccctggcccccccctggcctggggtccccccccggtcattttttctggtcccgagagggggggggggggggttccctttttgtttccaattcatgggggcctgaggcggcactttttggttcccctaatgaagtttaggacccggatattaatttggggtttccaatttttggtttggaggggtggggggtttatttaattaggccattccttgaagtttgggggggcaattaaggccttgggaccctcca

SEQ ID NO: 526287 - DNA, 148 bp, Homo sapiens
cacgctggtctgtcccattccttcccagggcttcttcatgtcagatgcacccaagtccttagcccagctgtgccacctgtcaggagtgtcgctctctgcgtgtgtctgtccccgtccccaagaatgggatgtgtcgtacttcatgccc

SEQ ID NO: 526288 - DNA, 222 bp, Homo sapiens
ggaacagacttcgaaagagtaatcttcatcttcaagtcaacagagtaagcataaactaagataatcacaagttacattataaaaaggtaatttagagccgggcatggtggctcatgcctgatactaccagcacttatgggagagccgaggcaagcgagatcatttgcaggtcaggagttcgagaccacgcctggaccaaacgtggtgaaacgcttgtctcta

SEQ ID NO: 526289 - DNA, 1613 bp, Homo sapiens
tggtagtcagctattaaataaggtccttaagaacttttaaaacaccaattggggaggataaatcccattcggtcaagagcaaacacaagatcggcagtgtacgcccgggacgctagagggaatacgctttgagattttggggtgaaaatttggtggaggtcccacaggcttctctggactcaattctggcggctggcccccggaaaatcctccatatatatttcctctcttattatctctggtgtgtgcagaagagtattctacacctctatccccggggtgtgttctaggggtctacccagagaagtctatctctttctattctgtgagaagtgtaaaagggctatacagtgtgacacaaagtgttgtgaggggagatatcttttaacacatgatgtgcgcgtggatatatactcgcatactatgtggcgcgtgtagacagcgtggtgggcccacaatctgcacccacacatatttctcccgtgggaggtgcggtgggatcccactcgcgcgacacagacgcgagaaaaccttccgcaaactgtgacggggacacccagagaatgggtctccacaagtctcacacacaagcggtgtactatactacagggccccaacatattaatgcccccaaagcgtggtggcgctatcatacacggggggacaaaaaaccccgacagcgcgcctctctttttgtggcccccccccctgatggggttggggggggtcttcacacaggtgtgaacaggaggacatgttggacaccccccaagacacaaaggtggggtccccccccgccggggggggggcggcaaaaacaaagcagggccgatgggggaccccatccgccacaaaagagaatatatcacctcccccccacagcccgaggtgctcctgctagaaaaccccgctgagaaaagagggggaggagcgtacacaaacacagagagcgcgccgggggggggacccccccacaaccaacaacagagcccctctcttcctgcagagagggcgggcggccccccattcttctctcttctgcccgccggcgctcgcgcggcgggcaacattacaacatctacatcatcctcccttaaaagggaggacggccactattttctatgcggagagcgccgacaccacgcctttcttttataaccaccacccacacccccgcggggggggggttattcacccccgcggcgcgccagcggcttctctcgttgtggtggttcatccccccaccccaccaaacgtggttgtggtgtttctttgggggcgttccccccccgggtctgtggcgcggaacaggaaaccccccctttgctttctcaccccgatttcccttctgtatgcccgctctatgactctccacaacccccctttcggtggacgaatattaataacagcggagcgacgcatgagagaagaacacacatcatcccccccctcttggatgagaacccagatatgagccgccaacttcccgcggggcggaacacacaaccactagtgtcgcggcgagacaatcccgcggggggcgaaaaaacatccctcgtgggccgcaaaaaatattcccctccctcgtgtcaccacaagcgggacacccctcg

SEQ ID NO: 526290 - DNA, 423 bp, Homo sapiens
cagtcggcccggatatgggctgtagctgagagtagcctctgggtggcagtgtctctgctctcccatccggggctgcagtgggacactatgtcagatccccggagatggtgtcttttttcctttgtaattaatgaataatccagtggtgacactgagcatgtcctggtgagctgtgtgactcctgcctgataatggtggtttttctagcctgtcctttcctttcacgtttattggttggcgttctgagaagagccgccttttctcccatcacttagtgtgcagtgtgctacctgtcacctgtctgtcacttgtcagtcactgtcacctgtcactgtcactgtcacctgtcactgtccatctttttgatgcttgacggttccacctttggccggtggccacctcagtctggtggtgtcttttgcc

SEQ ID NO: 526291 - DNA, 297 bp, Homo sapiens
aacatactaggtgcaaagtaaaggtaaggagcaagatttatcaagcaaatggaaaacaaaaaagaacaaaggtcgctagtcttatattagatacaacagactattacaatggtcaaaaaggacaaagaagggcattacataatgataaagggttcaattcatccagaagacttaactatcctaaagatacatgcacccaacattggagcatctagattaggaaaacaagttcttagagacctacaaagagacttagataactacataatggaagacttcaacaccccactgatagtg

SEQ ID NO: 526292 - DNA, 955 bp, Homo sapiens
accgttgactattctctacgaaccacgaaagacattggaacactatacctattattcggcgcatgagctggagtcctaggcacagctctaagcctcctgtattcgagccgagcctgggtccagccaggcgaaccttctaggtaacgagctcacgatctagccaacagttagtcgtccacacgcccatgcattttgtaataatcttggcttcgatagtgaatacccactcataatcggaggcttccggcgaactgactagttcccctaataatcaggtgcccccgatatggcgtttccccgcataaacaacataagcttcggtgactcttgacctccctctctcctactcctgctcgcatctgctatagtggtaggccggcagcatggaacaggttgaacagtctatccctcccttgagcgaggagacactactgcccaccctggagcggctccgtaagacctgaaccgaatcttctgccttacacctaggcaggtgtctcctctatctgtaggggccatcaagttgcatcacaacaattatcaatgatagcaaccccctgccgataagcccagataccaaagcgcccctcttcgtctgatccgtcctgaatcagcaggcggggcctacgttctcctatctctcccaggcctagctgctggcatcactatacctactaaacagaccgctaacctcaacaccagcttcttcgaccccgccggaggaacgagacacccattcgtataccgaacacctattctgatctaccggtcaccctgcaagtttatattctatccacccaggctacggagtaaactcccctaatgtaacttagtactcccggagcacacacacccattcgcatacctacgcatggaccgaccacaattccaatgcccaaggtatcggttagcccatattccggacgacgaaccccgttttctcctcaaaatgacc

SEQ ID NO: 526293 - DNA, 586 bp, Homo sapiens
aaaaaagtggaacacaaagtaggaagtgagaaccttctggggttgggatggatggacttctggattctttctgggtttggcctgaacaccaagtagcttcataatcaaagggtcattttctgggttggtatcagaccggtatttataaaggttggggtatttaatttcagtaactccgtggtattttcaacaggaaaaagaacctggagtccatttggcagttaggctcgcaccagctggtcttctggtgccagccagctccgcccgagaccccgggcacggtgttcgcagcacagcctgggcaggggccctgagcgggagttctcagcccggtctggtgccaaaggttggcctggtggggtcacgggaaacccgggcccatggtccacccagtgcgtcagggccagccgggggcccaaacctggtggatgggacacgcaggtgccgtgcacatcgggggcctcagccagaccggtctccttcccaggcactgtcggaaaggggctggctccgtgtcgggccagtggaggatggtggcaggagacggggctggggaggtccaggtcacgtcctctctggcgaccct

SEQ ID NO: 526294 - DNA, 111 bp, Homo sapiens
tgaatgaactgcttcacaacgtttaaatccagacaacttctttgccttcttcaacctctacattttatatagagactgtcttttcagactctcttgaatctgctctttcct

SEQ ID NO: 526295 - DNA, 710 bp, Homo sapiens
accgtggatgctataatctgctactccgacgcctgacccctcccagagactcgtgatgccaaggacctgatgacgagacgtgactacagaaggagtcggtggatattgagacccaagagaggagccgagtggctcctgcacatctatcatgggtctcccagtggaccaacccaaactgaagacaaatgaggtggtggcataggatccaagctaaagagcaagagaggtatgtcatccataccattgcctattggacaacatggaccacaccgaagtagacgttagataacccgggatataaatccacaatgtaatggcaaacggtacgtacaaggtaacgcaaatcaaatgaaaggatcacaagaatacaccgagaaagaagtaaaaggggattcgcaaacggacatatagactgtaataggcattaatagtactcgtgacgcgaaaagcggttatcccagagggccacgagtcataccacgaaaacacgggggtaataaggcatacgagtgattcacacaagaccacgacactcgcatactaggaccacatgggaacagacggcacgcgtgaggctacagtaccgaaagggcgcgcgacgaccggtgttgataagatcacatcgatgtatcaggaacgggagcgggcaaagagggcccaattaaagataagggcctgacacagcggaaggaatgcaaccgggaacaggg

SEQ ID NO: 526296 - DNA, 1419 bp, Homo sapiens
  misc_feature (1)..(1): n is a, c, g, or t
  misc_feature (861)..(861): n is a, c, g, or t
nggcgtgtgctgctgtgtgtcttgtcgtagtgtgagttcgcgatgcatgtatgtgtcagagaagagtaagaatcgaaataggaaggactacgtgcgtgagcgccaattccgagcctgtcgtgcgttagtatggagactcttgtgctatgctgtgatccctgcagcccgggatgtgtaacaccattgggtgtctgctcgggccggccatatttttgggggccgcgcctaatttgttggtgactcatttaatagggttcgctgtccgcggttgctaaatatccgcgttgtctccccttcctgcgcggggttgtttctaaggcggcacttgcgttgcaacctgcccctcccgtgcacacgccgtcggtcgacgattgatgggtggtgccccgccccttgcctgcggcgcgctctatttgttgggggcccccccacatgtgtggcgctggcgcccccctgttgtgtaatgtgccagacacgcaaattgtgcctggcgccatagtatgcacgacacgtggtagtttgttgccgtcgtcgtgccgcgtttttttatgattgctatatatttttgggccctcacacccctatggggccgcctctcggtgtgcataagctaaagaacttctgttttgtggcaccgagccagacgttcagcactggcgagtgccgcagttcgctggccacccacgggggatgtgcgtggtggcggccccttcctcgcgcggagttgttatacatggcgctaactccgccccctctacgtcagtgcatgtcgcccccctcttctcacgtgagaggggtggccacccgcttcccacccgagagggggcctcgtacatgatggttacactttcatgtagaggntcctctttctcatcttgtgcaacatagtatacaaacatgattcttggttagcgtcgtggcggcaatttgtaggtgtaggcctatgagattaaatcgcccgtagatattatctgccccacgccacacactctctcgtgagagtaggcctggttaggtgccccgcgagagcgtattccctccttggtgggccttccccaggagaggtttcttccgccgcccccccctctctcggttggcacatatttctcagcatagaaccccctctctctctgtccacccccacgccaccatgtctaaacatagtatttacactgcggcgcgcatcgactcacccgtgtataggcactcgcatcgactctcgctctggggggcgcttgtagggtccgcgcgagagcgcagttgtctttagtgagagcgccgcggagatgtctcccgggggctccactgggtgcgctgtcgagactctttggttgcacgcgcactcttctctctcctggagggaattcgcacggaagaaccccttgtattctataaaaaaatcaaataaccaaacaaaca

SEQ ID NO: 526297 - DNA, 294 bp, Homo sapiens
ctccaggactttcctcagctggaaaagacgtacacgattaaaatactgttgcacgcaataattttcacacagataacatggataacacttttattacagaaacgtacggtgaaaggaccaccaacagaaccagggcttcataggggtaattgagaattgagctgagaatgacctgggagaagaaagaatctagggtgagaatgaccctggggagggagccacgttccctttggactggtgactttagtgtcgccgggtcttccctcttccctgttctcattttggggagtgagg

SEQ ID NO: 526298 - DNA, 292 bp, Homo sapiens
  misc_feature (60)..(60): n is a, c, g, or t
agtggctgggcctgtgtgaggcacctataaaggggcattttaccacaaaaagttacgaantgtttttcgttttacaccaccgtaaacagcagctttcacacaagggcctttcactgaaccggcccaaatgccgccaacgccgaaccgaggatcccccctcaaatcagctgtccccaagtgtccgaccagggggaaaaaatcagcagcgtgggtttaggaagtaaatgaaatatttcaatcttccaagaaagagttgtagcttcccaataacctttccaaacacatctcacca

SEQ ID NO: 526299 - DNA, 153 bp, Homo sapiens
aagtgcccttcgtagcagcagccccgatggatgccacccatagcaggtcgccggatccaatctcttcctctcctccctcggtcttcctctccccacaaaccccagggtctagaatgtagaaggttctcccctcttctctccttcctcataatg

SEQ ID NO: 526300 - DNA, 134 bp, Homo sapiens
ctcttcacttgtgttgactccaagcatacaggtgctttgtgtccaaccatgcggcaattgttgcagcaatgggctcaaggacaacatgaattagggtacaagaaggctgcagaagcaccacaagaagctgaatg

SEQ ID NO: 526301 - DNA, 260 bp, Homo sapiens
gcgggtgccccttgtatgtgatgtcttctgcgctccacgggtgacttctagccgcctgcccaagcgccagtgctatcgcccttactgctgggagaagctagcggagtgcggaagtggacttggagcgcgtgcgtgtgtggtacaagctggacgagctgtatgagcaggagcgcaatgtagcgcacagccatgcaaaaccgacgatgggattgctgaccctgatgctgcaccagacgatcaagaacaatcccctcactacc

SEQ ID NO: 526302 - DNA, 173 bp, Homo sapiens
caaagaggaacagctctttggacactaggtgaaaaccttgtagagagagtaaacatttaacacccatagtaggcctgaaagcagccaccaattaagatagcgttcaagctcaacacccactacctgaaacatcccaaacatataactgaactcctcacaacctatttgaccaa

SEQ ID NO: 526303 - DNA, 446 bp, Homo sapiens
gcttcataagccctttaagtttccaatgaattttaaagaaaacagaactatgggatattatgggagtggtctgtgcaaggaagatgaacaggacgccaatgggcagatgcatcccaaagacagaacttgggcctgatatcaaaagtctagcaaatgaatgtacatttgggaaaacattaaaataaaaatatttaatggtatgtatgtaatacttggtggtactctcctctttaaccaatttttctattaactaactcaagccctgaccacgtggactaaaagggattcttggtcctttgaaaacaagtccgctacgacaaggaccaagagtgcccatactcctgtagagtgtctctagtatacagttcaccactgtaatcactttctcagtgcagtgatgcccaacatggcagtgatgcccaacatggcagtgatgcccaacatgg

SEQ ID NO: 526304 - DNA, 454 bp, Homo sapiens
  misc_feature (18)..(18): n is a, c, g, or t
cgagtatcagcaagagancccacctctactaacgagtacaaaaattagctgagcatggtggtatactcctgtaatcctagctactcaggaggctgaagcactagaatcactggaacccgggaggtggaggttgcagcgagccaagatcacaccactgcactccagcccggatcacagaccaagactgtttcaaaaaaaaaaaaaaaaagacaaaccccccagggggggccccataacttccccacaaggggcccaatataatcggaattccaggaagcgcggagggaccaaatgacactgagggaaaaaaaaaaatctctttattacgggaggtgtgccaccatgatatggtattcccccgtgatgcagcatacctgaattatatgggtttatatacaagtgctccttcccggtatatcctctgtgtggggctgcaccccttttaccccgcccc

SEQ ID NO: 526305 - DNA, 295 bp, Homo sapiens
  misc_feature (223)..(223): n is a, c, g, or t
aaatgcgtggcgtgggggcggtgtatcatggcagtgcccctccgcgcgcttcgggcgggcagtgcctacatccaggtcgcaactcaccgcctcggcatcttgggggaggaggccatggactggtggagcacggaggtgcattacactttggaaaaaaactgtgaatcacgtcactacgtggacactgcacaaagctgtgccactgtacaaaatatgacccatnttgtgtgacttcatttgagacacattacctgacatgagcaggtgaaagccatcaaagaattgggtgaccacg

SEQ ID NO: 526306 - DNA, 478 bp, Homo sapiens
  misc_feature (466)..(467): n is a, c, g, or t
tttttttaagagacaggttcgtcactatgtttcccaggctggtctcaaacacgtagcctcaaaggatatccactcaggcctctcatgggatatggtttgagtcacccacctagctatgctacgtgttttatcaaatggattcatttgaacaaaattaaaacttatatacattgtgatttcccttaaagaaaacataaatattcagtgtgaatggtaaagtctcaccaaaaccattcagttatctagtagtcaatgttaggaataaaatttggttacttacaaatctctatggcaaaatctagccaatatcacaaaattctcaaaggctaaaaattacagtaaatgggctgggtgtagtggctcatatctgcaatcccagtgctttgggaggccaccacaggaggatcattgaggccaaatgtttgagaccagcctgggcaacacagcatgacctcatacttctacnnaaaaacaattt

SEQ ID NO: 526307 - DNA, 112 bp, Homo sapiens
gatatatatctggtgcctcttatggtaataaaatcactgccccattgggggttttatattgatatttttgaaatgtgctataataattttagctattgaaacattctacaaa

SEQ ID NO: 526308 - DNA, 132 bp, Homo sapiens
ggctgacatacagagaggcgcgctatcataaaatacggcctataggctaaacgaacttagaccatgtctatccttttttatgcccggccaacacaagtgtagtctgcttttattattaagcataaattacta

SEQ ID NO: 526309 - DNA, 197 bp, Homo sapiens
ttgcgcgaattgaggatgttgtcgtcgtctggaccctgtgttagaattgtttatcgcgaaaattgtttaacaatatgaaatctgggcaccttgaaaaaagaacaggataacagtaatgttcagggaacaagggagataaccattaggtctggctgcctgagagctgggtggaacagagccatatttctcatctttca

SEQ ID NO: 526310 - DNA, 141 bp, Homo sapiens
gggaccgtgaatgatagcacgcactttcccttttgagaaggcagctcccagaagctcgttctgtgccctttctgagatgggccctaggtgggtccctccctagcaggcgaagggtagggtgcgtgctatcattcacatgta

SEQ ID NO: 526311 - DNA, 411 bp, Homo sapiens
  misc_feature (28)..(28): n is a, c, g, or t
  misc_feature (189)..(189): n is a, c, g, or t
tttgcggtgcctttcctccaggaggagntggatctacttgtgtaaaaaccctgcctcccttggcctgtgtgttctggggaacacctagattcacagggcagggtggaggctgagctgagctgaaaggtggggtatgggctctccaagaacaagctcttccagcgccctagtggggtgtgcagctgcatngctggctcaagacacccccacatccaactcagatctttgttttgagatggagttttgctcttttcacccaggctggagtgcaatggcgcgatctcaactcagtgcaacctccgcctcccaggttcaagcgattcttatgcctcagcctcccgagtagctgggattacaggcacacaccaccacagccagctaattttcgtatttttaatagagatggggttt

SEQ ID NO: 526312 - DNA, 610 bp, Homo sapiens
  misc_feature (173)..(174): n is a, c, g, or t
gcgacccctgggggttcccccccccccaaaattggaattttgctttgccccggtggcgctagggcgcccaaggtggattcccccaatatagtccttccaccagggcggccatcccctttggtggatattagaaggcctcccaaggcatgcccctccaaatgcccaagttttanntggggcccttgttgagtggacccctggtcctttcaaccaaaaacctttcccacgggcctttttttaatagaccccctattcccggggtggggtttggggggcctgtagaatcccacggggatattggcccccccctggatggggaaacaaggggggtgtggggggtttcccccttttatttgcctcatttccccccttggggccccatttggggggggaatggtgggccgaaacccccccttttttatcccgttcccttttggggaggggggggaaaaggggggatttccctttccccccttttttccaggtcccccccccccgcccccttccccccccactcaggggcccccttttccttgccccctttgggccccgcttgtttttgggatttgttttcccccccggccccgcccattaacttccggggaaatga

SEQ ID NO: 526313 - DNA, 307 bp, Homo sapiens
gcacccaggggtcatagaaggtactgaacggtgattgagaagccaactgcaggaatgtgagcctatggtcattatttttggctctggctgatgcctgggccccctgcccctgtgagtactaccccagtgatgcccaggaagcagggttctgtctccactgtactacccccacacaggatggtctctgcggtccagcagctctccgcgttccaatatattccccactttctgactcttcctctagtgcccatgccctccgccactgtcagcactccacaggtccagtgctggagtgcaataatgtccc

SEQ ID NO: 526314 - DNA, 851 bp, Homo sapiens
gtaccagttcaagccgagggagagttaattttccaactgaagtcccaagatgggtcggtgttacactcttaaggtgggggacctaataattagaaagggaagggaccacgaattatgagacaggactttttacccgggacaaaggttcccgcgctttctgatttctgcgtggtggagagcacaaagcgggggtgtataaaaatgatttctggtgacacgcaataccccacaatggtgttgtggcacacccgtgtcttgcttgtgaaatgtattagtttcaacataaaaagtcgttcaaaaacgcaaggatacaacctcttcgagcggataatagtcggttaaaggcccaatttatatacccacactactccaatctccaaatggttccagggagtgaatactccattatttcatatgacactaatttcgaaaatgggaagcataataataccgaatgatgataaaaacgaaaggcgatactcccatacgaataattcttccatctccccttcttattgaccacgagaatagaaaattttgtctctagaggccagtagtgacctcagagcatgagaaagagtgatggtctggagcaatccctacaggcctgcagatttctatctgctctccttccttgagcaccagagagagggcacacagaaaagggtgtggtgtttcccacaccccccgccactgagggagaactgggcttttttcaaattcgaccccttcctttttcccccccccccggatgggccccttttggggggggcaagggtccccgattggcccaccctggggatgttaggactcccaaaccaatttttttttaaataaaatttgggtttcca

SEQ ID NO: 526315 - DNA, 647 bp, Homo sapiens
gggccgggcgcggtggtcacgcctgtaatcccagctctcagggaggctaagaggcggaagggataagcttgagcccaggagttcgagacctgcctgtgggcaaatataggcgagaaccccggttctccctatgaaaaagtgacaacaaaaaagcagaagggcccacacaaaaaaatttacgggggtaaactttcacttcagagggcaacattttacacccttaacacccccaaaaaaagaacacaccccagaccaaggacacaacaaaaaaaaaacaccttgtgcgggcgcgaaccggactaacctaggaggccccctaggaagagaagcgtctatcaaagaaacaccaaccgtcggcgtggaagacgccgcagcggccccacacagagaggccaacaagtgaacaacacgtgcgtgccacaacagcggggggtccccacagagcgggcaacccacccggggtgcaacaaaacacacccagaacctcgtcaggtgcgggaaactcaccaccacccactatgcaatcataaaaaaaaaagacgccgccacgccgaggggcgcaaaccaaacaaccggccgcagacagccagccactcgtgcgcgacgaacaacaaacacctcaccgcgacgaatacagaggcgaccct

SEQ ID NO: 526316 - DNA, 401 bp, Homo sapiens
attgcaccactgtactccagccttggcaacagagtttttctatctcagaaaaataaaataaaataaaagacaataaagaaatctgctgcatcaagggactcttcctttcatgaaagatttctccttaacatactatactgtgtgatagcactttacccacagcagaacctctttcaaaataggaatgaatcctcttaaactctgatactgctttatcaaccaagtttatggaatatccaaaatcctttgttgtcattttaacaatgttcacatcatcttcaccaggagtagtttccagctcaagaaaccactttctttactcatccataagaagcaactccacatctgttcaggtttaatcatgagattgcagcaattcagcttcaaaatgtgacatagag

SEQ ID NO: 526317 - DNA, 271 bp, Homo sapiens
ctacacagtccacattgactcctggagaatatggtgactctccagtccccacaacacgaagtagtagtgcagcttccatggcagaagaagaagcatctgcagtcagcacagcggcagcccagttcaccaaacttcgccgatgcatgaatgcaaaggagtttacagttcaaatcaaagatgaggaaggattgaagttaacataccaaaagcacaagtagatggcgaatggagtaatgggagatggacatccaatgtatcataacacgacggg

SEQ ID NO: 526318 - DNA, 460 bp, Homo sapiens
aagcttgcggccgcctccgccctgcgctttgtggagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcacctttattactattggaagaagaccccgagcagccagctccgagcccatcgtagcaccgagcaggccggttcagagataaatgcaccggtcacacccgtacacaccctcaaccccgtcaggaattcttggacctattaacccgggagatgacttcgacagtgaggacagtgagcaggagctgaagggtacgcctgccgccactgcttcaccaccacctccaaagatt

SEQ ID NO: 526319 - DNA, 716 bp, Homo sapiens
  misc_feature (3)..(3): n is a, c, g, or t
  misc_feature (94)..(94): n is a, c, g, or t
  misc_feature (132)..(132): n is a, c, g, or t
  misc_feature (139)..(139): n is a, c, g, or t
  misc_feature (144)..(146): n is a, c, g, or t
  misc_feature (152)..(153): n is a, c, g, or t
  misc_feature (155)..(155): n is a, c, g, or t
  misc_feature (159)..(159): n is a, c, g, or t
  misc_feature (178)..(179): n is a, c, g, or t
  misc_feature (194)..(195): n is a, c, g, or t
  misc_feature (213)..(213): n is a, c, g, or t
  misc_feature (218)..(219): n is a, c, g, or t
  misc_feature (223)..(223): n is a, c, g, or t
  misc_feature (262)..(262): n is a, c, g, or t
  misc_feature (290)..(290): n is a, c, g, or t
  misc_feature (299)..(299): n is a, c, g, or t
  misc_feature (301)..(301): n is a, c, g, or t
  misc_feature (310)..(310): n is a, c, g, or t
  misc_feature (333)..(333): n is a, c, g, or t
  misc_feature (347)..(347): n is a, c, g, or t
  misc_feature (355)..(355): n is a, c, g, or t
  misc_feature (359)..(359): n is a, c, g, or t
  misc_feature (367)..(367): n is a, c, g, or t
  misc_feature (446)..(446): n is a, c, g, or t
  misc_feature (482)..(482): n is a, c, g, or t
  misc_feature (488)..(488): n is a, c, g, or t
  misc_feature (494)..(494): n is a, c, g, or t
  misc_feature (497)..(497): n is a, c, g, or t
  misc_feature (503)..(503): n is a, c, g, or t
  misc_feature (520)..(521): n is a, c, g, or t
  misc_feature (540)..(542): n is a, c, g, or t
  misc_feature (550)..(550): n is a, c, g, or t
  misc_feature (563)..(563): n is a, c, g, or t
  misc_feature (567)..(567): n is a, c, g, or t
  misc_feature (576)..(577): n is a, c, g, or t
  misc_feature (579)..(579): n is a, c, g, or t
  misc_feature (585)..(585): n is a, c, g, or t
  misc_feature (610)..(610): n is a, c, g, or t
  misc_feature (614)..(614): n is a, c, g, or t
  misc_feature (625)..(625): n is a, c, g, or t
  misc_feature (712)..(712): n is a, c, g, or t
ttntctcataaaaagattcaacttcaagtagcacaatttcttgtctgcttttaatcctgaacattcttgaagcatgaaacagccaactgtttanacaacaaatctaaaaaaacaaaaaaaaaaacaaaaagngccgaanctttnnnctctgnngngcangggctgttgtctcagcttnnggagggcccagatcnngccactgtgacctctggntttgnnagcnacaacaggtcccagcttcccagcccttccctcccctggnacctcccaaaagcacaagaatgcaaacngagattggncnaccactgangcaggggtggactcccgcttgantgtgccaacagggngggtggantgtnctggtganttcctggtgggcctggccaaccaagaggccaagtggcctcaccaggccttacctggctgcctggcagcctggagatganggaggaaggacgctcacggtgcgaaagtctggccangctggngggagntangtgatnatcctggcgatggcttnnagggaggggaagtggtggnnncgggcagnatggaggggtttnttgntttggtatnncnattctntagacctgctggggaggtggggganacangggcagtccangcccgcctgctgggtggtggcctgccacgcgctcttcttgttcttcttggacttggtgctcagaggcttctcgcggttgcagaagtnccgt

SEQ ID NO: 526320 - DNA, 152 bp, Homo sapiens
tctgaaggcactgggagatggactctgaatgccctgggaatatctatctcagatgccctctcatccttgtatgtcatagcttgatgtgcagccctaatggcacccactggcggccaggtgcacagcctggtggtggtggcaatagaactgtg

SEQ ID NO: 526321 - DNA, 231 bp, Homo sapiens
tcttactctttaagtgtttaaggaaaaaaagacagatggaaagagatggccgaggaaggctgatgttccaaatataacctttgtcagccttttcaaaccattagcaaatacacttaattccttccaaggtttattaaaaataggttgcacctgaaatacagtaaaattggaaacctacagcagttttgatgttttttcatagtaatgcagttctgaaaggcacttttacac

SEQ ID NO: 526322 - DNA, 1295 bp, Homo sapiens
ctagttctaggggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctatctctctctctctctctctctctctctctctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattactt

SEQ ID NO: 526323 - DNA, 296 bp, Homo sapiens
  misc_feature (182)..(182): n is a, c, g, or t
  misc_feature (239)..(239): n is a, c, g, or t
agggatgagagaagcagggtcactgaagagaagggagaatgttaacatgacaacaatttggcttataattttcctctgctccctgattatttgcatttgcgtcaggtgtcgtaaatcatcatgccagtgaattatttaaattcccagatgtattagatcttctgtaaactaagtattttgcnacttatatttttgctagttaaactgagtttctgtcatggtcacgtcaaatctaaagnacatttaatatttgctgcgcaggccacctggtgtgggtgtgaggaaaagcgcagctc

SEQ ID NO: 526324 - DNA, 735 bp, Homo sapiens
cacgaggactgatgcccaagagttaaatggcctctaatatctttgggacaccatgaagaaaatcaagacttcttgggccaagtcaacaggtgccaagtctagtggtggaagggaagacttgtgagtcatctggactgcagagaaggaactcctctgaagcaagctccggagacttcttagatctgaagggagaaggtgatattcatgaaaatgtgagacacagacttgccagtgcagcctggggcagagtgaagagaagccctgtgcctgctgctgcctgtgcccagccctggtggacccaggccccagtgccatccagaagaaatccccactggcggcaagtccagcctcgtcttgggttagctctgactgtcctgaactgctagtcagatatctagtctgtaacctccatgcttgtgaactgcacaacttgagcctgactgtacatctcttggaatttgtttcattaaaaagaagcacttatatgtactgctgtctttattattaatatactttgtgcaagaacaggtaaacacatctgacacattgacctctgtggactctgtgagagccataggcattgagttgtgaactagctagatacatggcgagggaacagctttgtgaacactaagaactgagatcataacgacaaaatacatgggtccagatgtgtagaggatctaaggaaatgaggtataaaactaacttggtttccaagctcaatgggcgaca

SEQ ID NO: 526325 - DNA, 251 bp, Homo sapiens
agcaggatacccgagtcccgatcagtaccttgtagctccgtgtattgccatctaatagtcacaaagctgtgacaccatagagcaagtgtgcgcctggagggttgatctctactgtagacatgtgcagaccctcgaattgtgtgccttcgcatgaaagatccccggtataagcccttagtaatgatgtgttatccctggatacggcaagaagggacgaaagtataacaaacacgcacctcatcattgccctg

SEQ ID NO: 526326 - DNA, 107 bp, Homo sapiens
tcactattgcgtggagagggctccgacgtgttgcagtggctaactgcggttaagaagcagcaggtcccagagagctcagcaggctgggtgcggcctaggtatgacac

SEQ ID NO: 526327 - DNA, 113 bp, Homo sapiens
accaggcaggtctagaaagtaatgatgcatccaggcgcagcagcagcactccacgcacagcagcacgaccaggaccacgtaggggaatgtagcagtggagtgctgctgcctgg

SEQ ID NO: 526328 - DNA, 136 bp, Homo sapiens
ggtaccttacagcttgtatttacacttgtaatgtacacctcctctgatctaatgattctccttctcggagtgaggcctaaagaactatttctagacatgaacagtcatttactcacaaggaggctcactacgtgct

SEQ ID NO: 526329 - DNA, 371 bp, Homo sapiens
gtgacctgaaatcacgacagttgcctcaagccacggcaatgagaaaaaaattcagtaaaaacaaaacaaaacaaaaccaccataaaataactcagacttaaataaatacaaccctagtggtgaatgactaaagatggattactcataacagagataacagtccaataagaatccaggaatcttccttttaatacaaaaatctttcttcgaagaacatcctctcaaggcaggaaatcattagtatgaaggcttccctaaaaacaaaattccttggcaggaatggttcacatctgtaatctcagcactcttggaggccgaggtgggaagatcacttgatgtcaggagtcgaggcgggaagatcacttgacgtc

SEQ ID NO: 526330 - DNA, 177 bp, Homo sapiens
ccgcgccagtgggcttgagtttaagagcaggatctctggaagacatccttatgacgacagtttgtccaaggggatatccacagagtacctgtgggcattaggtgatgtagttatacactttcacaaaagatttatctttgatctcttggcgatcttcttcttgcccatggcagctgt

SEQ ID NO: 526331 - DNA, 208 bp, Homo sapiens
tctcttactttactcaccttatctacttcctctgcctcatcatacactaatttccttctctcgttcctatctccaaataaagggtgatgggaatagcctatgaactgaaaatgcttcttcactactatctattgacccgcctctacttctaggtactctgtctgatcttctttaagatggaggatcactttggtacccctgccaatgg

SEQ ID NO: 526332 - DNA, 146 bp, Homo sapiens
actagcaggatccgagcaggtcacaggtatgaacgcagcctgcaaactcatcattcagcagggggctcaatcaacagcattcggcatgggctttcttctcaattccaggctcatttcccaatgcaaacttcagggtcactgcagct

SEQ ID NO: 526333 - DNA, 738 bp, Homo sapiens
cggacgcgtgggtacaaaaattatccgggcatgggcatggtggcgggcacctgtaatcccagttactcaggaggctgaggcaggagaattgcttgaacccagcaggtggaggttgcagtgagccgagattcctccactgcactccagcctgggtgacagagtaagactccatctcaaaaaaaaaaaaaaaaaaagttaaaaattaattaatttaaaaaaaaaaccgggtgcaggggctcagtgcctgtaattcccagcacttttgagaggccaaggggggcagatcacctgaggtcaggaggtttgagaccagcctgaccaattattggtgaacccccattctggtactaaaattacaaaatttaaccacgcattgggtggtgcattgccttcaatcctagctactggggaggctgaggcaggaggaaattgctttgaccctgggaggaggaggttgcaagagctgagaatcagtgcccatggcaactccagccggggcaactacgaggtgaaagttcagcctcaaataaaaaaaaaaaaaaactcaccttgttgtgtggggaatgggatattacaacggtgcgcactggggtactagtcattttagagattaacgagggatttcaagcggaaaagctaataggtgcagcattgtggggaatcaggttatccagggttaaattaatgccagaagttatctgcgaaccaatggacgaggggatggaagagtgtgtatgc

SEQ ID NO: 526334 - DNA, 314 bp, Homo sapiens
tccggtagatggatcattggctattctcttatcctcattactccatccaggagtggatagtcacatgcctggtacttccagaccaacctcgaatgagccagagcgccccacgataggccaaacttatcttgtagagcttcagcacgcacgacctatacgggcagcagtgaaccaccatccgcattattctatgtcgtagaggcggtagggatagccgtcaacacacctatgagacggtccagacgcggcctggcctcgcttggttacagtggagcagcatacctcgcacggtccgccagaagtgcgcctgggtg

SEQ ID NO: 526335 - DNA, 81 bp, Homo sapiens
tgtgcgagattctatggttcggggagtttcgagcccttatttgagtactggggccagggaaccctggtcaccgtctcctca

SEQ ID NO: 526336 - DNA, 162 bp, Homo sapiens
gtactgagtggaagtgctcggaatggtccacaggcccagaatcctgagttcgggaacttaggaggtccttactcaatctccttagtgctaaggttcagagtctcaaaccagatattcttccaaacctatcttgtagtactagtattgttccccccgtcacta

SEQ ID NO: 526337 - DNA, 938 bp, Homo sapiens
gcctgtaacgtaacagtggttaaacatccagctgttgcggcctgactccggatagatagccgaccctacgcactcagagtctacccctagagcgatagtgtcgttgatgatttcagttgaggaagagctaatgctagtctgggccaggttcagaaagctaccggaaacttgaagcaatgcagctatagcatcacatgtagaacaagagatggtccttctagcatttgcaaattgcaccagtacctccagctagtcatttgctaggtagctgcagttagccctgcaatgaaagaccgagggtcagttagcacaaacccttcaccatgactggaaaactcagtatcacgtatttaaacattttttttatcttttagccatgtagaaactctaaattaagccaatattctcatttgagaatgaggatgtctcagctgagaaacgtgttaaattctctttattcataatgttctttgaagggtcataaaacaagatgttgatcaaatctaagctgatgagtttgctcaaaacaggaagttgaaattgttgagcacaggaatggccaactataattaattgatacctatgagggctctggcggcttggcattttaatttgcagatacataccctggtaattctcatgacaaaatagacttgtataacttttgataaaagactaattccaaaatggccactttgttccctgtctttaatatctaaatacttactgaggtcctccatcttctatattcatgacattttcatttattaagcacatgtcatattaccttgatttcagaagagaagaaccatatactgtgtcccagagctataattgaacctgcagagtagtgcttctaagtgctaaatactggaagcttcaccgaattgcctccttgtaatcgcaattctgcttctaggcggcctccgggcgcggga

SEQ ID NO: 526338 - DNA, 142 bp, Homo sapiens
agctcggtaccagcttggtgcggatagtctgactatttaaggagactggcgaactctgcccaaacaatctgtggatggaaaagcaccacttgctactggagaggaggatgatgatgaagttccagatcttgtggagaatttt

SEQ ID NO: 526339 - DNA, 82 bp, Homo sapiens
gacagcagcatatatctctgcagcgttggcgcagggccctgggagacccagtacttcgggccaggcacgcggctcctggtgc

SEQ ID NO: 526340 - DNA, 398 bp, Homo sapiens
  misc_feature (6)..(6): n is a, c, g, or t
cgcctnaagacattaaaagaaaattttttgggcaggggcaaaggggatggcatttttttgtttttaaaaaaaaccctttggaggaaagttgcaatttatggggggtacggttgttggagggaaatttttgcttttggttaagccgggaattggtaaaaaagataaaattttatttttttttttggggcgagcttaaggaaaggttttgggggttctagttaatcagggcggaggttgaaaccttgctgggggtttttgatgtgcttctgtgcttttgaatgacttcaccccctagtttttgtctatttttcctttgatgttcaagtcctagtctataggattggcagtttaaatgctttactcccccttttaaaataaatgattaaaatgtgctttga

SEQ ID NO: 526341 - DNA, 539 bp, Homo sapiens
ggactcgagaggatcccctctactacccgacagctaactcatgactctgtcgtgaatgtaaatatttgtaattaagcctgcacatattggttgattgccctagagtactcaagtgttagcaccaagagcttttcaggtagcccctacatctttgtgcaattgttatctggttccccaaagtgtattttgctctaagtcgagggctatgccataatacaaatgggaatgttacctttgatctccttatgaaggagtttacaagtaggagtttttacattatgtagtaacactcctgatacaactctggttattagtgaattgagcagttaaggtttcttttgtatggattcctgtcctggaaagatattcatccatgaagattcaaggtcaagcaaaaaccaactccattcttgccaggagttggttgggctgagattgccaatcacggttaaacacaaagggtgcccattgaatgcggaaacagtcgttaacagagggcaggtattgcaatattgagggggcaccaagtttacttagaa

SEQ ID NO: 526342 - DNA, 298 bp, Homo sapiens
  misc_feature (14)..(14): n is a, c, g, or t
  misc_feature (25)..(25): n is a, c, g, or t
  misc_feature (57)..(58): n is a, c, g, or t
  misc_feature (202)..(202): n is a, c, g, or t
  misc_feature (265)..(265): n is a, c, g, or t
gcttagcacgaggnaccggcgagancctggagcaactgctgtaccacctaaaggtcnngtataacgcctaagcggaggccgagctgggccaggcccgccagccgctcaggtggtagccacgccagagcggggtcgcctctgggcctctttttgagcaaacctgggtgtaaattcggtggttttaaatgcataaagtgccttntggacacgggggagttgtggtgcttctgggtctctgggcctcgcctgctggcctgaaatgcgntcatgttgggaagcattccgtgccccgtacccc

SEQ ID NO: 526343 - DNA, 135 bp, Homo sapiens
aggctcgttatacctatatgggctcgtcatactactccagaggaggcgaaggccaggtccgggggggatagggctatcagattacagctagggcaaaccgaacaatttaagtgggacaataacagggtaccgagc

SEQ ID NO: 526344 - DNA, 737 bp, Homo sapiens
tggggggggaggaatctgggctctgtcacccaggctagagggtaggggcacaatctcggctaactggagcctccacctccggggttcaagaaaattcttctgcctcaggctttggagtaccgggcattacaggcaccggccaccacgcccggctaattttggtacttttagtagaggtggggtttcgccatgtgggccaggcgggtcttgaactcctgagctcaagtgatcctccctcctcggcctcccaaagtgcacccctagatacggatgcggctcctcacccagggacacttcccggggaaatccatttctcaaagaaatttccaagtatactggtaggcccccagttgaaatcttggagagaacagaccctaggagctgagcagtgacgggttgggactcgcactttccagccgggagtgcagatacagtgcggctattaggatggcccttggttacgtacccatggccagggtcaggggtgaaataccacgtggggagggcacctcattcgtacgaagaattcccaagaagggggttgcccggggtatataaaagcaaccggccagggttgaaagactaggtccgcacacccgggacaagggtttcacggagaaacagctgacctcacggattggaagctgcgacagggaatatcccctttggcgatcgggtcacacgactctatcaccaatggagaatggccgtgtggaccgcccgacaagacccgaagc

SEQ ID NO: 526345 - DNA, 259 bp, Homo sapiens
agcagcagttctcccattaggatacctaatcatagattgttacagccttatcatgtacctctctcacctttctcttaatcatgaggcaactgatcactcacgtattatggcaatataagggaactccatagagcttgacgtttactcctgtcgtcctgtacagggtcacagcgcttatatgtttcttttcttttctttcttactttctctcccctctctgtctttctttctttcttataatacagatcggcctctccat

SEQ ID NO: 526346 - DNA, 199 bp, Homo sapiens
tgtgcttacagtacagtgatggcagatggagacaggcaatcagaagtgtatggaacaagctcagtgtatggctgagagcatggagatgaattgcttgtacctggcgatgtggcatggttgcaggtgagtcttgacatcaaggcccctgttactccgaacctgtagcaacaggagtgagactccatctaaaaaaaaaagc

SEQ ID NO: 526347 - DNA, 1042 bp, Homo sapiens
gcattgctctacaatctgtggcgcagcccttgccaactctggctcttcccccgctgatggtgcctcggcagagatgtgggcagctggtcaggatggccattcggtgctcaggacagcaacgcagcccagtactcagactggggaagccaacaggggctggacacggccaggagagccgtgtctggacagctgatcctgagatgtgggagttgctgcagagggagaaggacaggcagtgtcgtggactggagctcattgcctcagagaacttctgcagctgagctgcgctggcaggcctggggtcctgcctgaacaacaagtactcggagggttatcctggcaagaggatactactgggggagcagaggcggtggctgaaagtcgaccctggcgtgcccaccgggcggcggacatcgggacggcgccgaccccggaatcctgcaacaggggggagaacagacccccgagcacccaccccggcacgtcccagaccgaccgtggcacgtcccacagaccggccctcatgcgacctcactgacggggagacactggggaaagcaccccacagaacaagagggccaaccacacccacggcgacaatgtaccagacggtcaagcggaatactcaaacccacgtaccatcgtgcaaccgacgatcacgcacctagtacgttcaccggggccagcagccaggcgcctggccagcctcacactgcccctcgtcgactcgagccaggcccagaaagcggcacaaaccggacaaggcccaatccatccagaaccgcggacccaggacgcctccagcccccgacagccacctccccaagccgccgagcaccgccaaaggcgcggccagacccaacgccagacgtcgccgcgacctaccgcacgcagagaccgacgcccgacacccgaaggtcccgagagccccaaaggcgcgaagcgagccatgagttaaactgagagacaagcacgcgtgaacaccaccccggacccacaaaataaggcgctgaaagccagaacgccagaggatatatctaga

SEQ ID NO: 526348 - DNA, 1155 bp, Homo sapiens
  misc_feature (99)..(99): n is a, c, g, or t
  misc_feature (318)..(318): n is a, c, g, or t
  misc_feature (380)..(380): n is a, c, g, or t
gtttcgtcgattccttctaccttgcggtgccttattcaatgtgcatgtcgtgagacacaatgggtgctaaatcgtcccatgagattatcactgagaacncagactcggctgtgcgcaccagtgaccctcccatagactattctggactcgcgatgctaccagagctcgattaccagggcacgtgtccgggtctgtcctgcgcagtgcaaggggaatgaatcctgtgggactcatccgttgcattgcgacacgctgtacatccgcgaataattctcatgaggagatagagtccacgcaagagtcccttggtcatgatgngcctctgaggcgcactgaggggatcatcctcgtggggcccacggtgtggagcaacaaccgcnccgtttgtagaactcggtaccgtcgcggatagttggtacagctccttgcgaaaagttcggctgcacattgacgcaggataataggccgtagagaccgttgggcttcccacgggcaagccttttgatgacctgggtcaccactgcttgcccgctggggtttgcgaaagtgcacctcgtgccctaggaggggggctcgggctcgcggagaacaaccactgtttgccattgcaaaggaaccccaatacggcgcggcctgttatgtgggccacgctaggcggcacccaccaaggtctaagctggtcgattgtgatccctaatcctgtcggctgttacgctgggagaaaaactctgcgtcaagcagcaatctgagacgacccaggggggccaccctctcggaggaccgggacggcatgatgtggatccccagggagacttggtatgggaactttattaaaggccctgtctgtgtgggacgcacgtttgtccacgacagtggtcagtgtcgcgcggacagtgacacactggcgttatgagacgtggttcatctctgtttccccccagggccccaggatggggtcgttgtcaccaggaaaacactttccattttgtaaagtgtgtgcaacggaagtgaaaacgcggcgacacatctcccgtgaacttttttccttaagtgaaacgcaaaggccggttacattgggcctcgcccatgaaacagttgttgccttgtcttagaacgcgcctcgaatgggagggtgaaaacgacatagttggtgca

SEQ ID NO: 526349 - DNA, 291 bp, Homo sapiens
cgcgcaagagtgtatagagagtttagagttggttaatggtcgttgtcctgcgagcccgttgggtacagtatgtcgttcaggaggggttgtgcgtatgtcagttgtaagagggagacctcgtggtgcctgagtttaacccgttcctagtgcgttttgccgacactacgcttcgtgatcgccacttggggtatttttcaacgatactgtataacccaccagatgcccccgattatagcgcatcgttactgcctgactggctaacctgtaccttcatcaaaagtggtcatcacg

SEQ ID NO: 526350 - DNA, 255 bp, Homo sapiens
tgtactgacccacctgtgcagaggaagaaaagtggatagatttaagagctattcaggctaggcacagtggctcacgcctgtaatcccagcactttggaaggccaatggcaggaggactgcttgatcccaggagttggaggctgcagtgatcacgccactgcactccagcctaggcggcagagcaaaaccctgtctcaaccaaagccgaacaagagctattaagaagcaggccttagtggtgggtcagaacataag

SEQ ID NO: 526351 - DNA, 1035 bp, Homo sapiens
ggcagacactgaccttcagcgcctcggtccaagcgccatggcgccctccaggaagtcctcgtgggggaacactggaaaatgaccgggcggacgcagagtctggggacgctcatcggactctgaacgcggcaaggtgccgcccgacaccgagggggtttgtggctccccctatggccttatatctgatttcgccggggaagaacagctagatcccaactgatggctgtgggtggcgcagacttggctaaaaacgtgactacaattggggcttatcactgggggagatcaaagcccgtggcattgtatcaacaagactgcgggagccacgtgggttgtgaccgtgggggcactcaagaggacaaacggcatgggtcttctggggggacgtacagatggcgagccttgtgggcacagacaacggtgccgccacgggctccgggcagcgaggggcactcgggaggaaaatcggccgtgccatttggtggcacgaaaggcataagacgtgaaagtgcggacagcgtgggaatcccacagtggccgaaagggtgtgtcatcagaccgacagaccaacgcgtgtcactcggcaagaatacagcggtgacagcgacgtggcagacaaggggtcgcgtctgcgccatatgacagcttgtggtggggtcatgacgtaccgggacagacgtgatacacacccatagagcgccagggaagtaacacgagaagcgtccgaggtaatggacagcacgtacagcgtctcagatgggaggaaacagagcaccgtataataatgaagggcctgtgaggggcaacctgaggacgtggacagcaggttgagtggaggctccagggggggggccacataaagccggaatgggcatacacgccagatgggcactcagtctaccttcgccacaggatacacaaagcagaaggccacgaataggaggacagcccggcacaaggatcctggtattcaccggtgcaggctcccaaggtcaccaggctcgaaggggtgcgcacggaacacagcacgcggtg

SEQ ID NO: 526352 - DNA, 630 bp, Homo sapiens
ctatcatatagtaaaacccagcccatgagccctaccaggggccactctcagacctcctaatgacctccggcctagccaatgtgagtttcacattcacagcgtcgcataagcgctcctcatactaggcctactaaccagaacactaagcacatataccaacgatggcgcgatgtaagcacgagaaagcacataccgaaggccaccacgacaccacgtgataccaaaaaggccttcgatacgggataaaccctaataaaattaacgtcagaaagacaacacacgtccgcaagggacagaaacagagcgatgtgcacgaacacacaaggccaaagcgcccccaaacccaccaaaagaaaagaagggaccagggaaggcacaaaacagcgccatccaaacccccaggatacaacgatcacccacgtcacaacggaatcaccgagagtcgcaatcaggacacaaacatacagcgcagtcaaatacggccaatcaacggcaagctcatcaaaaaccaacatggagagcacaaccaaaaagaagaacatcaaaaaacacaacgagaaagccagcaaacaacaaaaggaaaggcacacagaacaccacacagaaaggggaacaaaaacacggcaaaca

SEQ ID NO: 526353 - DNA, 695 bp, Homo sapiens
ccccgcctagctcgggcgccacccgagccctggcccaccttcacagtcgcgcctccgaggggccagactcccgccagatattcgccttggatgagggagcttctacctccgccctgatatgacccgggcccggacgggaaagggccccgacccgcgtataccccgcttcccgacctggagctggaaaaggagttcccacttccaaccggctacctgaccccgcgacggcgcatcgagatcgccccacgccactctgcctgtctcgagcgcccagatccagatctggttcccagaaccggcgccatgaagtggaagaaggacccacccaattgaaaagtatgagccctggctaccaactggcagcgcctttcagtcctgagcccgccccgaggagccccgcggccccagagcccgtgccaccccccgcctggcccctcccatcctccccgctctgccgccgccccgcctggggaccggttccccccagcctgcctcgccttgtgttacgatatttcgtttgatcttaggtcttcctcgtggctccctctttcctggactggttatcttgttattattgttaataattaataattattattattttccttcccagctccccactcccttttgcttgtccccaatccccccgtgtttctgaaagtttgtgtctgtggttgccgtctttccccccggga

SEQ ID NO: 526354 - DNA, 157 bp, Homo sapiens
agctacagattctcccaggctctctccagtttgtcatagctatttcctttgttgaatcctgaatacttctgaaagttatattttgattttcctttgatgaccctgtttttattctcttgtagacctcagtactataagttgattgggttgacgtcag

SEQ ID NO: 526355 - DNA, 101 bp, Homo sapiens
  misc_feature (44)..(44): n is a, c, g, or t
  misc_feature (56)..(56): n is a, c, g, or t
  misc_feature (58)..(58): n is a, c, g, or t
aacgaaaggaacgcaagaacagaaggattattttttgggggacngcaaaggccaangnccactgtggatttttcgcaagaacattaataaactaaaaactt

SEQ ID NO: 526356 - DNA, 943 bp, Homo sapiens
  misc_feature (25)..(25): n is a, c, g, or t
  misc_feature (76)..(76): n is a, c, g, or t
  misc_feature (113)..(113): n is a, c, g, or t
  misc_feature (175)..(175): n is a, c, g, or t
  misc_feature (186)..(186): n is a, c, g, or t
  misc_feature (206)..(206): n is a, c, g, or t
  misc_feature (213)..(213): n is a, c, g, or t
  misc_feature (218)..(218): n is a, c, g, or t
  misc_feature (268)..(268): n is a, c, g, or t
  misc_feature (272)..(272): n is a, c, g, or t
  misc_feature (313)..(313): n is a, c, g, or t
  misc_feature (342)..(342): n is a, c, g, or t
  misc_feature (371)..(371): n is a, c, g, or t
  misc_feature (401)..(402): n is a, c, g, or t
  misc_feature (427)..(427): n is a, c, g, or t
  misc_feature (488)..(488): n is a, c, g, or t
  misc_feature (493)..(493): n is a, c, g, or t
  misc_feature (498)..(498): n is a, c, g, or t
  misc_feature (600)..(600): n is a, c, g, or t
  misc_feature (622)..(622): n is a, c, g, or t
  misc_feature (655)..(655): n is a, c, g, or t
  misc_feature (703)..(703): n is a, c, g, or t
  misc_feature (707)..(707): n is a, c, g, or t
  misc_feature (715)..(715): n is a, c, g, or t
  misc_feature (778)..(778): n is a, c, g, or t
  misc_feature (810)..(810): n is a, c, g, or t
  misc_feature (824)..(824): n is a, c, g, or t
  misc_feature (839)..(839): n is a, c, g, or t
  misc_feature (859)..(859): n is a, c, g, or t
  misc_feature (928)..(928): n is a, c, g, or t
tgtagtgttttcaaagatcaggcgnggggacccacaccttggcctccagagcctaaggaggagtgttacgtgcagnagcacccgtgggtgtgatccacaaccagaactgaggnctgcctgggtgctccacacaccaccagggcctagccctggactctgcccattgactctcccntaacttcctcngggccttggtgtactcctcngtaaaanggggnggagagagtggcattttcactttctcgcacataactgagcccacatcatnaacnagactgtgggccaagcacagagataagatgatagaagacancaaaacaaggtcttgaagtgggatcccancacgtccattctatcccagacagcacatnactccatggtatgagggatgggggtcatcnnggtgaggctttttacctgtgtttgnaagaaggaaaaaagaaccatgcatgaagaggcacagaaaggaagtatggagccagcaatancttgngaggngaaagcggagagaggacatcactctggtccaacccccaatctcaccccacaaataagggctcttttttcccccagaggctctgtataagctctccacaagtntcattctcttcctaagcctcantttccccatctgtgcaatggggaggttggattncatagtctcaaactccaggctctgctcaatagaggaaaagggaatganagantgcaagancacagagagaacaggagaacccacaccagggtggaaaggaagggaggagggaaacaggcaganaaggaggagagcgcctgcagctgcctgcctgngagaaaggagagancaggtgtgcacagcnaggatgcttccagacctgcncgggctatgtggggcacttcctgttcacttaacggctgcagccctgcagtggtaaaaacaggcctgganaagaaggtgaaggtt

SEQ ID NO: 526357 - DNA, 138 bp, Homo sapiens
tgtgaaaagtatgtaaacaaaagtaagcttacattatgatcgacattattaccatgatgtaggtcacgcactaggaccttactgacattccacaagctttccttgaagcttcccaatcacaacccagtccttctctca

SEQ ID NO: 526358 - DNA, 156 bp, Homo sapiens
atatctacccccggcctccttcactgtaggtgagcatggctgctgcccttgaacaaaggacacagcccttataacagccctcctttccacgtgacttgttttcttccaagttcctgtaactgttccccttctgctaaggagaacaccaactctaca

SEQ ID NO: 526359 - DNA, 443 bp, Homo sapiens
taaccctttagataatatttacaagacacttaatgatatagatacactgtatcatcctctttctcactcccattttatactagaataaactgacaagcagaaaagttaagagattttcacactgtttcactgctaagtggagatggtggggtttgacgtctgaaatttggtactaatgtctgcatgtttaatcaccactctgtgctgtctccctgtgtgttgttttgagttttcagcagcagcatttacagaaaggaataatagcaggatagttaagaacactatagaacttgctagaattttatgcatttattaaaatgttcatttttgaaaagctagtgttaatatgcaatgtacttaagttacatgcagaaacaggatacaattttatgtcaagtaattacaattatgtaacaatataactctctgcttagaaattaaaa

SEQ ID NO: 526360 - DNA, 228 bp, Homo sapiens
ggagagccctgactattaggagactgctccatgattcattaacggcagcatctagaaaggtggcttatgatcccagagttcaattcctgcaaagcaataacatatatgtcaagattgaggttctggttgttcacgctgaatcaggtcactgagactctagagggggcgctgccgaagccacgttccaagtcacgaagtgtatgctgagcctcctgcctttcggcccgc

SEQ ID NO: 526361 - DNA, 889 bp, Homo sapiens
ggtacaaaagtactaaatgtaagagatggtatgtcatatggatcgcagcacatggctaatccttgtttacgaagatatcgagcgcttgcctgatgcctggatagacaatcgatctatgatggtgggagagctagtggcggactagtcctatgcagtgaatcgtgcaggcactgtatccaggtcggagcccatccaacttcagtcgaagacagagtgcgcacattactttgcagatcaggctggactgtggcatgctttctaattccaactttatacaactagcaaaaaaagtgtcgcttattccaccagttctactgtgaacatactcgagtataaagacatgtagcaaatacacggggagtggaggggggagtctcacagtgccttgtgcacgggcccgaaccttgccttaaatcttcctcaaccaaataagtatttacatacagttgcttgcagagaatctgaatgtaggatgggtccaactgcacaacaaggacacaagatttttcaccactaatgtagatatcagctcctacaagtgacgccacccgcttagtgctggccttctgtcgtaacatgcattatgcctgttaattacaagacagcatcccaaacactggtactatttctattcccatgtagcaacggccggaaatgtctcataaagctacctggacaacgcagatgaactgggcggtgtaaagtagtccgtaggtcccggcggagcctaatatgtactcttggactcattggacaaagtagggttggcggtcaccggatcagccctgagtgcacatctcgggcacaggcacaccatgtgcgaacactgaatggacagttgatttcccaaatttggggaacacacacacacacaagtcaagaagcacaa

SEQ ID NO: 526362 - DNA, 783 bp, Homo sapiens
agcggagtcgccgcgcgaacatggcggcgaaatccactccaggccgcatagcagccgcccggtgctgctgagcaagatcgaggggcaccaggacgccgtcacggccgcgctgctcatccccaatggaggacggcgtgatcacggccagcgaggacagaaccatccgggtatggctgaaaagagacagtggtcactactgggccagttgtacaaccacaagggtcttcttccttggctccggcttatgcgctttccccattcatgcacgcgcgagcacggaatatagtgtgcgcccaggataagtggcagcgtgtagtggaattcacacgtccctgaagattttaataaccatgaaacttatatcacagacctacccagctccatcatgaaccgggtgtctgcgatatccttcagcttggccacagagtgcctagatcagtaccggccacgacaaagtgtgtgcacgctgggatgttgcacgccggagcgggcacatgctcgggcagggcacttctacacgtcctgggctatcgtgtctgccaaatatgactgcgacactcagctatgcctgcccgttggtgattattcctgggcagcataacctgattgacagctttgaacagaaaacgttgtacagtcaatcacctatcctcaaaggactctgaagggtgtgtcgcctgcttctgggtgggaaccctattcaaggcggttactcttcttcaggagcatctgagaaacagcatcttcatgtgggacatcgggagggaagggaaagggccggcc

SEQ ID NO: 526363 - DNA, 528 bp, Homo sapiens
cagtccaacatccggggtcagtccaacatccggggtcagtccaacatccggggtcagtccaacatcctgggtcagtccaacatcctgggtcagtccaacatcctgggttcaagcgattctccagcctcagcctaccaagtagctgggactatatgcgtgcgccaccatgcccggctaatttgtggtggagacgggtttgtgccatgtgggccaaaccatcattcttttggatgctcagatggaccggcattgggccagtgtgtgtgtccccagcagtctttaagcccctctgacggcttgtcctttcactgctgtccggtacagcgggtccctcctctttctacagtttggtctcttggtgtcatgtccgggttgtgaagccctgactttctccggccgaccacctaagtgccagcattcagaaccggtcaggcccgtcaggcagcctgtctttccatgctgtctctcattgcatatgtcccatctgtgccccaggatgtggactggggtaccgagtcgaatcgtatc

SEQ ID NO: 526364 - DNA, 377 bp, Homo sapiens
cagtccaacatccggggtcagtccaacatccggggtcagtccaacatccggggtcagtccaacatcctgggtcagtccaacatcctgggtcagtccaacatcctgggttcaagtgattctcctgcctcagcctcccgagtagctggaattacaggcatgcaccacaaggcctggctaattttaggtagtatgagtagagacggggtttctctatgtggggcaggctggtctcgtactcctgacctcaggtgatccgcccgtctcagcctcccaaagtgctggggataacaggtgagccaccgtgcctggtccttgcagcttgattttttaaacatcagatttgatatacttataggatacggagtttcactgttatt

SEQ ID NO: 526365 - DNA, 141 bp, Homo sapiens
cacggagggctgtagagctgagacgacctcaggtttgaggtttccggtctcgatcttgacgacgtgaccggccttgcaaaccgtcactttggcgctcatggctgcggccagattgatgcgctgccatccacccgaggacga

SEQ ID NO: 526366 - DNA, 850 bp, Homo sapiens
ggttgacgggggatactgcctggacggtaggttccagagggaggcagacatcgtcaagctgtggctggtgcgcagaagagtatcttgacccttcgtatgtaatccgcgaagactgttcggaatcacgccacgtactcttcatcgtgctagcaagcaactagcacacagccacagccgtcgcgtcaagatggccccaggctcccgggcgagcgtgccagctacgcctcccacaatgcaagcagatatcttgcagctacgctaccatttcgcaccaggtactgccgaggagtgcagcctctgacaataatatgatgggctcttgtggcaccggcttctggccatggtgacaatgaattgcgtccctcatgcattggagactacatcagatcccagtgctagctccagtcggcagggctgagtgcggtgggtccttgggtcgctgtatgacatttgaggtccctggtaggatgacgagtctggaggttcctacacgctggggaggtgtgtggaggtcctggatagctccaaccccatcctggtggaccggccgcctgcagcaacaagttgggcctcttccctgccaactacgtggcatcccatgatcccgataaagctcttcaggggacagaagctttttgtctggagctgcccactaagaaaagaggggcaaggaaaaaaggacgtggacgtgccatgactatatatacatacatcgtatctacatctgcctgtgtacacacacaacttttatacagtagctaatttattggcaacttgggtctggtaattacgttgatagcaaaagggaactcaggtggagaataatattgacacttgcttttctgcccct

SEQ ID NO: 526367 - DNA, 365 bp, Homo sapiens
ggctgctgagcttccaacaatatggatgggctgacatgcaggtcacttttatacagacatttttctgcccctgtccagccctgaaacagcaagaccaacccctcctcctccgcttactcagtatgaagatgattaggataaagaactttatgaggctgggcacggtggctcacgcctgcaatcccagcacttcgggaggccgaggcaggtagatcatgaggtcaggagatcgagaccatcctggctaacacagtgaaaccccatctctactaaaaatacaaaaaattagccgggcatggtggtgggcgcctgtagtcccagctactcagagaggctgaggcaggagaatggcgtgggcccaggag

SEQ ID NO: 526368 - DNA, 838 bp, Homo sapiens
  misc_feature (12)..(12): n is a, c, g, or t
  misc_feature (123)..(123): n is a, c, g, or t
  misc_feature (140)..(140): n is a, c, g, or t
  misc_feature (156)..(156): n is a, c, g, or t
  misc_feature (171)..(171): n is a, c, g, or t
  misc_feature (177)..(177): n is a, c, g, or t
  misc_feature (213)..(213): n is a, c, g, or t
  misc_feature (217)..(217): n is a, c, g, or t
  misc_feature (220)..(220): n is a, c, g, or t
  misc_feature (270)..(272): n is a, c, g, or t
  misc_feature (289)..(289): n is a, c, g, or t
  misc_feature (307)..(308): n is a, c, g, or t
  misc_feature (315)..(315): n is a, c, g, or t
  misc_feature (398)..(398): n is a, c, g, or t
  misc_feature (409)..(409): n is a, c, g, or t
  misc_feature (421)..(421): n is a, c, g, or t
  misc_feature (437)..(437): n is a, c, g, or t
  misc_feature (439)..(440): n is a, c, g, or t
  misc_feature (443)..(443): n is a, c, g, or t
  misc_feature (448)..(448): n is a, c, g, or t
  misc_feature (485)..(485): n is a, c, g, or t
  misc_feature (575)..(575): n is a, c, g, or t
  misc_feature (594)..(594): n is a, c, g, or t
  misc_feature (671)..(671): n is a, c, g, or t
agtgacggtgcngggggagtgacacgctctaaatacaagtgtaatgatacagctgagacgttaactcagagggtcttttggggcgagtggttttcagaaagcgtctgctctctagggcggtangggtcctctacaagggnacgtgcagatccaggngctggggcgtcaggnatgggngccattttcatgcttcaactcaaactccaggtggtngtgngcncaacggtccctcattccacaaaacatgacagcaaattcatcttctaaaannngttttgttttgtttttncccattcaacagggaaannaattagncacacacggtgaaatttacaaccagcagcatcatccatcacactgtctgttctaccagatcctacacttaaagctcagcattnttggtattagngctttggggggngttagaattcttaggngnnggngtganatttgggggggtgtgcgaacaacaaagaatgcccggncctgaaccagacctaaagcgccttccagttcctccacacatcatgccccaacaccatccagcccaatcgggcaccaggacagtgagggangggtggctgttcggtgggngacggatctggaaggaaagattttcaaaaaaaaaaaaaaagtgtctgccaaatttgaaaaattaaaagttatctgtntagcagaaaaatcaaatgggtaaattagcactttagaccgataacagataataaaatgacaaatcagaatgaacaaaaaatcattaaccttttgatttcagtattttcaagagattttatcagaatactctaaatgacaaaatgactcatggtttcttatgtttgct

SEQ ID NO: 526369 - DNA, 528 bp, Homo sapiens
tgtgtaatctgggacgtgcgggccagaggggctgtgacatgctgtgggaagaagagaagggactggtggagtctggaaggtgggagatagggctactggcttggcgggagcagaggcagaggtactaacccagactgagcgctggcaatgaccttgaggctggcagcattgcggatgagcttgtccagggtattgacaatctgggagaatttgggcccgaggttccggtcccgcacccagcagtccagcatgagctggtgcagtgctgtgggacagtccatgggtggtggcagccggtaatcctgctccacggcattgatgaactgggccgaaggcagggaaaccctgagtgagccactgccatgatccccagccagcacccacctagccaaccactctggcgtagcctcactcacatcctggttgctcatgtcccagtagggtcgctctccatagctcatgaactcccacatgacaattccgtagctccagacatcactagcagaagtggacttccgataggctatg

SEQ ID NO: 526370 - DNA, 119 bp, Homo sapiens
gagtgatgctgctggtgagttagaggatccagttcctggtccccactactgcagcacctccaggcctgttgctatatgatgcctaccgtgtatgtcaactaaacgaacatgctgaatgc

SEQ ID NO: 526371 - DNA, 437 bp, Homo sapiens
cggtacacttaccaagttcaagtgattctcctgcctcagtctcctgaatagctgggacgacaagcgtgtgcacacactagttaattttagtatctttagtagagatggggttcatcatgttagccaggctggtctcgaattcctgacctcaagtgatccacccacctcggtctcccaaagtgctgggattacaggcataagcccaccacgcccagaccttgttcatttatttattgagacagggtctgactctgtaacccaggctgtagtgcagtagcaggtatcacagctctctgcaggcttgaactcctttgctcaagtgatcctcctgtatcagactcccaagtagcgggaagcatgggcataacgcaccatgcccagctagttcttggatttttgcagaaccagggtctccctagagttgtccgccaatcgaa

SEQ ID NO: 526372 - DNA, 242 bp, Homo sapiens
tgctgcagtcgatctccaggatccccctggctgctcaggtcttgtcgcgatacgtgtgttctgctgagtgttcctgcatgtgagtaattaagaccatgggaggggagagagaaacccacacataaacaatgcactaaagatcactgaacttgtttaaactatttccacgttgcctagtttacatttctatgaaagactgtatgcttgtattggaattgtttcttgttcactgacttttaatg

SEQ ID NO: 526373 - DNA, 233 bp, Homo sapiens
ggcatgagaatcagctgaaccaggaggcacagttctagtgagccgagatggcaccatcgcactccagccggggtgacggagcgagactcgcctcccaagagagaaggaaaaaaaaaggaaagactagagaggaaatattcgacaaatgtcaatagatggttcccggatgcagatggtgtagatttggtccgtctgtgtcttctgattttcagtttaattgttgccccagagct

SEQ ID NO: 526374 - DNA, 175 bp, Homo sapiens
cccgatgatcgatcactgtactatgattggactgactgcagtatggacctgtgaatatagatgaaaaataaaaaagaaatgctaaaataaaaaaacttagctacgattagtgttaaatatcaaaactcaccgagacaatccaatttttaaagaaaactcgatggaaaagatgctt

SEQ ID NO: 526375 - DNA, 286 bp, Homo sapiens
  misc_feature (22)..(22): n is a, c, g, or t
tgtgggatgggaagtttctgtntcggaaagaacaggatgggcggtgctctctggggtgtctcctaccaagcagctgttgaaggctcgtggtgctcagggagcacgagcaacactcgccgtcgcttcagcttcatcttcagggcacacagcatttccgcgcaccagatatcctcaggctcaggggcgagcaccttccggtggcttctcctccaacgactctttcagatacgtcccaccactacctattccttttccagcaaaaggacctaatgcggggggctgggat

SEQ ID NO: 526376 - DNA, 588 bp, Homo sapiens
gtgagcagtactgcggactcctctcctctcctaacctcgctctcgcggctacctttaccctgccgcgcctgctcggtgaccagaacaccttccaccatgaccacctcagcaagttcccacttaaataaatggcatcaatgcatggtgtacatgtccctgcctcagggtgagaaatgtccatggccatgtatatcttggatctgatgtgtacttggagaagtgacatgctgctgcaatgaccctggaccctgtgacaagttgagcccaaagtgtgttggaaagacgcttgcctgacagcttggaatttccgcatgtgctccatgatactttatcacgctcatgagggtgttaccaacacgtttgcacacttgtactcctcgtttgccttgcttgccattgatattcgggggacacccctttcacggtcaatggggaaccactaacaccaccagccttggcttgttcatagcttgacaagtatcactccaacgtgttaaccacaatctgcaaatgtggccttgcccagccagaccccaatcttcgacggcaccacacttgtaaaaccgggatcaactgggcacattgggc

SEQ ID NO: 526377 - DNA, 361 bp, Homo sapiens
atattcatggcgtgcgacttgtatcttaaagcgtagatgttgtggttgctttattagaagtttgtatcttgctgtgtgtggtggctcatgctcacaattcccagcatcttggggtaggccgtagtgggtggctaacgtgaggttaggagttcgagaccagcctggcgaacatggtgaaaccccatctactaaaaatacaacaattagccaggcatggtggcgcacgctgtaatcccagctacttgagaggctgaggcatgagaattgcctccaggaagtggaggttgcagtgagctgagatcatgccactgtactctagcctgggcaacagagcaagactgtctcaaaagggaaaaaaaaa

SEQ ID NO: 526378 - DNA, 246 bp, Homo sapiens
atatgagattaacactcattctcaccagacctgctaggcgaacagagaattagtaccctagcgaacgccttaaataccactcgccacatcaagcccgagatgatatgccgatgcggctacacaattctccgagtccggcccgtacaaactaggaggcgttcttgccctattactacccatcctcatcctagcaataatccccatcctgcatatatccgaacaacaaagcataatatttcgcccact

SEQ ID NO: 526379 - DNA, 199 bp, Homo sapiens
gttcaacgtggaatggttaaagccaacaagcaccagatttaaacaggcttgtgaagaagctgtatgacatttgatgtggccaaggtcaacacccttgattcgggccctgatgggagagaaagagaaattgggatcatctaaactgagtccagctgccctaattctgaatatatatatatatatatcttttcaccataaa

SEQ ID NO: 526380 - DNA, 112 bp, Homo sapiens
tcggccggtctacgggatacggattgaatatcgagatgggctcccagatcgcaatggataaacgaacagaactttcatttttttttttaaaatcactgttggggtgggggat

SEQ ID NO: 526381 - DNA, 445 bp, Homo sapiens
  misc_feature (161)..(161): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (184)..(184): n is a, c, g, or t
  misc_feature (187)..(187): n is a, c, g, or t
  misc_feature (297)..(297): n is a, c, g, or t
  misc_feature (307)..(307): n is a, c, g, or t
  misc_feature (318)..(318): n is a, c, g, or t
  misc_feature (361)..(361): n is a, c, g, or t
  misc_feature (364)..(364): n is a, c, g, or t
  misc_feature (389)..(389): n is a, c, g, or t
  misc_feature (413)..(413): n is a, c, g, or t
  misc_feature (428)..(428): n is a, c, g, or t
ccttctgtcttggatggcagctcttctctatgggatgaaggaaccctcctcggcccagcactgaaggtcttctaccgtctggtctcagctcacctttgcatcggctcccaccgccagccaagctggatgccctcccaccccatgcctcaagcacaccctgnttctaggtcnttnctnacagggnccnttgctcagtgggagtttgctgagggcccactgtgtgcgggcgctttccggggtgctaggcacagagggagcagctggcaggacttacattcatagagcacactcgggtgnctcttgctgnggcctccctgnaacctccccttccttcccttcccctcaagggtggtcacctatnggnctccacgaaccaatgtcttccctgntcctgggtcaatggggaaggaccngaggatcttcccganggggacccgacaggcct

SEQ ID NO: 526382 - DNA, 131 bp, Homo sapiens
tcaagcttctaacgatgtacggggacatgcgaggtgcctttggaaagccccagggcactgtggccagggttcacattggccaagttatcatgggcttttttttgaataaaaaagcaggcaaatagaaaaaa

SEQ ID NO: 526383 - DNA, 120 bp, Homo sapiens
ctagaggatcccgcagaagacgacagaagggcactgtagagatagagccttcttggtgatgaaagacatagagtgttctctataatgcacctcctcaagggggctcagtgcagctcatgg

SEQ ID NO: 526384 - DNA, 413 bp, Homo sapiens
  misc_feature (41)..(41): n is a, c, g, or t
taatgtttgatatgaccaacattcttaggtcagcgcaccanaatgatggaaaccatgtggatcacacggcatatgtcccacaaaagaaagcacaatgtacaaaatgtgcatgtttcagtttcctctatccaaaaatagttaaaatccattccaggtaaccatgtcacattaagaaatagtcctagtaagaaattggcactcaaaggaaaaatgcaaaagtattttcacacatgaaaccacaagacagtggaattggaacctttcggataaaccactgtaacccagttacgctctgtgggggtgtgggggaagatatgggccctcaacatttctgcagataacttttttcccctaaattcatctaaatcacctatcattatcccacacaggcacttcaatctattaatctaaca

SEQ ID NO: 526385 - DNA, 909 bp, Homo sapiens
ccacgcgtcgggaggcgggggctgcagtgagccaagactgtgctgctgcactcctgcctgggcaacagagcaagactccatctcaaaaaaaaaaaaaaaaatcagtggttttggttccaaaactggttttggcaagtggtacttaataacgatgtaatttaattcaatattaccaaaatcaaacaattatgagtgtgaacgagagtaatctctatgaaaaaaaagtggaaaactggggaaagacctgataaaagacgtgttattaaagaaaaaaatgctgtggaataggtgtgggtaaagcaaccgtgaattgttggggagggagagaaagtgtcaaaatataggacttggccttcatttggtttcacaagtgtctggagtcctcattctactaaagctgaaatggataaggcttctggcggggctaatcaagggtcctcggtgcagccggatcagcaggcccacacgcaaagaaaggtcttatcctgacatcaaggagtgatgggtagataaccctgtgtatatttaacttacacattaacctttggaagatatatatactaacaaaaaaaataaaaaaaaaggaaaaaaaaagagaaaaagcaacaaacacgcagcagagtacgccagacacacgaaccacagaaacaaacaaaagaggacgagccccgctgcaaaataaatcactcacgggaggcacccatagtcaccacacatgattggaaagagagccaaccatgaaggtaataaaaaagcagcagggcatactaacaaagatgcaggacacaacaggtttctgggcacccccggtggggtcacagcacccacaagatgcggaaaaaaagtgcatggacaccccttggaaagcggtatataagcggcaaaaggaaggaggcaggacatggcgaa

SEQ ID NO: 526386 - DNA, 542 bp, Homo sapiens
tgtgttgggaactagcattctaccagtaactatgatattggtggagcaagggtgaagagaggaccaaagtggaggaacatgaaggaaaaacaatgagcaagttattagaagtaacccatgaagactccaaaaaagaattaggggtgactttacgggggagagaggtcctggagtcaagagcctgagggtgtgtgtgtataaatatgtgtctatttatatctatatcaatcgctatctatatctacatctatctttcttcaaaaataggacatttttacatctactattgtataatatttcttcccttaataatatatcttgaaaatcttgtcatatcaaatatagaaatattttatcattttaaatggctgcattatattccattgactgcatgaggattccattgtaatcattgtatgcatgtatgtgagtatcaaaatttatttaaccattatctaggttgttttcaagctattatcaatttcttattagcagttcattttattattaaaataataatgtatttttctcctttaaaaaac

SEQ ID NO: 526387 - DNA, 202 bp, Homo sapiens
ttgaatgcgtttcaacgcatcatgatcctctggttgccatcccaggatcggccccagactttcagccactaccgcggcaatcaattcactttgggtggggaaataacggtaagccgtagcccgtgacacctgcgcataagcagccagctcagtgatcgacggaaagcccccttcgtcatacaacgccatggcacgtcgacgc

SEQ ID NO: 526388 - DNA, 344 bp, Homo sapiens
ggggggggttccccccaccggggagggggtggttttttttccttgggcgcccccccccccccccccccagagggcccttttttggggggccccccccaaaaaaaaacccccgaggtaaaccccccccccttttttttttttgtgggggggggtttcccccccccggcccgggggccccttttcccctgggggggaatttttggcaacaaagttttttttgggggggtttccccccccggggggttttggggggaaaagcccccccccccccgggttttttgggggggttttggggggttttttttcttttccccgggggggggttttccccctttttgggggga

SEQ ID NO: 526389 - DNA, 871 bp, Homo sapiens
  misc_feature (82)..(82): n is a, c, g, or t
  misc_feature (88)..(88): n is a, c, g, or t
  misc_feature (92)..(92): n is a, c, g, or t
  misc_feature (106)..(106): n is a, c, g, or t
  misc_feature (110)..(111): n is a, c, g, or t
  misc_feature (115)..(115): n is a, c, g, or t
  misc_feature (122)..(123): n is a, c, g, or t
  misc_feature (134)..(134): n is a, c, g, or t
  misc_feature (146)..(146): n is a, c, g, or t
  misc_feature (164)..(165): n is a, c, g, or t
  misc_feature (173)..(173): n is a, c, g, or t
  misc_feature (182)..(183): n is a, c, g, or t
  misc_feature (192)..(192): n is a, c, g, or t
  misc_feature (199)..(199): n is a, c, g, or t
  misc_feature (202)..(202): n is a, c, g, or t
  misc_feature (208)..(208): n is a, c, g, or t
  misc_feature (210)..(211): n is a, c, g, or t
  misc_feature (214)..(214): n is a, c, g, or t
  misc_feature (219)..(219): n is a, c, g, or t
  misc_feature (221)..(222): n is a, c, g, or t
  misc_feature (227)..(227): n is a, c, g, or t
  misc_feature (233)..(234): n is a, c, g, or t
  misc_feature (241)..(241): n is a, c, g, or t
  misc_feature (243)..(243): n is a, c, g, or t
  misc_feature (256)..(257): n is a, c, g, or t
  misc_feature (268)..(268): n is a, c, g, or t
  misc_feature (271)..(271): n is a, c, g, or t
  misc_feature (276)..(276): n is a, c, g, or t
  misc_feature (288)..(288): n is a, c, g, or t
  misc_feature (300)..(300): n is a, c, g, or t
  misc_feature (307)..(307): n is a, c, g, or t
  misc_feature (310)..(310): n is a, c, g, or t
  misc_feature (316)..(316): n is a, c, g, or t
  misc_feature (321)..(322): n is a, c, g, or t
  misc_feature (335)..(336): n is a, c, g, or t
  misc_feature (353)..(353): n is a, c, g, or t
  misc_feature (357)..(358): n is a, c, g, or t
  misc_feature (372)..(372): n is a, c, g, or t
  misc_feature (377)..(377): n is a, c, g, or t
  misc_feature (380)..(380): n is a, c, g, or t
  misc_feature (390)..(391): n is a, c, g, or t
  misc_feature (393)..(393): n is a, c, g, or t
  misc_feature (403)..(403): n is a, c, g, or t
  misc_feature (418)..(418): n is a, c, g, or t
  misc_feature (420)..(420): n is a, c, g, or t
  misc_feature (424)..(424): n is a, c, g, or t
  misc_feature (437)..(437): n is a, c, g, or t
  misc_feature (445)..(445): n is a, c, g, or t
  misc_feature (461)..(461): n is a, c, g, or t
  misc_feature (478)..(478): n is a, c, g, or t
  misc_feature (494)..(494): n is a, c, g, or t
  misc_feature (504)..(504): n is a, c, g, or t
  misc_feature (506)..(506): n is a, c, g, or t
  misc_feature (508)..(509): n is a, c, g, or t
  misc_feature (803)..(803): n is a, c, g, or t
  misc_feature (809)..(809): n is a, c, g, or t
  misc_feature (857)..(857): n is a, c, g, or t
tcgcgggaggccatcatgaggaagccacgagcagccgtgggaagtggtcacaggaagcaggcagccagccaggaagggaggnagaagnatgntaagaacaacagtnaggnnaagncttctgnntgtgatgagangtagctgaagtnacagccttccgagggagnntgctaagntggtaggannaagagaaangggacgntancatggngnnganggggngnngatgngatggnngcgtggngngggggggatatgnngtgtgggtgtnagnggtcntgctgcaggagngcccaggttggnagtgtgntgnagctantatannggatggatgcagnngtgggcgtacacgtggngggnntggggagtgcttcnctggnggnggtgagtganntntggggtgggntggggtagtattctngnggcngggggctgcgggngggaggtnggaaggtggtagaggngctaggggggcacatgncaggtacaggagagancctggcgggngntnntggctggggtggggcgcgtgagagagctggggccatgtgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcanccaganagtggagcaggacagctcttagcctcagggagctgtggggagtctggngggggggggggggt

SEQ ID NO: 526390 - DNA, 245 bp, Homo sapiens
aaaagagaggcaactgagcaggaggcagacaaaaacaagaaaagcccagagatacacaggagaatagacatttcccccagtacatacagaaaacatggctaggctcatgatgaaatgacatgtccccggagaacctgagctacaaggctgaactgctagacttcgcatcagtaattccaacaaacctgcagtgcgttgggcacatgaaacattgacagcaaatgtgcttagatttaaacttactc

SEQ ID NO: 526391 - DNA, 125 bp, Homo sapiens
ggcacgggaagcccgcaggtgggaagcatgcaagttcaagtcctagtacagttgacgggacagtattttaaaaaaacgtactattctatatttttccccctccctttcccaaaaaagggaggcct

SEQ ID NO: 526392 - DNA, 329 bp, Homo sapiens
  misc_feature (329)..(329): n is a, c, g, or t
ataaaccactggagttttttaatcccttaagtcacatatccccagaaatgttttggttgtgaatcatttgcccagcgagcccaagggagaggcagggattcccctgaaatgtactcttacacttttttattttatttttaatgtacatttgtgtgcaccagaatggaatgtgctctttttaaagagctggacagtggttgcttcagacttctgaataccagaaagacttgccttttaatttttaaatattactttttacatcataaaatgtgttatcttatccatgtatttgaataacatcatatataaaggtagttttttgcttgctn

SEQ ID NO: 526393 - DNA, 165 bp, Homo sapiens
  misc_feature (126)..(126): n is a, c, g, or t
tatagatcgagctggtaccgaattcgacagtgtgcacgctccttgccacaaaacatcggcattctgaaagttctgcctgagtatagcacctttattccgtggaggtatagtgcattctaactaccnatgaatagtgtccactgtgatcatttccctctgcacgat

SEQ ID NO: 526394 - DNA, 252 bp, Homo sapiens
  misc_feature (75)..(75): n is a, c, g, or t
  misc_feature (139)..(139): n is a, c, g, or t
agcctggccaacatggtggaacctcatctctactaaaaatacaaaaactagccaggcgtgggggcgcgcacctgnaaccccagttacttgggaggttgaggcaggagaattgcggaacccgggaggtggtagccgcagngaggcgagatcacaacaccgtactccaacctgggcaacaagagcaaaactccgccttaaaaaacaaaacaaaacgaacaaaaacaaagaggaggaggcggcgtcaccagagcc

SEQ ID NO: 526395 - DNA, 208 bp, Homo sapiens
gggaggagggaggccggggacaaggcgcgggtggcagatcgccagtagtgtccgacgggggggcgcccggtcggcgagcggacgagaacgtgcgagtcggtcaagggagcggacggagatgccggggacagacggactaataggacatcacggcagctgtcgttgaatgacggagtgaccatgacttcaacgatgaatctggagagtg

SEQ ID NO: 526396 - DNA, 774 bp, Homo sapiens
aagagtggtatcaacgcagagtcgccattacgtgcctggggccaagattgtaccactgtattccagcccgggtgacagagcaagactgtgtctcaaaaaaacaaaaaaaatcctggttggcacaccgggggctcacacctgcaatcccagcacttgggacggctaaaggaggagcggagccatcaggaagctcggaaggttcgggagaatcggaagcctcgaagaccagccgtgaccacttagtgacgtgaaaaccaccgatctcatactaaacactaccataacatagcgtggtcattggatggaaagtgcacagggtaactccacagatacatgtggaaggattgaaagagggaaacatggacttgaaacacggtgaagggtatgaagtgttgcaaggtgagcgaagagatttgcgcaattaggcattagcccccagcccagggtgtaacagagagcaacacagtcccatcctataacagaaaacggccaacaaaaagggcacctggagccagacggacaacatccctggcgacatacagcgagcgacgcagtaccccgttggaacaccccggaagggcggacccaatggcccaagcacgaaagccacgcgacacagccgtagagcgacccaacgagcaacaaaaccaacacgggaatgggcgaccaacacacgggacacacaacaacaaggatgaatcggcccaccaaagcccccagataccaggtagagagacacaatggacccaacaaaacgagcctacacaaagcggc

SEQ ID NO: 526397 - DNA, 574 bp, Homo sapiens
  misc_feature (22)..(22): n is a, c, g, or t
  misc_feature (37)..(38): n is a, c, g, or t
  misc_feature (40)..(40): n is a, c, g, or t
  misc_feature (48)..(48): n is a, c, g, or t
  misc_feature (50)..(50): n is a, c, g, or t
  misc_feature (78)..(78): n is a, c, g, or t
  misc_feature (80)..(80): n is a, c, g, or t
  misc_feature (234)..(234): n is a, c, g, or t
  misc_feature (241)..(241): n is a, c, g, or t
actagctgaacgaggatgagcnggtcaggcgaggctnntngccatggntnttatgagatggcccttgggatagtcagnanagggagcaaagtaaaagatctgaaatatgtcggaggcacttgctgatggataccatatcaggcgggatgaagaaaaagagcaatcaaggctcaatttctagcatccaaatttgaacaaatgcatgagtggtggtagtgtcaagtacaatggggngaatganagacaagtaggtttggtaagtggataaacaaattggtcagtctataggggggcatcatatcaggtttgtgatatcaggtgttaggagtacatatatcaaaaagataattataacagtctggcctttaggagaggggcagaggttagagatcaacgtctgcatggcattggtgcacagttcctatttaaataaggcacagggcagggtaagataacctaggaagaatgttcgataaagatccaggatcgagctgtgagaggtctctaatattaccagtcatcagagtagggtgccagaaatgaaagaggagcacaccatgaagtaaggaaagca

SEQ ID NO: 526398 - DNA, 123 bp, Homo sapiens
cccagaaggatggacttgcctgatgatcgtgattatcgtgaggagaaatgagctctgggaatgagagatgtacttgggggttatggacctctcaaaaaaaaaaatataataataaataaaaaa

SEQ ID NO: 526399 - DNA, 344 bp, Homo sapiens
  misc_feature (344)..(344): n is a, c, g, or t
tgtggtgactcatgtctgtattcccagtactttgcgaggtcaaggcgcagggatcatgaggttaggcgattgggatcatcctgtgtaacacagcgtaatcacatctctactaacattacagaagtagctgcgcttggtcggcgagcgcctgcagtcccagctagctcaggacgctgctgcaggagaatcgatgcacccggctggcatagcttgctgtgagccacgatcgcgctacgacactccagcctgggcaacacagcgagactccatattcacaagactccgacccaagcatgcggccgtatattcgagctcacttggccttcgtcctatggcgagttcgn

SEQ ID NO: 526400 - DNA, 836 bp, Homo sapiens
  misc_feature (411)..(411): n is a, c, g, or t
ggggcagagcttgcagtgagtcgagattgtgccactgcactccagcctggctgacagagcgaggctccatctcaggaaaaaaaaaaaaaagggacggaatagaattattaccctcagaccaaggagggcttgatgatgaacatttggggtaaaacggagggataacaggagaattatacctaaaaggctcccaaagagtcactacgagggttacttccaaagggaccccaaatttagattggcgcatttatattattcacacgcaagaaacttacagagggtcagaaattgcttctacgcagtgtctccagattattctccaggtgggacaagggattttccagtcttataacttttatttgcgcaaggccaaatttatcactcacagagtggggacgtctaagggtaaantaacattatttttaaggaacatttgcaaggagaagactttaaacaaccctggaagtcccccattgaagctggtttgttccaataacatcacctggttgaagattgtccccttaaaaaaggcaggtggacgaccaaatcgtggggttacgggaaacaatgtgctcataacaggtagcaagaagactactcgggagaagcccagtgtattgaccggttggttgttagccagtctaggggacattttcttaagaagtgtgggaaacagaaaaggtgttccggggaattgtttagaccaccaagaagaaaaaccgggtattctgatggcaatttggaaggctttgtggacaaatttttcccgattggtgacacaagatttggggagcacatgttgtgagggggaaacaggagtcttagaagggttcaga

SEQ ID NO: 526401 - DNA, 809 bp, Homo sapiens
taggtacgaggctgggtgtttaatcggccgagggcgacccgacctctttctaacctacccccggagccatggcctctgctggggtggcagcctgggccgacatgtgctggagtgatgtatttgcctgccaacgtccgaccagccgctgcctgacaccaagcctgctgcctgcctcctcatgcctgccgccggtccctgcgcctcaacctgcagcagtctgcctggcgccacggactcagtcacctgccctgcgctgagggaggaagagaactactcctttttacctttggttcacaacatcatcaaatgcatggacaatggacagccctggaggtccaccagtgacctgaactgccctcaaaagcaagttccagtgatgatgctgcaatgctcatcatgcaccatgccctggcatccacctgagcccctgaacatgcagcagcagcagctgcagagcctccgggagcaagtcaggaccaatgaatgagcttctgcaaaagtacaagagcctctgcatgttcgaaatccccaaggagtagagtgatggcttgacttccttagaacagatgtggggaagccaatggcctgtctccccactaccatccccaaactgctcctttggggctgttggttccctgtggacccccagctcagctctgtcaagctgcatgggtgcgggtggctcctgttgcttgtgcgcgctgcatcgcctgttgctggagccagcgcaaaggcttggtgcgccgggggttcctcgtgtcactccatatgttagaatgctataactggagtgctgtggggaagtcgag

SEQ ID NO: 526402 - DNA, 179 bp, Homo sapiens
gtacatattttggaattccatctatttccctttcactctagcagtattacatgctacattaccatttaaacagatgtctaataaatgcatattggaacctattgcactaacagcattaaacatgctcttcatccacatcactaacatacaaattaaaagctactccaagtaaaatgaag

SEQ ID NO: 526403 - DNA, 1492 bp, Homo sapiens
gggtgcctcgtgctcccgttttgtcgtgtcgttctgtgtttctatcacctgcagtgcgagtcgtgatgatgggtgcgcgtggggtagctgtgcgtcgctgaaggggtggtctagatgggttggtttgtggtaacaccatcaactgtctcatggtttgggttcttctgtcttatgttcttcggtgatcccgtcgatgagacgcccctcgtgttttttgatgatggtctctcactgagtcgtatgttctgaggagtgtgggcttgttcgtgatatgttgtgttgtgtttgcatgagaatatgtcatctctttttgctggggtggtgatcaggggtgtgtggtgattaggggggcgtaagaggattgtttgctcgctctggttgttaatgttttcctttgggtgtttggtggatcctcgcctgtgtggtggtcgctcttgcttgtggttggtttggcatcaatgcactgcccgcgcgggagtaggggccggcgccgcctgtgtgtgtcccccctaggttgtctctctgctttgcgtgttgtctgtactggcgctctcgttgtgtgtggttgatgtggtgtggtgtatagagatgttggtttgttgtcgctttggagtgtggatgtggcggtgatagaaatgttgtagtggggttgggagaagtgggaggtgttgtcgtttattgttttgttgttttttgtaggcaaggggatgggtttggtgcagagagctagtttttttgtgttgagttggggtagttgtgtttagtgtttttttttgtgtgatacgacgttacaaagtagagatagataagttatggtgagggggggctgcggcgcacgccgctggttgtgtgtatattgtttgtgttgtgtgtttgtgttgctcttttttgtgtgtttttatatatgttgttgctgtgttttattttctatatatgtaggtggggcacaagacagagggcgaattgctgtaggcccacagtatgcagaagactttgtatagggcacgagcccctctttaaggtgaatctcgaagagttagtgggtgtataaaggaggctgtacaagaggtgttggagtgggccccacggcgcggggagatacacacgaatgtgggaggaggctctcaagtatgggccaccgttctagagagagcttgcgtgcattgcgcaaggtatgcgccgcgcgcctgggcggcaaatgtaagcgccttctgttgtgttcgcggggtataccggtcctatttggtttctggagaagtatgcgcccccgtaaggtgcccctgcgttgtgggtccacacaccccgttcgttgtgtttcgcatccacaggcgtgcccaagcttttacggccagctgcaagaggccacaggttttgactgggcacagtggggtcacatgcggtgcaatcatcccacctgtctgtgttggctggtccacagcggaggccatcagtctcctcaataagtgatcattttgctgatgatggagtgcca

SEQ ID NO: 526404 - DNA, 343 bp, Homo sapiens
  misc_feature (159)..(159): n is a, c, g, or t
tcttcagttctatcaagagggttcaggaaccggtgtgggggaccatcgcatgatacttgggtgcggggtagggctgtgctggaccccttggctggctcctcaaaaactggtagaacgcagatccatttcctctggagggtggagttctatggtgactanggctcatttcttaccctatgattaggctgttacttcccctggtgaaactttcatcctgtaggttcagcacaaggttgtcagctgtgagatagatccgattctgtgatgtggcgatcgtcttggagatattctgggctgctcgaatcttgcgacgtttgatgtagccggggttcttgctcagtgc

SEQ ID NO: 526405 - DNA, 694 bp, Homo sapiens
  misc_feature (9)..(9): n is a, c, g, or t
  misc_feature (17)..(18): n is a, c, g, or t
  misc_feature (23)..(23): n is a, c, g, or t
  misc_feature (33)..(33): n is a, c, g, or t
agcctttgnggaaaatnngtctntgttgttgtngttataatataataattttttattttttattaaaattgtttttttataacaaaataaaactggggattatattaaggggggggccaaggggcaaacacccaaaggccccaccttattttgcctcttaaaggttttgccccactgtggggaacaaccccgcgccgcttcgttaaaacaccttaagagggagaattaaaaacataagagagttattggggtcccacccccaaaccaattaatttaaaaattttcgggaggggccccaaagtttaagttctttaaaaaggccccccagggaaaactaaccccccgccagagtaaaaaactgttgtctttttgcccagaaatatggagaagaaaaaaaaatgttaaaaaggttaatgctcacccccccaataaagtttgaacctttctgccccaaaaggcgggaaagggtcctttttttggcccattcttaaattttcgttgtcccaaccgggaggaaaaaaaccagcccaaactttttgactggaaaaaacaaaaaaaaaaatttctccaaccaaattaaaaatcttgtttaatgagaaaatccaggggcaggggaaagaaaattccctgtaaagagcccaaaaccccctggggccttttctttctttgttctttttttctaccatagtcaaca

SEQ ID NO: 526406 - DNA, 439 bp, Homo sapiens
  misc_feature (80)..(80): n is a, c, g, or t
gatccatgggtgggtgattaggaagtgaatgtgtggggcttaatcccattccctggccgagcccagaccctgatctgacncaggatatgggatggcaaaaggccgatttgtcagactgtcccgtggtttcacggaggtaaatctaccgatttctccaaagtgccggggtagagaatgatgaaaggggagagcaaaagggaggtttttccccaagggctggccagattccaaagccacagaatatccgcttaccctgcagggtaagggtaaggaatgtgtccttttcttggttacatctcttactccaccacagttaccgtgggttcaatttgctgctctttagttgactcgaatagtaaaactgtcctgaattaatttcattctgtgattctcaagtaaattagttatttccttgcaattaaaagaatcttttcatctc

SEQ ID NO: 526407 - DNA, 608 bp, Homo sapiens
  misc_feature (41)..(41): n is a, c, g, or t
  misc_feature (105)..(105): n is a, c, g, or t
  misc_feature (189)..(190): n is a, c, g, or t
  misc_feature (206)..(206): n is a, c, g, or t
  misc_feature (208)..(208): n is a, c, g, or t
  misc_feature (212)..(212): n is a, c, g, or t
  misc_feature (220)..(220): n is a, c, g, or t
  misc_feature (229)..(229): n is a, c, g, or t
  misc_feature (231)..(231): n is a, c, g, or t
  misc_feature (298)..(298): n is a, c, g, or t
  misc_feature (310)..(311): n is a, c, g, or t
  misc_feature (323)..(323): n is a, c, g, or t
  misc_feature (330)..(330): n is a, c, g, or t
  misc_feature (332)..(332): n is a, c, g, or t
  misc_feature (334)..(335): n is a, c, g, or t
  misc_feature (338)..(339): n is a, c, g, or t
  misc_feature (345)..(345): n is a, c, g, or t
  misc_feature (349)..(349): n is a, c, g, or t
  misc_feature (367)..(367): n is a, c, g, or t
  misc_feature (370)..(370): n is a, c, g, or t
  misc_feature (376)..(376): n is a, c, g, or t
  misc_feature (383)..(383): n is a, c, g, or t
  misc_feature (389)..(389): n is a, c, g, or t
  misc_feature (392)..(393): n is a, c, g, or t
  misc_feature (396)..(399): n is a, c, g, or t
  misc_feature (421)..(421): n is a, c, g, or t
  misc_feature (424)..(424): n is a, c, g, or t
  misc_feature (431)..(431): n is a, c, g, or t
  misc_feature (435)..(438): n is a, c, g, or t
  misc_feature (446)..(446): n is a, c, g, or t
  misc_feature (461)..(461): n is a, c, g, or t
  misc_feature (474)..(474): n is a, c, g, or t
  misc_feature (476)..(476): n is a, c, g, or t
  misc_feature (503)..(503): n is a, c, g, or t
  misc_feature (512)..(512): n is a, c, g, or t
  misc_feature (524)..(524): n is a, c, g, or t
  misc_feature (527)..(527): n is a, c, g, or t
  misc_feature (543)..(543): n is a, c, g, or t
  misc_feature (548)..(548): n is a, c, g, or t
  misc_feature (606)..(606): n is a, c, g, or t
gacacagggcaaccacacaggaaaaggataccaggacagantccatggagttttgcttataccacaaaaggagttaaggcagtttaattcaaggatgcgaaaacnacgtctatgacataaacatgacattcaaaaataactcagcctttaaaatgtccccaataccaacaaatcaacaaagtagtcaanncgacagcccctgtcangncccnctgccccntcccaaccncnctcccccatgacaccgctataacaggtgctatgcagagccctccctatgcagttaacacagattgangggtgctatttnngggccaccagtntcgcatncncnnccnncccctncctntcttcccctgtcctcggnggnccattnccttttntgtgtntgnnttnnnngcctctttttctcgttccacanacnggggttncggnnnncccaaggntggccagggccaccntgagataggtttntnttttttttggttggcccctctttggcnctgtgttgnggcctaatattntgntggggtgggttccgtnctttnttttgtggttgttacctggttttgggttttgagctcggtcggtttttccctgtgatcnag

SEQ ID NO: 526408 - DNA, 108 bp, Homo sapiens
agaactactgggccgaagaaccagaagagagggaaacctagtgagcaggacactaagagaagacatggaagacaaaagatcagggttgaaggtcccagcaatgtcagg

SEQ ID NO: 526409 - DNA, 776 bp, Homo sapiens
agcgggtgatgtgggtggctggaagagcggagagccagcgaccgccgatctgttagctcgtgcgacccagcggcgggggtcctccactgttcatttctctacaactgaaggaaaatactgtgtgttgagcacctgtgtagtgcgcgaattaaaggcctcatccttctggaacctaaattttaatgaagccatgtgggcaatcaaatgtgtgtgtgagcagcagcagcagagcagcacgcaatgtgcacctggagtccatggtgcacatgtgcagacagcagataccactgcaaggtggcaatctattcgacccaacaccacggaaccaggacaacttgcacagaattttggactcagttcttactagctcgacatttgctgcagagagacacagaacaaacagagacaacacaagcataacaaaagaagaccaacaaacgcagagcgagagagagacagaaaaaagtgtgcatgcgccaaagcgcggggaaagaacacaccgcaaccagaggggagaaagggcgagagacaacaaaacacgacccaacgcaacaagggtaggcgcgacagaagagagaacaaggaggcggaggagagagagcgaactacagaaacgccacaagcgccggccgtacgacacaccgcgacatactccccgaacggccgagaacaacgaggcgggggacacgacgggagatgtaggcggagcacctacgcgcgcgagcagtaaaccacaaccacgaaatcgggcgcgaccagcaggacagacgtcggca

SEQ ID NO: 526410 - DNA, 191 bp, Homo sapiens
  misc_feature (73)..(73): n is a, c, g, or t
  misc_feature (122)..(122): n is a, c, g, or t
  misc_feature (164)..(164): n is a, c, g, or t
gcaggtggaggggagatctgtttgctcacattcatggtaatggactttttccaaagggttataagtatctgtnaagcccatctgggtgtttcctgctggtgcatcctttagattctgtatgnttatatgtctatggcacccaaacatcatgagcctaaacagtnatatttggatgttgactttaatgctct

SEQ ID NO: 526411 - DNA, 425 bp, Homo sapiens
  misc_feature (23)..(23): n is a, c, g, or t
  misc_feature (29)..(29): n is a, c, g, or t
  misc_feature (157)..(157): n is a, c, g, or t
  misc_feature (175)..(175): n is a, c, g, or t
acctcagatgggttgccaaaatnccccantgaccattccctccaccagaaatagaaaaccaccaatgcctaaaaattggtatgggaacccaaaaaaggaccctaaatagcccaaatcaatagtaagcaaaaagaacaaagctggaggcatctacctnccctggcttcaaaatatncccacagacctatagtaagcaaaacaacatggcattggtataaaaacagacacatagagaagtggaacagaatagagaattcagaaaaaaatccacatatttacagtcaactgattttcaacaaaggcatcaaaaacatatattggggaaaggaaaccctgttcaataagtggtgctgggaaaactggatattcatgtgcagaagaatgaaactgtctgaatgaatagacccctgtctctcactatataa

SEQ ID NO: 526412 - DNA, 240 bp, Homo sapiens
  misc_feature (2)..(2): n is a, c, g, or t
  misc_feature (13)..(13): n is a, c, g, or t
  misc_feature (26)..(26): n is a, c, g, or t
  misc_feature (194)..(194): n is a, c, g, or t
  misc_feature (199)..(199): n is a, c, g, or t
  misc_feature (233)..(233): n is a, c, g, or t
tnatggttacacntcctacatccaangccatagccctacagcatggttcattctcctcctcaccccagtgcgacctcctatagtcaacagcttatacttcctggaattcaggtaacttgaaagctcagacagaatcctccactcagtcctcagtctctatagatagtgagttaagtgcttcagattagatgagnttcanttggttccattataagctaatgatgtactgatgncagttct

SEQ ID NO: 526413 - DNA, 181 bp, Homo sapiens
gcgtgcgcatgcagttgattgctgctactcgtgccactggaagatgcacaacagcagcatgagaaaatgtcaccttggtctggtgatgggcagtcaaaagattctgggcgcttcctcaagtgagaaagaagctcaagtgtacagttgaaggttgtgaggggacatttgtatggccagcgag

SEQ ID NO: 526414 - DNA, 893 bp, Homo sapiens
ggagatgatggcaatctttatataaatgtgaagctgaaggctcgtgaaggagatgggatcgaagccactcacattaggttaccacagaacaaacacagaatctgaggtgatgaagtacattacatctttgaagtgaagactctacggtacagtgggttctctagtagcgaggctgacgcgtttagattcgagagaattccattagatagctgaagaagtgatcaaggctatagcacccgagaaggatgtggatggataagagtagcatcaaatgcgggtgagactggctacgaggtgacctcagaggacgtgtgttcattccgttgtgagcgcctaagggatgcttggaactcatcaaagagacaggggtgccgaattgcccggaaggcagtgctgtggatggtggaggactgcagtcaagaaataggttgggggaccccgaatgcagtgacttgtcgtgtacggtaggaacgaaggccacacgggaccacccgtgcgcgacgtccaaggactgcgcacactctcgcgactgaggacggtgaaactacagagggtgacatcctgaggaggccggccctgggtcagactgtagagagggtgtaccagggggcagtagggcgcgaagccccggaggggcatgaggtaggatcggaccgtggggaactgcatctactagtgtgccagaatggatatagcaggaggcacaaggggcagagaactgtcaagtggggtgccggtggggaggacatacagagagtctaccgaggaggggcgaaactacggcatgcacgaataccgggcaggggatggcccccgaaacgtcgagaaagatgcagaatcgaggtagagcaaaagggcgcgcggaccctgaaggacgttgaacccgcgtgaag

SEQ ID NO: 526415 - DNA, 714 bp, Homo sapiens
caggatcttgtcgctcggacgagatttttgatctcgctcgcaagctatcgccaaaaaccgcctactcgccggcgagccgagctggaaagccgtgtgcagcttagcgatcaggtccaccagatcatcagtcatgcactcgcagaacgaaaactggaacctgctccgcccaccaaggcagaggccactggaaacatccgcgagaaccgcgcagaagaacgtctccgtgagcgtgaaaatgctgttgttcctgaaggcgttagggcggagccagcttcacttcaatctgaattgacaccgaaagcgcatgattcatatgccggcgagcgcactgcgcaggttatcgatttgctcaaaagaattcggccaggacaggcaaaatgaaaggtgcacagacgtttgccaattacgtcagacaggacattagtgagtatgcgggtaacccgcttatcgaagctttgcctccgatattgtcggaggcggcggctgttgagctgatctcgaattttcctcagccggtggatccgaaagagctgacgctcgaaggagccactcgaattcactgtatcgaccggctaagaaccgtggtacagccgtttttgctacatctggaactggaggccctgttctcactgctcattcgtcgagggtatgtagggcgtacccgatgtcgccgctaccgtcggcattgcattcttatctggggccagggtaccc

SEQ ID NO: 526416 - DNA, 1561 bp, Homo sapiens
  misc_feature (224)..(224): n is a, c, g, or t
  misc_feature (312)..(312): n is a, c, g, or t
  misc_feature (472)..(472): n is a, c, g, or t
  misc_feature (527)..(527): n is a, c, g, or t
gaggctgagcggatggtgtgagaaaggtcgattttcgcggagctctcacaggtggctagagatgctcagtgagtcccaatagaatcgctcaatggagactagaacggcatgtgattgtatgtctgctcacgatctcatctcgctggtgcgatcacggctccatgcttgcggaatccttctattgacgtaagcagcaatcgcgaaagaagatatggtactaatanacaaggcggcaaacgttgaatcgcgtccttttatgactacgaataaaattcgtgccaatgaaggggagcgcctggagggcacgccaanggtttcattgtcgtagcgcctcgactacaggtgaccatgtatggtccgacgagtggaagaacgcttagactagaatgatccagaggattcctattgctgtagagcgtgattgcatagacacggacttgcgtgacttgtgtacgtacgtttccgtcgagtngcgaccgtatcgcgaagggccagctacgcatatagtgtgtgtgcgcatatccagntactctgcgcatgcattcaaatcagccctcgtactcggaggcgtccgtccatatagctgcgctagacactatgcgattgccctctgtggagctcctgtcgaatgccctggtgagttgtcgacccaacacaagccagtacggctccgaggagagacactggaagtcgattgttaagctccgttctaggcataggactggtggttgctactttgaggcaaatctcatgacttgcttggccagcgctatcgggtgggatcattggaagtacattcccctaatagggtaccacaggcaatgtcgaatccctaattatcccaggggttcgccaaaagtagccgtccggggaagagtttagatgtcgcaggcaggaatgtggggtgcggatagctggtgttccgaacgcattaccccaactgtaaaagacgactcccagtgctggaatggcctcaagtctgtggccttggagaggattcttgattcgaagcattctaaggaaagaattttccgaaaacacggccttcgcaacgaaagaggaatgagagaataatacaccgaggctggttgaccccacggggacggaactaatacattacggtctgggattggttgggatcgaagggccagaaggtaacattccgggtttaaagacgtcgtaacaggagtgggagaaacagttgtggaggatattggggaacagagtaacgcaggggatttggcgcgtggcacccaaccgtcgttgggacatttgcggagacaaggcccgcaaaggtgcaccagttaggaaaatgcgccctgtgcagatgaacacaaccagttaatctagcgagaccagaaacacaagcagaccaaggccagagaaaaacgtaggagcgagcataacaccaacacaaagggctgtgacacaaaagagagagacgcacgtgagtccaacacaagtgttacagagggacaagaaagtaactactacatgtgagcaacacaccagcggttgccgcaagaaagaagaacgcaggagcacccagcagaaacaagac

SEQ ID NO: 526417 - DNA, 257 bp, Homo sapiens
atcatgcagagaaccccgtagacgtattcgggtctgtgccagccttgaagtcaagtggagcaactctatagctcactggcaacctccacctcccaggctcaagagacttgtgtgcctcaacccctcgagtagcttggattacagacatgcagcaccacgggcagctagtatctgtatgtgtagtagagacagggtattgccatgttggccaggctggtcttgaactccttgccttcaagtgatccgtccgcctatgg

SEQ ID NO: 526418 - DNA, 223 bp, Homo sapiens
atggctgctgactgcttagggtggtggttgctgaaggttgggtgacagtggtaatttcagtgatttttgtattgttttgtttcttaaagagacagggtctcattctgtcactcagggtggagtgcagtggtacgatcatagttcactgcagccttgacttcccgggctcaagcaatccttctgcctcagtctttccagtagctaggaatatcaagaatcggca

SEQ ID NO: 526419 - DNA, 820 bp, Homo sapiens
  misc_feature (9)..(9): n is a, c, g, or t
  misc_feature (117)..(117): n is a, c, g, or t
  misc_feature (277)..(277): n is a, c, g, or t
  misc_feature (299)..(299): n is a, c, g, or t
  misc_feature (328)..(328): n is a, c, g, or t
  misc_feature (335)..(335): n is a, c, g, or t
  misc_feature (337)..(340): n is a, c, g, or t
  misc_feature (343)..(343): n is a, c, g, or t
  misc_feature (355)..(355): n is a, c, g, or t
  misc_feature (357)..(357): n is a, c, g, or t
  misc_feature (420)..(420): n is a, c, g, or t
  misc_feature (563)..(563): n is a, c, g, or t
  misc_feature (799)..(799): n is a, c, g, or t
tccccacantacaaaatacacaccccaatggctcacaccagcaaatgaaagtgaaagagaaacaggtccacccctccctctgaagggcccaccaggtctgggcaagggtgggagggnccgtgggctgggtctctaaagagaagaaaaggagaggggagcaagtgagtggaagaggctggaaagtcatcgcagggccccaccctcctcttccctctgtgccctactgcctctgctggcagacaggggcaggggtcccttcgtccccataacaccaganacacaggcagggctgcagccantaacggtcaggcctttggacacaaaatantttcgcntnnnntcncccttacgtgtnanccaccagggaggatctttgctgagggcaaagtccaggatctcagccgtgtggccccggtagtnagtaagcaggcggccggtccgggcgtcccagaggcgcacgatgccatccaggctgcaggtatataccacggcagtgcctgcctcccacagcagctgcacgatgcccgactggtgctgacactgatgcctaagagtctgcgtancaggtcatagatggccaaggtcccatccaggtagccaacagctgccaggggcatcacactgcagaagcccaaggactccaccgagttggactcactctcctccccttctcccaggctgggctgggaggcacagtctcaggtctaaaaacacccaccaccttgccggtggtggcactgaccagcttggcctggcagtccacagagccagtaaggatcaagctgccatcctggttggnagccacacaggtgagtgggcc

SEQ ID NO: 526420 - DNA, 271 bp, Homo sapiens
tatcaagggggtcttttatcatagtacagcttcctttcaggttgatattcttccattagtatttctttaagagagagagctcctggaaatgaagcctcttggttttccatcacttgataacatctctctttagcgtactctcgcaacggctcttatttctggatacaaaattctgggtggatagtttaaatgatcttccagctttctaaaaggtaggttcccctgtcatcgtcatgggccaccatgtttttgtatgataaatggactgtca

SEQ ID NO: 526421 - DNA, 264 bp, Homo sapiens
catgcatgagcgaacccagtcaagatcagcctaagcttgtagcatagcagaaaaactctagtgggcaaagcatagacctgtaataaatcatcacatagttgttttaagtctccaaatttaggggccccttgctatctagtaacagacacctgattaaaccacacagtttaaaatgcaatgtcctacaaaaatctggttccattgttttacccatgcttcttgattacatccccaagaggactcccacatcctgtcatagtttca

SEQ ID NO: 526422 - DNA, 603 bp, Homo sapiens
taatttttaaacaatgttttatttttcttttttccctttttaaaacccccacccaaaccgaggaaaatttaattgggggggggccccaacctagggcccggactcgtgaaatctcataatctccccactttcccctcattttgggtgacttaggtgttgggggctgtggttctcacaccaaaacgtgggtgctcctcctattgtggactcggtgcagaagggggcacctaggcacacacttttgtggtggccccccccagtgaagggggtttaattgtggcagaggcgtggaaagaaacaaaagagtctctctccccaaaataaagaaggccactttttacacctctcacaaagagggggggtgtgggagttatggctcgtgcgtggcgaacatgttgtgcttgctgtgggggttgcggcgcgagcgacggttatatttctcacactgtggaggagaggtttattttgcgcacagattgtgcaccgacgaaagaaatcttcggggggaaagttcctcgccttcccgccgggccacctcttgcgggggcctccggtggggggcagtgcctgatctgctttgggcctcgcagaaggggggacgcg

SEQ ID NO: 526423 - DNA, 262 bp, Homo sapiens
ctttttttggttgcccaggatggagtgcagcagtgctatctcagctcactgcagccttcaccttctgggctcaagtgatcctcctaccccagccttgcacctcagccttccaaatagctgcaagtacaggcacacgccaccacacccagctaatttcgtttatattttgtagagacagggtctcactatgttgcccaagctgtctcaaattccagggcccaagcaatcctcccgcctccacctcccagagtgctagtcgaca

SEQ ID NO: 526424 - DNA, 936 bp, Homo sapiens
  misc_feature (346)..(346): n is a, c, g, or t
agcggagggtgcggcgggagcgccgcacctacaccgagccaacccgaggattcccgaggtccagacagctgcccggccctaagatccccatcgacctgacgccaggagcaatgccgagagtccagcgcgtgtcctggctgacactccggagcatcccgcagcagtacatctgttccttctgacccgagctcgacaggcagacccatttccagtggacaccctgtccccgtgggggcagcgacgtagtctaccttgtcggccatggagaccccagatccatgcagggcgcgccaaaccgacagcgggagagcgaggccacggctccaactaccacgcttgtctgacncaccccgacatcaacccggctgacatggatgaagaggacggaccccttgcagagagactacaagtggattcagacattgaggcaggatactacagatcagaaactcggtagtagacagtctgcaactggagaaaaaagcgggataaaaccgccacgaggtgtgacggcccttcaggccattctatcccgtaggattcttgagatgcacgggtggattcagaaccgccgcgtaagggtgtttccggggcattacaagcgctccgggacatagcggagggggcacagaagacttcgcgtggggacttgaccccgacggaacgtaccccttatgtaattttcagaataacggacaattggaagacacgcgccttccgacacgttgcaaggcttgtgaaggcttgaagacaagagggtgtccggttgatgggaaggtattaaaagtgatgcgtggaacagtggctgcagcaaattgcccacacgaaagtgacggggattgatcgcgtagaattatgtcttgccttcaatgggcgttccgaggtctttgaacacggactcctgggacagggcctacctggcttgaaaacatttct

SEQ ID NO: 526425 - DNA, 1086 bp, Homo sapiens
ctgtctcaaaaaaaaaacaaaaaacaaaaaaccccaaacaccaaaaaaacccgaaaaccaaaacaagaaaacaaaaagcaaaccagaaaaaaaaaaacccagtgaaaacgtgaagttccctttaagaatctccgatttaattttattcagaaaaggaaagttaagcactccctaagaaacttctacttataattcaagtgtctagaagctagtgtcagtggtgcatggtggccacacatagggtgcaagggtgggcgtggaaaatttttatatatttgtgaatagatgtgtgatgtgagccagtgtgtagaagcattcttccatacgtgataagtgatggaggacattatgcacaagagagaggtgaataggtgaaagagagagagacagggactagctaaaggataaagaaacacatggggagcggaaataagtgaaacaggcagtaacatttgggataatttatcaggagagaaattttcaacaggaatcacatgggactggtgcagaagggaatttagaactacaacataaaaaatagtcttggactgagactagaaagtatcagttaatcttcctttttaactaatgttttaaaaattactaaaatcagatggaaatcgggttataatagaattggattatgtagctgcaattatggtcgggatctacacggacctctttatgccaagtatgttcgtatgatagataggtaacggtctatcaaacaatttaacacatggtatctacattggctctggcggaaaacacagcacatttcacaggatggttaagaaagactcataagggtgcttccaagatattctgccattagaatgacgggtcctcaaatgagaatcattacgaaaggcttgggaggcattgagaaaaacacacatatacattgtgggcatgaaaacttaacaaggggccctccacacttaacattcttctcccgcggtagacaaacacaggtataagcacgtcacatcatacttacagaagtagcatacacatagatcgacaaaatatctgtcagttacacataagagagccaccaccgactttatagaaaacacctactgt

SEQ ID NO: 526426 - DNA, 111 bp, Homo sapiens
ggcgccgcctactactactaaattcgcggccgcgtcgacaatgtttttcaccatctgttttgatgattatatgatttttcctctgcagtctgttaaagtgacaaatcatac

SEQ ID NO: 526427 - DNA, 753 bp, Homo sapiens
tcaaggtataactgcaaattaggaaaccagagagggagccccaggctgggacaaattcatggctaccccttccccaacagaacagggggaggaggtggccccttacacccttttagtggctcgatttcgggccccctgttgctcactcgtgctgcagcactcctaggggcagggccccacctttcccgtgggaacgtggggtagtcggtcacccagccgtgccagtgccccagaccccttcttcccccaacaaagaagttattctgtggagggaagggggcaatcggctgggccagaaaccaggaaggccaagtgagcgattgacacatttgtgggcgcctggtagccagacaagaccatgtgcacgggattgttcggaaacaaaatgtgagaacactctgtgccaccacaacaacaccaaaccacaacagcgtgctcgccagaacgcgactaggctagcgctcgaaccacgactggacaaccatgtggcacccccagaaacccatatggggggagagcaacggagacgcgatcaagagagatgaggaggagaatggggaacacgccgaaggacaaaggtgtgtgaacgctctcccatatcgtatacatagtggataagcacccccactctatgatcagaaacggggcgaaaatctcggcgcatgacagttgcgcagcacaaacacacatctaaagggaataacggaggcagagaaacagaccacaagcaccaaccactacagggagacacgc

SEQ ID NO: 526428 - DNA, 178 bp, Homo sapiens
gtatactatctcccgacggtatcctatctccctactgtatcctatctccctactgtatcctatctccctactgtatcctatctccctacgtatcctatctccctacgtatcctatctccctactgtatcctattggtgcgggggctttgtatgattatgggcgttgattagtagtagt

SEQ ID NO: 526429 - DNA, 909 bp, Homo sapiens
  misc_feature (454)..(454): n is a, c, g, or t
gccgcgccgggtttcaatcaaggtgggcatatccgcccctgggacgtccccttctcgcgctggcttcacttggttggctgctggagcccccgccttttggttccccccctaatgggggcggaaaactcttccactgtctgtccagtttggaatacagttcatgcgttgcaaagcatcgccgcgcaaacaaagccaggtctctatctatgtcaccacagaacagcgcgtgtcagtgggtggtcgtgcgtaacacatcgtcttcaccccacaaagttgttcgtctgataattcaatctctgtagttagttctattcaagtgaggaacgcgtttcctctcctctagtgagcaatattttcttgatgtcgccgcacgaacctccacaggtttcaatacagatagatgtgtgtgtcccacacatacagatcgtggcgacacagatatattctgtgtcancgtgaacgaatgagagagaagtatccggtgaattcctccttgtgtgagcccaccgacccgccaccccaactagggggtccacagctacatctttcctctgcaccacccacgtttataggagtacagtgcgaggatatcatatatacctgtctatacatccatactttctggagaaacatatcataagtgctcgcccactgcggctgttttgataagatcggcgaggatctgtccgtctagtgtgggaagactgggcgggaatactactgccgccgccgttgttgacgactacatacaaagactatgctacgtccatccttagctggggggatctttgtcgaaaaatagctcagaaccctgcgtgcttttgtttttacgccgaaaagcgggcgcccaagcaagcatttcgtttccccacagaggtcaaaaaaaagccccttccccccaaacaagac

SEQ ID NO: 526430 - DNA, 1471 bp, Homo sapiens
  misc_feature (1448)..(1448): n is a, c, g, or t
ggatcagatatgagcgtgattccaatcatcatgacgagatgaggacccgcacacgaatcatagcagatagagacgagtagcgtagtggaccacgtacacaggagaggacctgcgacccccagtggtatcccgaggatagtacgtcccacgtgtctatggcttcgtgtaagaattgcatcaggagtccgatggcatactgcccgtgctcagagccgaggcgtacgtcacatggtatcatggttgtgtacgttgacaaatcacccctgagtgcttgggtggcagcctgtcggtccccaaagggccttggagtgcgagtctccggcgcttgaggcctggagtgtcgtagaaggtctatgatactcgcagtcaacttagggccaatcaacggatgccacccctgtttccctgctgatggaactcgaacaaggtgaccactcaccatccagagggtcgtgcccgttgtcgagtctttgtgggaggccccccagtcctttataacgcgtattcgtcgtagcaaggtttccccgttggaaggagtcactgtaacggttttcaccgagaaaggaagtctctgtctggtggaagcgttgtggtacttacgccaattgatataatgcggggggtttcaatacacttccgtgtttgcccacctcgtaaaggaaagccggtttgtacagagggaggcacttggacttagacatttggtcgccaatgatgcctagtacccaggagggggcactagtgtgcgaaatacgaagtgttcacagatcctcgagcgtgggaccatttgagatgtgcggggataatgcccgaaaacatataatagtgaaaaacagcctgtctaaagatcgtgggtcccataggtgggcggcagtagtcgcactccatacggcggccattaagaagacagaggggagcattgagctacggaacgactgagttttttgtgcccccccattgggggctacacttgtttgcgccggcattattcgaccgcggagtggtgcactattcctagcggatattggacgtgccatgtacgtggcacagttgggacaatacgccctcgggtgtgtacgcacacttgcaacgcggccccctaaggagaggaaatcagtccacaaaacgggtaatgaagcgttcggttcccacgttatatcacggcccgccatttaaacggccatttgcgcggcctctcattgtgttgccacacaccatataggcaatgacggcttgccgtctatcccattacgtactaacagattgggagaatatgaccagagaaggaacgacgcggcaaaaggggaacgctctgtgcaatttccagagaattaccacgcggtgcaactgcacaggtcacggccgccagagtgagagtgacattaaggtatccacgtcccccgcatctatgcgcgcgtaagggaaaaagtctatgttgtgtagcaagncgatgaaactcgtaaacaggaat

SEQ ID NO: 526431 - DNA, 1553 bp, Homo sapiens
tggctcaataaagatttattacattaaaaattccatggccaaacccgtgaggcactcagggcttctgaccggtgtgcagccagtgaccttctgtgaacccagaaacacatgtggaagcagcagcagctgagttggccaactcaagttctgggccgtgccgtggcttggcgtggcgaacctcctgtgcacaccctttcaagggcccgtggtacaaatgtgtcttctgtggtcttataggctgtgacgcagctgtgcgtgccctttctgtggtggccattcacaggggcctccttgttaacacagattgagtggcctcctgtgcaggggaggtgtgcccccagtgtgcccagacacgagggcccgaggcacagcaggtggggtgcagcgggaaagcgttcgtgcgtggagtgacccacgccatagaggccaactcagagggagccagcgggggccgtggggctccgtgggctccctacacattccgtctttcgcggaattcttgtgccccttttcttgtggagcggggacaccccagagggacgcagatagggccgccactgttgtgttgacagagcctcctgtgagaacgcgggcgagagcgggatgtgcggggcgcaaagaagacgcttgcttgtgaggggccaaccacggcttgccacgagaagtgtgcaagctattcgtgggcgccccgagaacgagccagacagtgactatcaagggcactacaggcagtgacatgtgaggatcatagacagcacttccggggacgggagaccatccgggcccttggccagggggggtggcccatgtgagggcccgattgggggggcccgggggaattgccacctttgtgggccaagcggggcacttcacgcctttacccccaaccactttgttgcgcatctcgtggggggccttacgacgggggtacacagatttgcccgcgctatacattaggggacccggaggtcaacgagaacctgatgtccaacatcttgccggggtgctcctttgtgttgtccccccttttcatgggatgaagaagggcgtctcgcgctttggtaaagcacagcttggcatgatagtataaccgggaccggtcctaaaggggtatatcccgtcgagagggggcgcacagagtctatacgagcgggtaacaccaagcgtttttgtggtcaccaacggtgggtccccatacgagcgagggccggcatttatcaaagccaaagcgacaagtggacacgccagaatacacacaaagcagcgtgaaggggggcaaaacgcgctcccggcggacctgtgtgagcgagaccccaaccttggggggggggaccacggggcaccacaccacgagaatcaggcgactggcgtaagcaatgacagcagatgatgatgcgacagctgatgtattgtgacgtagctagcgatgacacagtacgacagtcaaggagctagaccacccggacactaacagcacgacaactcatctcgctagacgctatatagactagcctcgcctgccatgcatctatccactccacaacaaatgcgtt

SEQ ID NO: 526432 - DNA, 152 bp, Homo sapiens
gaaggacaacagaatatacaggaagcagatggtgagctacatctccacaactacaactgtcatcagagaaagctcgacaatacgaggtggggcccattgaacacaatcgaacagttgagggtcacagctgtgatagagcaaagagatactgg

SEQ ID NO: 526433 - DNA, 194 bp, Homo sapiens
gaccaaatgtacttactgacacaagaggaaaatatatgtgaaatactagctcaggatgcagtagactatctacccccgcgaaaaaggaggtgacagcttacttcatgtgtgcccccctattaagagctgtttcagctttgttaaatacttgtgaatgaattaataacccgcaaaaaatatttcactggggtaat

SEQ ID NO: 526434 - DNA, 416 bp, Homo sapiens
ccggagcatggcaactggagcgcaccttcatctgccatcaagccggacgaggtgcagtgcgaacttggtgaggcgagatcatcaagcgcttcgagcagaaagggattccgcctcgtggcaatgaagttcctccgggcctctgaagaacacctgaagcagcactacattgacctgaaagaccgaccattcttccctgggctggtgaagtaccatgaactcaatgggcaacctggagctgcaacttgggaaggccatcacccttattgtatcgttgcaggaaaagatctaagtcagcggataacatgaagttaagctaagccaagaagatcacttttacggactgagatggattgtttgacaagtaggaaaagcatgaatgacagctggagtacaagagaagagaaactacgcggtgg

SEQ ID NO: 526435 - DNA, 83 bp, Homo sapiens
ggccaagaaactttcagaagcatagttgggacggcaaaccctgctgtgagcttctcagacttttcacctaccttcacctatta

SEQ ID NO: 526436 - DNA, 592 bp, Homo sapiens
ggcctccagacgtagccattttctgacatcaagatgttgaatgtgatctggtctgagctgggcctgtgtgaggggtcgcctgaggcctgtgcgctgttgtcctcgcagatgtacttatttttgttcatgatacgggcgctccgttccttaaagatgtatatatcttcttactgtacataaagatgctccttaagtcgcacagaaggtggcgcggcaaagggcctcgcgcagagtgttcagattgcccttgcagatcttctgtgtcttcagcgcccagccctgcgtgatcctggtgaagcagtttcacatcagtctctgcagatagcactacgatgtattccgcttatgaacaggatcccatgccagtgtggaacacctttccaatcttaagttagaagaggcttgtatgacacagataggggtcacatgagggctcgtcagctttctgggtcctgtttagaaggcacaaagatcttagttctggtcccccgcccagggtccttaacaacttggcacacaagcttgttgctgtagaggctggctctgtgtgtggcttaagctctggagacgagacattgcgtgcttgctcttc

SEQ ID NO: 526437 - DNA, 209 bp, Homo sapiens
gggaagtgacatcgtctttaaaccctgcgtggcaatccctgacgcaccgccgtgatgcccagggaagacaagggcgaccttggaaggtccaactaactttccttaaggttcatccacctattgggatgataatccggaaatgtttcattggtgggggcaaaaaatgtggcctccaagaggatcagaagacccgcatgtccttcggggaa

SEQ ID NO: 526438 - DNA, 247 bp, Homo sapiens
  misc_feature (42)..(42): n is a, c, g, or t
  misc_feature (97)..(97): n is a, c, g, or t
  misc_feature (120)..(120): n is a, c, g, or t
  misc_feature (130)..(130): n is a, c, g, or t
  misc_feature (134)..(134): n is a, c, g, or t
  misc_feature (147)..(147): n is a, c, g, or t
ctttggttcttttggaggtgcttttctctttagatagcacanatggttcagctactggttggagggtacctgggcacccttccttccttggtaaggnaaggtggggctcatcctacaggntttcacaagncggntggggcaaactgnatcccagggccaaagggtcccatccctgcagcgagcacttactcctgccatgcgtaccagccaggggcccccactgcatctcacttcccttcctgcactt

SEQ ID NO: 526439 - DNA, 165 bp, Homo sapiens
  misc_feature (149)..(149): n is a, c, g, or t
ctacatacagaagcgatgaacagaagactcataaccagtactggaacagggccaacttgagcccaggggaatcttctgtgtagaatcgccacatccccccgggtgcctgccgagagttgtgcggccggcacaagtggtcgcagattcgngggatcctctaggagt

SEQ ID NO: 526440 - DNA, 410 bp, Homo sapiens
  misc_feature (10)..(10): n is a, c, g, or t
  misc_feature (26)..(26): n is a, c, g, or t
  misc_feature (49)..(49): n is a, c, g, or t
  misc_feature (95)..(95): n is a, c, g, or t
  misc_feature (109)..(109): n is a, c, g, or t
  misc_feature (190)..(190): n is a, c, g, or t
  misc_feature (332)..(332): n is a, c, g, or t
  misc_feature (341)..(341): n is a, c, g, or t
  misc_feature (383)..(383): n is a, c, g, or t
  misc_feature (389)..(390): n is a, c, g, or t
agttttttgnaaattttttgggaaanaagtttttgtttgtttgtttttnaaaacggaagtctttgtttgtcgcccctgggtaaaagtgcaagtgncgtgatctcggctnactgccacctctgcctccctgggttcaggtgattctcctgccgcagcctcctgagtagctgggactacatgcacgtgcatncagacctggccaacatggtaaaacctcgcgtctgctaaaagtacaaaaattagctgggcatggtggtgcgcgcctgtaatcctactcgggaggttgacacaggagaatcgcttgaaccgcatcccccatcccctctgggagncggaggttnagtgtgctgagatcgagccactgaagtccgcttctgccacanggtgtnnctctgctcaaaaaacaaacc

SEQ ID NO: 526441 - DNA, 983 bp, Homo sapiens
  misc_feature (983)..(983): n is a, c, g, or t
gtttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctggatggagggagccccccacatatgaaaactcatccccctggtgagactgcgcgcacctcccataatgtgcgcgcgagggtggtgtgggactgcggctcgaggcgcttggattaagaagacaggattagagtgggtaacaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggacagcgggtgatgtggctgcatttgactcggttgtgcctggtaaccagcatatgttactaatgcagggcgagtccggtacgactggggtaccgcgcgctggatgagccttcggagtctggagggcggttccggaagccctgtgtggtgggaccctgtggcctagacttgctcgcctcgggcacagatgtggtttcgcaaccccggccggaaggggcgcggggttgcccccccctctctgttttgtcccggggggtttgccctctctggcgccan

SEQ ID NO: 526442 - DNA, 1187 bp, Homo sapiens
  misc_feature (1187)..(1187): n is a, c, g, or t
gtttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactactgaaatgatctattttcgtgggtgaggggctgaagggcctatgatgcacggcagcgcggggcaaaggcatctcacgacgataacgtggtttgaaacggcgggcacctggtgcggggacgctcttgcgcgcaggcagtcttctccccagccttagcctggctcccatgactcccttctgcgtctgtaggcacacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctggatggagggagccccccacatatgaaaactcatccccctggtgagactgcgcgcacctcccataatgtgcgcgcgagggtggtgtgggactgcggctcgaggcgcttggattaagaagacaggattagagtgggtaacaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggacagcgggtgatgtggctgcatttgactcggttgtgcctggtaaccagcatatgttactaatgcagggcgagtccggtacgactggggtaccgcgcgctggatgagccttcggagtctggagggcggttccggaagccctgtgtggtgggaccctgtggcctagacttgctcgcctcgggcacagatgtggtttcgcaaccccggccggaaggggcgcggggttgcccccccctctctgttttgtcccggggggtttgccctctctggcgccan

SEQ ID NO: 526443 - DNA, 236 bp, Homo sapiens
ccggtatcaagatcccaaaacgatctaaatatattcttcagacagggcgtggcagctgtaatacagactttggaggggaggagggcggatcacttgagcttaggagtatgcagagacaaactgtacagagatatgtctaaacccatatctatcacaaaaaaaaaaaaggaaattttttacttccctctctcaggcttaaaattaaggggggggggggcaaatgtgggataattccc

SEQ ID NO: 526444 - DNA, 434 bp, Homo sapiens
ggtgttatcttgacgctgccatgtaaccacaggcgaggcacttttcttcttgctttcggaagttgaacttggtggttctttcagaccccttatggctctgagattctaagattcacccaggcgtggtaatcccagctacttgggagactgaggtgggaggatcacttgaacctaggagtttgagaccagtctgggcaacatagtgagaccctgtctctaaaagaagaattttaaaaagcagggtgtggtagtgcatgcctgtagtcccagctacttgggaagctgaggcaggaggattgattgagccccagggctttgaggctgtagtcagctatgattgtaccattgcactccagcctgagcaatgaaacaacaccctgtctcaaaaaaaacaaaaacaaaacaacccaacaaacaaaaactccaaaaaaacg

SEQ ID NO: 526445 - DNA, 873 bp, Homo sapiens
gtgttttgtttaaatatgggaattaaaggatgatttaagaacaaagttactggtttaacgaacgctacataaaactctgggaaacgatatcagttagccaatgataatatttacggtctacttcttgtgtactgagtacatatcggtcaaatgtaccaagaaaacaagataccaaacatggaaaccccgaaagctatcacttaggaattagcaatatcacccaactggctttgaaaattgaaaatttaaataacatggtggcatgaagtacaagttgcgagtattaggcaatattgcatagtgttcctcatgctactttctgttacacctcgtatgatattagttttgaagtataagacatctgttttcgagaccaaataatacaactcttagttgtatgagagctctatcttatccatgtttatgttttccaatgcttttctgtaatacattatgtaattttcaaaatagtccttgtttaaacagcaatcagtaatgcactactaaaatatagtatgtgattaaccaatcctgcttccatatttaagcactgggaaatggaaacttaatctctgtgactacaaagggaagattctattgtgcctatggtagttccagtcactgacttgtggtctcttagaatcttctgtggctgacttcttgtattcaactctggtttaatatccttaatcttcgaacttcagacatacatttgtgtgtttatatgctcacaggtggattgagaaatcagttacatcttaagtgacctacagggtatatgttggcaaaagcagactgtgtatatgtcttataaagtagaatttatgttcagtgtgtttggaagtgtatagcatgtaaattatttcatactac

SEQ ID NO: 526446 - DNA, 358 bp, Homo sapiens
gcgtggtccttgcagatagaacattacataaatggtaccaacatgctattatcacaatgtggtacggaccacccagaatagctttagaagcaggtcaagtacattcccaataaggtgagaatcctttggaatctctatcttctctctaatttcgggtagccagttcctttaattcctcaatttctttcttgtattcaggagacgatccttcaagctccttcaactggtcgtttagtacaggcattctgttctcaatgacttccatagatttggtgaactgtgccactggcccatcatactgagagttgtacccataaaccaagcccaactggtagtgggtctctgcaaggaacccacg

SEQ ID NO: 526447 - DNA, 338 bp, Homo sapiens
  misc_feature (10)..(10): n is a, c, g, or t
  misc_feature (65)..(65): n is a, c, g, or t
  misc_feature (93)..(93): n is a, c, g, or t
  misc_feature (132)..(132): n is a, c, g, or t
  misc_feature (258)..(258): n is a, c, g, or t
  misc_feature (286)..(286): n is a, c, g, or t
gagacggagntcgctctgtcgcccaggctggagtgcagtggcgcgatctcggctcactgcaagcnccgcctcccgggttcacgccattctccngcctcagcctcccgagtagctgggactacaggcgcccgntaccacgcccggctaattttttgtatttttaatagagacggggtttcaccgtgttagccaggatggtctcgatctcctgacctcgtgatccgcccgcctcggcctcccaaagtgctgggattacangcgtgagcacccgcgcccggcttttttnagtctttaaagactactgttagataagtaatagtcaaatcttcactctgctt

SEQ ID NO: 526448 - DNA, 267 bp, Homo sapiens
ggggggggaaacccggggggggttaaattatttttcaaaaaaaaaacccaaaaaaaaaaaaccccccccctttgggggccccccccccccaaaaacgggtggggccaaagccgggggccccccccctaccaaaagcccccttaaagccccctcaaaccgggggggcgggggaaaaagccaccccccaccccgggggccccccgggggaaaacgggccccctaaaaacacaaaaccctctggggactttccccctccccccccggccc

SEQ ID NO: 526449 - DNA, 784 bp, Homo sapiens
taagtgggctggtaagcttgactttattaaagttaagcgaggtcagaaatatctggaagtcaacggggtgggcagaggccagtcccttcgtggaggctccaggagatgtcctactgggtgcctggcccagcttctccaggctggcctggtgtcggggcagggccgcgtcttcaaaggctgggctgggctctggccctgtgcttggaaagccctgtgatgacatgggggctgtatctgggacgaattctaggatcacctctccagtcttgaaattttttgtcttctttgtggaagagacgggatgtctccgtttcttggtcccctcagggtcttggggatgttgctgtcgcagtgggtcgcagatctttccgctcacttggcaaggcttggtcgcctcccgggggtgtttcacccccaattcttccttggcgcttaagcctcccctaagtacgcttgggggccggacgtgtgtggccccaagcaaccaaagcccccggggaaatgacgggagagctaaacgaaaagacgtgttggggttttcacccaattgtttcgccaatgagtggtccctggaactgtcttttgaccgctcgggtgtactctgggaccgccgtgtgtggctcaccagagtgtgtgctgggggttaccggggcgggtgtaggccacacaatgccaacccagttttttttaaaatggcgaagtgacctcctttggttgggtggggggccccttttcggggggtccggatacaggggatggccggcacgcaatttccgcgcctttg

SEQ ID NO: 526450 - DNA, 438 bp, Homo sapiens
  misc_feature (398)..(398): n is a, c, g, or t
  misc_feature (438)..(438): n is a, c, g, or t
ctactgcacaagacggcaccgatcgcgaacaaggaagctgctgccactcctaaagctgaagccaaagcgatggctctaaaggccaatagggcaacgctgaacggtgtgcaccggcactatgggatgaatatccgcacgtagcgcacctttcggtgcccgaagacactgcgactcctgagacagcccaaatatccttggactgaacgctatcagtgagaaacaagctacgaccactatgctctaataaagttctcggtgaccactgtgtatgtcatgaagaacatagaagacaacaacacacttgtgttcattgtggatgttaaagccaacaagcaccatattcaggctgtgaagaagcatgatgacattgatgaggctcagtggcatcctgattaggnctgatggagagacgatggcatgtgtgcgactggatactgn

SEQ ID NO: 526451 - DNA, 1228 bp, Homo sapiens
gggtgggcgggagagggaggggagggagggtagggggagaagggagggggagaggggggagggggggggtagtgggggatggggggtgggtgtgtgggggcaggagtgggggagggggtgggggagggggagggtgggggagggggggggttaaagtagctgtggggtggggggggggaggagggggggggggggagggcggggtggagaggtggtggtggatagagataggtggggggagtgtgatattagtgggggtgtggggaggagggggggggtggttgtgtataagtgtagatggggggtaagaggggggggttatatgtggggggctagtgtttttgtgagagatatgtgtgtagggaaaaggggttgtggagggtggagtaagggggtgtggggttgtatctggggggagagttgttgttgggggaagatagttttggttgccgcacaaagggggtgttcgctgcgggggaatacaaggggttagctatcggtggagagtggtggttttagtggggtccaataaagagatgggtatttctttgtttgttagaaagttctctcgggggcgtctttctccgcccgcggagtggttcccacggcagccactcctcccgcccgcggttttttgtttgtcgcacacgccgcggagggttctgtaaagtgtccccaccggggtggtcccgcggcgggggggcgcctctctctgtgaggggataaagagaagcctcctttgtgaatagcgacggagagggggggcgcatagcccccacacagagggggaggggacacacagatattgggcgcctctcggggagagaccccacgcggggcgcctctttgtgagaaagaagacacaccactttttatagaaaaagagtattttggtgggggacatatattttggaggaataaaggttttaagagaggagttttcttctgggggtggacacacagaggagggagatatattatgagagagagcgccagagaagatgggtggtgcacaccggtgggctgacgggcctctcccggccgccgtgggcgccccctttatttttttctcgcctgttgtggggcctggggccgaggtaatattttctctctccaccccccccctttttttctctccccccccccgctgtggtgggggcccccccatgtgagaaaatgtggcccaagttttttcaataaaacaccttgtgtggtgttgtggggccca

SEQ ID NO: 526452 - DNA, 141 bp, Homo sapiens
gaccccaaacccctgtggggcccgggttaccgtgctcctgcctgtgattccagcacttccggagctgaggcctgagaatcagttgaggccaggagtttgagaccaccttgggcaacatagtgagatcccagctctacaaaa

SEQ ID NO: 526453 - DNA, 161 bp, Homo sapiens
tgagtgtggcaggttcgccactgtgtgaggtttcctgatctggcgggtcctcatacagggctgggccatctactgctgcctctttgtcattttgctttgcggccggcttactcttcttgacctctgactctgacctgagctcatcctcggcttacgccacc

SEQ ID NO: 526454 - DNA, 527 bp, Homo sapiens
ggctatcacattatcgcatccactactgttatttgttcaagcagctgctccctcccccacttgatggtggctccaggcaggcagtgtcaaatctcaatgactcctgtgcttcctgcccacagctggagcagtaacactcaggcaaaggaaaggcctgccatccccacaggccatggaatatatcagcttttcccctgaccccaggtggggagactacttttccgaagtctaggaatgtggcagatcacccagcactctcttctttcttagaagcctaaactaatgtggctaacaaggctatacaatctgaagtggtcaaatcttacatgcttatgtaggaagacggaaagagcatgcataaccaagaagaaacacccgagagtagcacagatttacaaaaacagtgtcagggagactaatgctacatgagtggaggcttccccaaaatggtcaagacaactaaaaagggatttcaaaagttatatttggtgtgtgaataagaacaaggaagggctaggatggctctt

SEQ ID NO: 526455 - DNA, 164 bp, Homo sapiens
agagagtagtatttaaatgggtaaggaagtagagagggggccaggtgtggtggctcacacctgtaatcccagcactttgggaggccgagacaggaagagtgcttcagcccaggagttcaggaccagcccaggcaacatagggaaaccctacgcacagataaaat

SEQ ID NO: 526456 - DNA, 148 bp, Homo sapiens
cccccccgggggggggggtttttccggcccaacccctgttttttttttccccaaggggtttggggcaggagccggggcccttaccccccgtttttgttgttttcccttttgacccggcttttgggtttaaaaaccccctttttttgta

SEQ ID NO: 526457 - DNA, 877 bp, Homo sapiens
ctcagactgctgcagccctaaccttcccatgtgctcagctctttggagctgcccattcctccggctgcgagaaatggacgcgcgccctgcgtcatgggctgaagaaaagaagcaaaacttgtcgggagggtttcgtcatcatcctccttccctgcaaacctaaacctcctgcctgtgggccatccctagactagaggaaagttcctgcatgagccgaccagccctagtggatctggggcaggcatgcggcgctggctgtggaattagatctgtttttgaacccagtggagcgcatctgctgggtgctctggaagtcacctgtccgctgggcaccgggttggcgctgcccgagtggaacctgacagtttgcgagcctcggctgcaagtggcctctcctccccgcggaagtagttacagtgtcggagtgagggctgcgagtgtaggcaagttgcaaagagagcctcagaggtccgaagagcgctgcgctcctactcgcgattcgcttcttcctctaactcggatacccgtactgatgaaatcgcagacgacactacacaaaggccatccgggtcctaaccgagaccgatccgcagacgtaaggcccaggtacgcgcctatagcatcgggagcccccgagcagcggcgaaggactggcgggtggggaagggaaggatgacaggcgggcaatgcgcgaccgtaccccgaaagggccgaacctgcgacgcctgcaccgacctatgcaaccacggccaactgacttccacgggaccgagcaacaagatcgccagacagggaaacccgaaagaccaaagtcctatgaagaggcagcaatggaggttacctcagggcctaccgtcacacaagacgaagaagggag

SEQ ID NO: 526458 - DNA, 287 bp, Homo sapiens
gtttgaaacttatccatctgttgttaaatattgtaaatatttgtatatggccctattcagacctgtgctttataaatcacaaaagagctgggttttatatagtctagtctattttatttctaacgctctctgcgtaaaaagttacaaattgtctccttcaagatattttttctattgtaattttttgtatatcactgttgtgacatatccataaactatgtgacagttagctcttgactaatacttgtctatatccactttcaggtttgctatatacaaagctacca

SEQ ID NO: 526459 - DNA, 114 bp, Homo sapiens
aggtgatggttgatatatgacatgcatgacggtggcccttggatgttttaatccgctaaggagtgttgttacaactcacctgggctgaatcaactagccattgagtaaattgca

SEQ ID NO: 526460 - DNA, 266 bp, Homo sapiens
  misc_feature (41)..(41): n is a, c, g, or t
  misc_feature (103)..(103): n is a, c, g, or t
  misc_feature (132)..(132): n is a, c, g, or t
  misc_feature (194)..(194): n is a, c, g, or t
  misc_feature (228)..(228): n is a, c, g, or t
  misc_feature (245)..(245): n is a, c, g, or t
  misc_feature (254)..(254): n is a, c, g, or t
  misc_feature (263)..(263): n is a, c, g, or t
gcacttgatccctggagtcccaggttcatgttggggtagancctggctaaccgtgggacgaagggcggaaggacttggtggtcagcggatattagagtcaggnggtatcatgtcatctgtgatggagaagtnagatatcctcctcatataaaccaggctgccgtgttaagacataatccgagatgcaaagtagnccattttgttgtgtcctcagaaggctcatgattncagcaaggagggtaacntggagaacnggtggttcngat

SEQ ID NO: 526461 - DNA, 648 bp, Homo sapiens
tgaggttgctggtggacctgctctggtggtcttggatgaggccccatgatgcgcggctgcccctgtgtgggctacagcagcagcggttccgaggatgagtcctgaggacgggatgcggaccaggccgggggatggtgagcctaccgttcgtggtccagagcccccttcctcaggcagagatttccaggtacctgacagtgtgtctgaagcatgttcccggtgcaccgatggagggtgccttgaagatgacagcacaaaacacgtggggcacgggatgcgcagccttcccccacgagcgaggcaactgtggccacccacgtctatgtaccatgtgagtgatgtgtgaaagattgaagccaaggaggagttcctggatcttgcttgatgtgttgctgccccatgcccagacatatgtcccccggctggtacgggatgaagggggtccacgctcaggctgtcccagaggtgtggttcttgcggccagccactggatcctccccttcgtgcaggctctgagaagcccgtatgacctcctttccacaggtgccagaagcccatgccagaagcccaagccaaagtggcttaaacaacagagaaatttataggcgggttaactaaaagattcagaggtagcactggctcatgcat

SEQ ID NO: 526462 - DNA, 680 bp, Homo sapiens
atttcctcctcaggaatgggggttggactgtccagggaagggccagaggggtgaccccttccctcaagcctcacaagttttgtgatgcagggcagcagaccaaggcagaaagtgagcagccacgaaggcaaaagcaatgggagtggccaacagtatgttggcatgtacctttaagggtcagccaaccctgtgcccagccagacatttattaggttaggcacctcaccagagtccagccccattcattgatttagcaacagcaacagatccccctccagcagaaacaggtggtgatccagcagcagattgccatcccccccagcagcagttccagccccggcagtcccaggtcctttacacaggtacacccctccagttggggcagcagcagcagcagcaacaacagcaacagcagcaacagcagcagccgcaagcccccaccctcattgcccctcagcccccacatgtcccccctaataggaagggtccccccttcccagtcccagcagcaagcccaaaccctggttgttcagcccatgcttcagttccatttttggtttgtcctaaagctttataaaaccaaagggggtgggggtgaggtcaggagtataaggacccgccttaggccctattccttatataacaaaaaaattaaaaatttttttccccagtaaaaggga

SEQ ID NO: 526463 - DNA, 619 bp, Homo sapiens
  misc_feature (346)..(346): n is a, c, g, or t
taaaaacaaaatatttttatttagaaatttttacagctcattttatctcattacacttctccttattgaattagttaaataccttcttaatttagcagtgtcatattccaaaaggtgcgtgggtacaactctaggtggtgcctctttatagacacgaggccacgagattgttattctaactatacactctcaaactataatgtgttagtttaaagtttaggtggtgcctcaaacaaaaacaaactctctaggtggtgcctatttcgagaggagtgctctacgagaatttatagccaaacattctctataacgcgtgggatctcaagagaggagtgtgaaatgtccnccgcgggtgaaattgggagggcccaagctgtggtaagaatattttcgcaaagtgcccttcttacaaagagggctgtggagagggtatagtgtctcctttatagcgggcatgtgttcaatggggcgaggggcccactctctcaaaacagggggagacctcggagcgcttttgtggaaaagggttgaaaacactctattggggataagacatttgggaagaggggggatctgagcattcttttggggcccagaagtatccctccaattttccaca

SEQ ID NO: 526464 - DNA, 302 bp, Homo sapiens
tatgcgctacgggctcaggcgagggacctacagctcctggtgtctgccgcaccaccaggaagtgccagcgatgcagggcgtctggccttcagtgtcgtctcctccacggtgacccagctgagctgggtgagccggctgagaccaacggtgagatcacagcctacgaggtctgctatggcctggtcaacgatgacaaccgacctattggcccatgaagaaagtgctggttgacaaccctaagaaccggatgctgcttattgagaaccttcgggagtcccagccctaccgcaactggtacggcg

SEQ ID NO: 526465 - DNA, 437 bp, Homo sapiens
acaccgcaacacacggcgagctgctgctgctgctgttgtctgctgctgctgctgctgctgttgttgctgttggctcttgccgcggcgccaataactccgtctcacctggctcttagttttctcattcttcttagtccggtagtagtagaggacgcactcagccactgtcttcctctccaggaatgatgcgatcaggccatagttcttggtgatgctgcatgaacttctcccggaaggtctccttctcctgctcactccacatgttcacgacctggtggtcgttgtacaccttcatggggtcggccataagcccgttcatgttgatgaacttgatgcgctgctggtcagcgtcgtacagcatgggcgtgatcacgggcagctggcgcatctgcttctccaggttctcctgctctgagaggccatcgatgatctctgag

SEQ ID NO: 526466 - DNA, 474 bp, Homo sapiens
  misc_feature (29)..(29): n is a, c, g, or t
  misc_feature (53)..(53): n is a, c, g, or t
  misc_feature (58)..(58): n is a, c, g, or t
  misc_feature (62)..(62): n is a, c, g, or t
  misc_feature (75)..(75): n is a, c, g, or t
  misc_feature (303)..(303): n is a, c, g, or t
  misc_feature (324)..(324): n is a, c, g, or t
  misc_feature (351)..(351): n is a, c, g, or t
  misc_feature (361)..(361): n is a, c, g, or t
  misc_feature (379)..(379): n is a, c, g, or t
  misc_feature (384)..(384): n is a, c, g, or t
  misc_feature (430)..(430): n is a, c, g, or t
  misc_feature (445)..(445): n is a, c, g, or t
cacactgactgctttgaccacctcagtgnctcaagtaacaatttgtgtccctncgggncagncaacatcatcagncaacctgcttcaaggaggactgccaccagtaagtatcgatgacctcttctccgggaagtctgtacctcatcggcattgctgtccatcgtggttcgtctgtgtatcatgtatcttcgtagatgtatcctgagtcatggtgctgtgctgtggcatccggtaacagctccgtgtactgaggccccgcagctctggccacagggacctctgcagtgccccctaagtgacccngacacttccgagggggccatnaccgtctgtgtatataacgtttccggnattactctgntacacgtagcctttttanttttngggtttgtttttgttctgaacttttcttgttaccttttcagggttnacgtacatttaggtngcgtgtatgagtgagacgggctgggtttt

SEQ ID NO: 526467 - DNA, 325 bp, Homo sapiens
  misc_feature (13)..(13): n is a, c, g, or t
  misc_feature (15)..(15): n is a, c, g, or t
  misc_feature (39)..(39): n is a, c, g, or t
  misc_feature (73)..(73): n is a, c, g, or t
  misc_feature (75)..(75): n is a, c, g, or t
  misc_feature (102)..(102): n is a, c, g, or t
  misc_feature (107)..(107): n is a, c, g, or t
  misc_feature (111)..(112): n is a, c, g, or t
  misc_feature (127)..(127): n is a, c, g, or t
  misc_feature (135)..(137): n is a, c, g, or t
  misc_feature (173)..(173): n is a, c, g, or t
  misc_feature (187)..(187): n is a, c, g, or t
  misc_feature (191)..(191): n is a, c, g, or t
  misc_feature (195)..(195): n is a, c, g, or t
  misc_feature (209)..(209): n is a, c, g, or t
  misc_feature (229)..(229): n is a, c, g, or t
  misc_feature (257)..(257): n is a, c, g, or t
  misc_feature (261)..(261): n is a, c, g, or t
  misc_feature (277)..(277): n is a, c, g, or t
  misc_feature (280)..(280): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (313)..(313): n is a, c, g, or t
  misc_feature (320)..(320): n is a, c, g, or t
attcggcagagtntnagttcttatggcttcacttaaagnctgtctcaaaaatactttgctctcttcttctttntngttcatgggacatggtacctaagcaantaggngttnnggtttggtttttctnctaaaaannngctcaatacttacccaatcaaatggcatccatttgntaaaatgacaatanctanagcnagttaatgtcagtnacattaaactaactccaggnttcaggagttttaatgttagaatttagntttnacagatagagtgtggnttnatttgtccatggtagcccattctntnctnaganctcttcnagtct

SEQ ID NO: 526468 - DNA, 205 bp, Homo sapiens
ggacaacagagcaaagaccccaatctctacaaaaaatttaaaaaatagtcaaagcaatggtggtgttgtcccttgtagtcccaagctacttggggaaggcttgagatgggaaggatcactttgagcccaaggagttttgaggctccaggtgacgtgtgatcaatgccactgcactccacctggcaacagagcaagaccctgtctc

SEQ ID NO: 526469 - DNA, 158 bp, Homo sapiens
gacccatttaatattggccacaagctcagctagactctggttccctcgggctgttcacatcctactggacttctggtcccagatctcatctcagtcactgtggttggtcagaagacagtgaatcccaaacttgattagttgtgacgtccatctgtctt

SEQ ID NO: 526470 - DNA, 371 bp, Homo sapiens
cctcctgggaagggggccgctgctgtttggtgccctgtgaactgtgattgattgcctttggtcagtaatgggttcaggagtcccccccaggcccaaatggggccttgaaacgctttgtcatgctttttcaggcccatggatttgaaatgaactcatccttgctgtgagcatccaggggcccttgagaagtttatttatgattatgaaactggcaaggtccccccagaattagggtcagccttattccccttcccctcccagtgaacggtaaaaagtttcagccaagcagagggctttatttttagaagaaatatgttaccctcagaaatgatgaaacccaattttatattaaaaggcaaagatggcggaga

SEQ ID NO: 526471 - DNA, 228 bp, Homo sapiens
tggtccattaggcgcgtctgcgtgctgtagtcccagtgacttgggaggctgaagcagaagaatcgcttgaacccgggaggcagagattgcagtgaactgaggtcacaccactgcactccagcctgggcaacaaagcgagactatctcaaaaccccatattgatgtcatttcctaaatatttggttaaaaaaaattctggacgcgtctgatacgcagaacgcgcctaat

SEQ ID NO: 526472 - DNA, 122 bp, Homo sapiens
  misc_feature (83)..(83): n is a, c, g, or t
aactagccacaccccagaacaccacgttatcttacataggtccctcattcctctgtaccattacacaatcatgtatacagggnctgatgagatctgtcattcttaattagggtaccgacgct

SEQ ID NO: 526473 - DNA, 198 bp, Homo sapiens
ccagctcttactttcaggtgtttgagccactgtgacatagtttttatggtgtgaggcaggggtccggcttcattcctgtgtgtgtggccatccagctgtcccggcaccgctgttgaaagcctgtctttccctgatgaggttctcttggcttcgtgtcggaagtcgcacccatgtgggttgttcctggacctggtctca

SEQ ID NO: 526474 - DNA, 431 bp, Homo sapiens
tctggatgcaagtgtcctctgatgcaaaggtcttatgtatctggtgagtctcttgaagatggcagatacttggttgatggatttttatctattcttccattctgtatcttttaagtggagcatttaagccatttacattcaactttagtgctgagatgtgaggtactgttctattcattgtgctagttgttgcctgaataacttttctgttgttgttgttgtttgttttttctatttgtattgttttataggccctgtgagatttcatgctttaaggaagttctatctatggtgtattttgaggtttcgtttaacgatttcagcaactccttttagcatttcttgtggtgctggcttgggagtggcaaattatctcagcatttatttgtctgcaaaaagactttatctctctttcatttatgaagcttaat

SEQ ID NO: 526475 - DNA, 135 bp, Homo sapiens
gcgcatgcagtgtggggcaggacaggggtgggcttagtcatgttccaaactgtccattttcatttttcactgttgttcagcatcatggggcagtcagtgtgcattgcagtgtggcagtcagcattcaggctgtca

SEQ ID NO: 526476 - DNA, 1275 bp, Homo sapiens
gagtgctacatgaaacagtaaatgagctgacttgagtgagcgagtagcgagtgggaacaaggtccatggctcctttgtggaacactgcagcgagtcttgacattttgttgagattatgggaggttcaagtagaatgggagctatcctgctagttgccctctgcgtctatctggacgctggaccctgcacagggtccccagggcagagcattctggtgcttgtgttgcactatgagaagctagggtagtaggatcactagatttagcatatttgttaccgagctatcctgtccgtcgagtggataagaacaagtaggcgtaatgtgggcagggaatctggacctgtctctcgagattaagaggctacttgaggatacttcatatggaagcgaaatctgtgtaacaaagttgtgaacctagggctctgcgccaaagcagcgttgcactaggcgtctccgaaagcaaacacgcgcacaagggcaaggaacctcattcacaactcgcggccccagtgtccaggaaatacttgcaattgggttccattcgcgcatggacaagttgcgacaggcaaaccaagtatttaaatacccatcttgactttgtacacactctggccatctgaacctgtgataagacctctggggcacggagatattctaaataacatcagggatccatttgggccaattacaatggacaaattaatttcgacatcgatcgtaaagcttaataactactattcaacattatactacagtagcgcaggaaaacggagcagaccatcacgagctgggacacaccgatggatgaaaccacccaacgaacgaccatcgcgacaacaacgtgcaccgcgaactgcacgagagacacacatcacccacgcaaagccaaccaaacacagaaccaccaacacctctaccaaacaccaacacccacatggtgcagaaatccaaaaaaagacgaagaggaaagacaactcaccacgctggggacacataactcaccaaacacccacactcagcaagatgaacaccacactacgagcacccacgcgtcacacgaacatgaaccaaacgacaaaagcaatgcctgaacagcaccacacaagacaaaaacagccccacaaggaacgacaaactatgacaaacgacagacacaacaacatgagacagacggagacaggaaccacgcaatacgagcaacgcacgaccacgaacggaccccgcacgagcgcgacaccaagtagctcaatacaacagatgaggcgagaccgaca

SEQ ID NO: 526477 - DNA, 239 bp, Homo sapiens
ctttttaactgtttttttttttccgggaagcatagactcaggtggccctgaatacacgcccaaggttttctcttagattatgtgattttggtggggcacgggcaaaaggtgtgtgtgtgaatgtgtgcatgtgtgtgaatgtggtgtgtgtgtgtgtgtgtatgtgtgtgtgtgtgtgttggcagacttgcaaaagtgcggctgaaataataccttagatttcgaggtaagtcttccca

SEQ ID NO: 526478 - DNA, 600 bp, Homo sapiens
  misc_feature (283)..(283): n is a, c, g, or t
  misc_feature (357)..(357): n is a, c, g, or t
  misc_feature (378)..(378): n is a, c, g, or t
  misc_feature (424)..(424): n is a, c, g, or t
  misc_feature (510)..(510): n is a, c, g, or t
  misc_feature (528)..(528): n is a, c, g, or t
  misc_feature (578)..(578): n is a, c, g, or t
gaggacccctctatattccgggtgtcttataaaagatcaaaagaaggtcaggagagacagagagtctcaaatgacaggtgtccaactgaatgacctccatttcctgttctatcaaataagggatcataatatcgtgtctcacagggttatcatgagggttaaatatgatagtgcaggtaagacagtcattcttccacacagaatctgctcaacccaggagggattatttatagctttggatacctcatttcctttaaagcctcactccacacatcaacacagncagtgtcccacctggaactacgggcaaaatgctgagggtccatgagtttctctgggcctgcaaaactgtatganacctgaaaaaattgcctggcntcctacatacaaagtgaagatgctgtatctggtgttaataaacatntaattgaatgcctacataacattatatcaacctccctgacaagtatttaaatgcgtacaggatgttacgtcaagtaaacgtcattnatttttcaatgaaacatntaaaagtttttcatttgaaaataattggtaccttggcctcccaaagtgtngagattacgggcatgaatcacc

SEQ ID NO: 526479 - DNA, 546 bp, Homo sapiens
  misc_feature (229)..(229): n is a, c, g, or t
  misc_feature (303)..(303): n is a, c, g, or t
  misc_feature (324)..(324): n is a, c, g, or t
  misc_feature (370)..(370): n is a, c, g, or t
  misc_feature (456)..(456): n is a, c, g, or t
  misc_feature (474)..(474): n is a, c, g, or t
  misc_feature (524)..(524): n is a, c, g, or t
gaggacccctctatattccgggtgtcttataaaagatcaaaagaaggtcaggagagacagagagtctcaaatgacaggtgtccaactgaatgacctccatttcctgttctatcaaataagggatcataatatcgtgtctcacagggttatcatgagggttaaatatgatagtgcaggtaagacagatacctcatttcctttaaagcctcactccacacatcaacacagncagtgtcccacctggaactacgggcaaaatgctgagggtccatgagtttctctgggcctgcaaaactgtatganacctgaaaaaattgcctggcntcctacatacaaagtgaagatgctgtatctggtgttaataaacatntaattgaatgcctacataacattatatcaacctccctgacaagtatttaaatgcgtacaggatgttacgtcaagtaaacgtcattnatttttcaatgaaacatntaaaagtttttcatttgaaaataattggtaccttggcctcccaaagtgtngagattacgggcatgaatcacc

SEQ ID NO: 526480 - DNA, 592 bp, Homo sapiens
gtatgagctggatggaatcgatgtgcttcttcagcagttatccgtgtttacaagaccccatcccagacggctgagagcaagagatgatggagaatctgtttgattccctctgctcctgtctaatggcttagttacaatcgtgagcgcttcctggaaggggcgaaggtcttcagctgattgaatctcatgctcagggaaaaaagaagatctaccgggagcagtgccctgaaagtgtttgaccatgccatgataggccccgaaggaacagacaactgccataagtttgttgacaattcttggcttacgaaccatctttcccctctttatgaaatctcccaggaagctcacgaaagtgggaaccactgagaaggaacatgaagagcatgtctgttcgatcctggcttccctcctgcggaacctgatagggcagcagcggacccggcttctgaataaattcactgagactgacagtgagaaggttgccagactaatggagttgcatattaaatatctggatacaatgccagtggcggacaagaatattgccggggaaaaacactgacatggtccggcgaggagagatcatcgacaa

SEQ ID NO: 526481 - DNA, 388 bp, Homo sapiens
ctgagacttaagtttggacactttgtcctaggtcatgcagctgactacatttaggaactgcgaatgttcatttatgtaaatacttctgctttagcagtgcctcttccatgaggtaatgtgtgtaaaagctttcttgtagtagagccatataaccacgaagcattgttattcattttgctggacttttggctccatccagttcagcctgcagcatttagggagtccaggaaggggtgagggcagtaattaaagcctaaaggcccaatggcctgtcggaattccctgtctattctggttccctctccgaggcacctccagattttatcttctaccaaatagagagtttgttcctcagaagttgcaggatgtgggcggttatataaaaaaa

SEQ ID NO: 526482 - DNA, 112 bp, Homo sapiens
ccccgggggccgggggctttttggggttggccctcttgtttctttccccgggtcttttttccgggccctcggggggccccttggggggggggtgtggggggggggtttcccc

SEQ ID NO: 526483 - DNA, 170 bp, Homo sapiens
ggtagatttacgggggctattattaccacagtacaaccagcctatgaggattattatagaattccagataacttgtaactgtggccaaaggggtagctggctctttagccctgtgaaaaattatgaaatggaaaagttcatttatatggttagattttgtgcccccaccc

SEQ ID NO: 526484 - DNA, 254 bp, Homo sapiens
cttttggggtctttgctctgaaagggatggcttttgtgaaacattcaactgagaattaaactgtaaacaaggaagtaagaagggcccagttcctcttctcagtggcaaaagtcctccaagctccacattccatgtttttgaaccaaaccacttggcagtattcctgggaattcttcaaattatcatctgttgagtggatccagggcccagaaagcacctgggccacaggagggactcaataaatatttgttgaa

SEQ ID NO: 526485 - DNA, 1019 bp, Homo sapiens
aacgttaccatggtaacgtaaatcaatacaaaggactaccatctctcacactatcgagctgctggatcagggcttcagagaacctgagcggccaccgacacaacacaaccagagactgcacatgccaaatggacagacctgatcagaagcgagctagcgaacacagcataacaagagagatagacagcaagagacagatcaatggcaaaaggtgagtaactcgctcactgtgcaatcacaataaagactgagatatacgtcgacaacacaatgagaaagtaactgacacgcaacgacgaatagcaaatcacacagtatggtaagacaaaaataacacaaaacacattaaccccgagaggacagagagcaagcaaacaacacaattagaagaagtacacggaacaaggcgaagaaacacaacagaagtaccaacagagaatacaacgcagaaagactaaaagcgccaaactgctttggcaaaaccacaaacagcacaacgaacaagcgaaaaacgcacaagagaaagaagaagacgcagcaaatactccagagaaagcgaaaccaccgcacaggaaaaggacggttaagcagccacaaaccgacaaacccacaatgaataagaaacacacacgaaagagaacgagacacaccattaagaaacagaaagactactccaagaacaaataaagcaggcacacgtagcacatagtgacaaaacaagaccgaaacacaacacaaagcatggaagacaatgaaacccaaatgaaactacagcccaactgaatcgaaaaccaccataagaacacaagaaggagcgaacaaaaaacaaaaaccaagcagagccaacaaagaaagcctaaaccaccaaaagcaccgacaacaaagaggagaaaccacatccacacaaaactagaaaatcacagcatcacaaactacgcaaaccaacacagcaaatacagatgaaaacaaagaaccaaagagaacgcatcacacagaacaaaacgcagcagaaccaacac

SEQ ID NO: 526486 - DNA, 114 bp, Homo sapiens
ccgacttatctgctgttgtatctttcttccttccttccttccttccttccttccttccttcctttcttcctttctttctttctttctttctttttgcgcccgcagtctcccttc

SEQ ID NO: 526487 - DNA, 112 bp, Homo sapiens
tcagtttcccgaattgaggcactgcatcggtacgtcttacttggacttacgaagtatgtcatggcacacacattcagcagtaccctgaagagcaagaaactggtcagacaat

SEQ ID NO: 526488 - DNA, 1056 bp, Homo sapiens
cagagtgacttggtttctccagaaactggaagcctcatgggctgaggaactgcctcccacccacagcagagccctggcggacacaatcccttttcctcatggctgccctgactctctgaagtggcttggggttctgggctgactgtgggggacacatggccatcttgagcatcacacagaccggcgggtcctgctgcagtcctgtccttcctgtagtcttcactccacagcctcactccacagtgagtgaccctcactggacaccctcactccacagcctgcaacctgaggatggggtgtccgcctgagcacagcatcgggggcctggccccagcagcgggtcctggatgtgctgagattgggctgcctgggttgacctcattgggaggaggtggggacggcaggtccagctgcgtactggggaccctgctgcaagccctggatgtggactcctgagtcagttctttgccttcctgtggtctttttccggcactcacatcgcccaccaaggcctgggtgggtgagaacagtgcccacaaggagaccctgagtaacagagactcacagcccatccaggtctctgggcaggaaattgaaggaatcatcacattttacagaggaggagactgcagctcagagtgggggaagtgtgtgcaccaggccacaggcaagtctgtccagagcactggtaggaatgagggaaactaggaatgaccactttaaaaagttagatgagaagaatttcaaggccgggcgcggtggctcacgcctgtaatcccagcactttgggaggcggagatgggcggatcacgaggtcagaagattgagaccatcctggctaacacggtgaaaccccgtctctactaaaaatacaaaaaattagccgggcgcggtggcggacgcctgtagtcccagctactcgggaggctgaggcaggagaatggcgtgaacccgggaggcggagcttgcagtgagccgcgatcgcgccactgcactccagcctgggggacagagcgagactccatctcaaacaacacacacacacacaaaacaccc

SEQ ID NO: 526489 - DNA, 1185 bp, Homo sapiens
gctatggggctagtcttctctaaaggccagccagtgccatcctcgtcgctgagagcgagtacacgctctcagaacggcgacactgactgagcgaaatgacccttcgggcgtcatcctcaaggggccacaaagcggatgggataagcccagatccgctaagctatccccggcgaggtttcccgggagcggagtgactgcctctcgcgcgctcgtcgtacgatagagacctagtctagtcgacttgtggaaatcgtgaacagggattgaggacgcacatcatatggaaggttgcacgagtcggtgatctgcgggcggtcactcccacgtgttgccttaggtgactggtggttattgtccgtcagagtggtgcaggtgtctgtgccgtgcttcaggactccctggggaatggtacaaccgctgtcggcgctctggggattctcagcaacggggtcacccgacctcctgaggtggtaactttgctcggggccattaccaggggactgtgtgtgagtgtggccttcggtcctgctgagcaatccgggagattgtctctggatctcgagataaagagcatcgaagctatggaataccctggggtgtgtgcaaatacagctgtccaggatgagagccactcagagtgggtgtcttgtgtcccgttctcgccaaaagaggaacctatcatcgtctcctgtggcttgggacaagctggtcaaggtatggaacctggtaactgcaaggtgaagacaacacattggcacacaggctatcttgaacacggcgaatggtttccgaatgatcctctgtggtttgggggcaagaaggccggccagttgggatccacgaagggaaccctttacacgccagggggaaaaaaaagccggttgccacaccagggtgtggcgcccaatgttagagaccgaagtgtaacaacacatcaagacgcccgtcgcttgatcttgcttgacatgatagtaacaaaaaaccgcgctctgataccgccgagccagtgcacgacaacaaacattcgacgaccatacaccatacgaaaaaccatcatcacaatgaacacacacaacaacacaccaaagccaaacacacaccaccatacaacccacacgcaacacaatcgcaaacacaacaacacacacgcacaccacaggcaccaacagacaaagcaaagccacg

SEQ ID NO: 526490 - DNA, 142 bp, Homo sapiens
gttagcatcggaactccaattttaggagcagggttgtgtgttggatttgacatagatgagacgcatttggaaatattttcataggaattccagaagaggtttgagttaacacaatatttgacataggttcacatgtggatgt

SEQ ID NO: 526491 - DNA, 182 bp, Homo sapiens
ccccggggcccttttgggggttccccccccccccccggggcccccccccggtttgcttggccttttaattttcaaagggccccctgccggggcccccccccctttcccggggggggtccgggggttgggggggccttttttgggcccccttttttttttttgggggttttttttttccccca

SEQ ID NO: 526492 - DNA, 310 bp, Homo sapiens
  misc_feature (15)..(15): n is a, c, g, or t
  misc_feature (29)..(30): n is a, c, g, or t
  misc_feature (56)..(56): n is a, c, g, or t
  misc_feature (67)..(67): n is a, c, g, or t
  misc_feature (75)..(75): n is a, c, g, or t
  misc_feature (88)..(88): n is a, c, g, or t
  misc_feature (96)..(96): n is a, c, g, or t
  misc_feature (106)..(106): n is a, c, g, or t
  misc_feature (119)..(119): n is a, c, g, or t
  misc_feature (124)..(124): n is a, c, g, or t
  misc_feature (135)..(135): n is a, c, g, or t
  misc_feature (141)..(141): n is a, c, g, or t
  misc_feature (165)..(165): n is a, c, g, or t
  misc_feature (183)..(183): n is a, c, g, or t
  misc_feature (189)..(189): n is a, c, g, or t
  misc_feature (192)..(192): n is a, c, g, or t
  misc_feature (235)..(235): n is a, c, g, or t
  misc_feature (239)..(239): n is a, c, g, or t
  misc_feature (243)..(243): n is a, c, g, or t
  misc_feature (250)..(250): n is a, c, g, or t
  misc_feature (254)..(254): n is a, c, g, or t
cgctctagaactagngatcccccgggctnnggaattcggcacgaggtcagggaggnggggccaaggntgtcccanattcccaacaccnccctctgntcaccatggnaatctttggactnagganagggccaggtncagggntctccctcctctccccttcgctgncccctccccctggagggnatggtntcngggggtggcactgagctatgagtcccggggatggtgaggaacnccanaganagagccncccnaggagtgagtatagtgctggtgactgtgtttcatagccccagtccagggctgtcta

SEQ ID NO: 526493 - DNA, 202 bp, Homo sapiens
tactccatgtatgcggcgtgctagcttggatgtcttttggctaaattgtaacacgtaatggcatggatagcacacaggttggtgtctacaaacaaggccaaccatgataggcctcactacgcctcctagcaacagcaccgatagcttgcgctactggaagcgcagtatcttgttttaaatgtcctagagcacatatactctg

SEQ ID NO: 526494 - DNA, 660 bp, Homo sapiens
  misc_feature (13)..(13): n is a, c, g, or t
  misc_feature (141)..(141): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (302)..(302): n is a, c, g, or t
  misc_feature (304)..(306): n is a, c, g, or t
  misc_feature (308)..(308): n is a, c, g, or t
  misc_feature (310)..(312): n is a, c, g, or t
  misc_feature (314)..(315): n is a, c, g, or t
  misc_feature (318)..(318): n is a, c, g, or t
  misc_feature (320)..(322): n is a, c, g, or t
  misc_feature (325)..(326): n is a, c, g, or t
  misc_feature (330)..(331): n is a, c, g, or t
  misc_feature (336)..(336): n is a, c, g, or t
  misc_feature (338)..(338): n is a, c, g, or t
  misc_feature (345)..(346): n is a, c, g, or t
  misc_feature (349)..(349): n is a, c, g, or t
  misc_feature (353)..(354): n is a, c, g, or t
  misc_feature (363)..(364): n is a, c, g, or t
  misc_feature (366)..(366): n is a, c, g, or t
  misc_feature (368)..(368): n is a, c, g, or t
  misc_feature (370)..(371): n is a, c, g, or t
  misc_feature (374)..(375): n is a, c, g, or t
  misc_feature (381)..(382): n is a, c, g, or t
  misc_feature (390)..(390): n is a, c, g, or t
  misc_feature (392)..(392): n is a, c, g, or t
  misc_feature (403)..(404): n is a, c, g, or t
  misc_feature (406)..(406): n is a, c, g, or t
  misc_feature (408)..(409): n is a, c, g, or t
  misc_feature (419)..(419): n is a, c, g, or t
  misc_feature (424)..(424): n is a, c, g, or t
  misc_feature (427)..(427): n is a, c, g, or t
  misc_feature (434)..(435): n is a, c, g, or t
  misc_feature (439)..(439): n is a, c, g, or t
  misc_feature (447)..(448): n is a, c, g, or t
  misc_feature (516)..(516): n is a, c, g, or t
  misc_feature (539)..(539): n is a, c, g, or t
  misc_feature (626)..(626): n is a, c, g, or t
caactcccctggngagcagaggctcagcaatgagtgacagttggtcaccaaatcagcattgtttagacaacttaatcagataaatattttaaaaaacataatcaaaagaaggcacagaggccagggggctacatgggaacngcctattgttcagctccgttttcacggaaaacatgtctgagccaaggcagctcctacattgggtcccccaggataccccggtctcccaaataaatacattcatctgtaaataaataaataataaataaataataaataatcanaantnaaaaaataaatanannnancnnncnncancnnnccnnatcnnataantntataaannaantctnnaaaaatctnnananannaannactaanntaaacttntntcaatttctanntnanntcttttcaantcctncancattctnncaanaaaaaaannataaatggtataaagattaaagatgtaagggataaaagatgtaggaaagagtgagtaatggaggaaanagtttgaattattagtggttganagaaattaaatgtgaaggaaaaacattaatgaataaaaggtttagaagtggtggtattgttgattaaagttataagattgggttaanaaaataagccccaaattatttttttgagccagaa

SEQ ID NO: 526495 - DNA, 155 bp, Homo sapiens
gtggcacatagtctctgagaagacgcagaaatgaggcgggtaatctgctgatccatatgtttacaactggacagcatggtcagaggacagtgactggggaaaatggtatcggccaaaggcatcataacgtcttccctgatgggaaagcttttcct

SEQ ID NO: 526496 - DNA, 503 bp, Homo sapiens
gaagaacgcggcctgaatgaagcagagccactgcagtgggtccctaccaggcatgtaatgaccgttggggacagctgcaacaggatatggcttgatcatgccaagagacccatctggcctggatctcttcttcagatatcccttccagtcccctgaccctccagacctcagcctcaacggagcagccaacaagaagcaccggctaggtcccatttgtgaatcccgagaggacccgctgcacactgcaccgtcagaaggcagggatcctgactgctgccagggaagggacagctaatccctttggtggctcaggccaccagcaactaggtgagcacaaaaagcagcgttgtgacttctcgggggcagagacaatgaaggcaagatgggggccaatgggtttgggacactcattgttgctcatccgaatagctttctttgggtgcttcctgtgcgctgactgcttctctcgatgcccttacaaaaaagagcaacttaaggcaggt

SEQ ID NO: 526497 - DNA, 213 bp, Homo sapiens
agcggatgctgtatccacggttccaaaaggagctagaagtcgatgccactcaccccgcagagaccactccttcttggtggacgagttggacaccctccatcagtctgtccccaggatcatccagaacattggtacagagtttaactcacagcctcggaactgaattccgacgcaggccgacgacccggcacgtgctgctttactaacctgacg

SEQ ID NO: 526498 - DNA, 387 bp, Homo sapiens
gggacgaccgaaaagcatttgtagagcgtcatgcgcttcaggatgatcaaggcaatcggctaaatgtcacgcttagtcggctgcgaaagactatggaaagccgtttgtggaaactgagcggtggcgacattatagaagtttcctccgttatgggtcatacccctggtgtcgccgataatcactatttgaagatcaacgatgagatcaaggtcgacggggcgacatttgttggggaggcttttccggacaaactacgtggcataaacgttataccaaccccaccaggcggctgcaaagatagcctttacggtagtctggcaccaaaggatggcgtcaatcattgttctgaattcatccactgcctcggttgccctagctatgcaattg

SEQ ID NO: 526499 - DNA, 280 bp, Homo sapiens
  misc_feature (60)..(60): n is a, c, g, or t
gatctaaaggatcccggcagtctgatggtctggtcatactgcagctctaagtatagcttnatcagctggcagaatacactcacacctacacctcctggtcctacagcgctattctactcccgtcggatgtggtgattgaggtggagagcattaaactgtctgcactgcactggtggctttgtgtcgttactgggacgacccttgtgtgagtgatctccaggcggggctggagtgtcacagggaggctgccaggccctacatgcccccgatacagcgacca

SEQ ID NO: 526500 - DNA, 364 bp, Homo sapiens
ctatatcgcaaaactgaaactctatacccgttacacagtaactctgtatttctgcgtctcccgagtcgcctgtatcaaccatcatttttctgttcctagggtttgactactctagatacctcatgtaagtgaaatcatacagtgtgtgtgactggcttatttcacttcaacaacaaaggctcatccatgttgtagcatgtgccagaatttccttctgtactaaagctgaatgatataccattgtatgtgtacaccacatcttatttttccatccatttgtccatggacatatggattgcttccatcttaagactattgtgaataatgcttctgtgaatgtggatacacctcttaatgatccacg

SEQ ID NO: 526501 - DNA, 351 bp, Homo sapiens
tcgcgtacaagaagcatgaattatacgaggccttgcttaatacacatttcgagtggaatacgaacagaccagtggagtgactggtatactactactaagtctagtaacaatatacaatggcttgtctacaaagaagataaagcatgtaaaatctatttctatttattttctttgtcagtagaaaaggaaacatcccatctcagtttgctgttggaatgtttgcttcaacccctcatactagtcttgtgcatgaccatagtactcagccctgtaaaaattaattactgagtacagtaggaaagctgatgggaatgtgtatcaatacagtggcaccagcactatacgagcaac

SEQ ID NO: 526502 - DNA, 334 bp, Homo sapiens
  misc_feature (227)..(227): n is a, c, g, or t
atgtcattttactgttctgataaatgcataatgcaaaaattcccatggaaagaaaaatattaagaagtgttagcaatctgaaactatgtgctagtggttagctagtgtttatgttttggtgaacatccttttagacaattttctatgcaacgttagataaacatagaattgtacacgtatgattttgtacccatacattttcttctgtacctgcctttccactcaanagtgttttaaagccatctttctatgccactaaatacagtttttcttcctcattttaagtgacattgtagcatcctgttgttggctgtcttgaaattaattaaataaa

SEQ ID NO: 526503 - DNA, 359 bp, Homo sapiens
ctgagatggaatctcactctgtcacccaggctggagtgcagtggcgcaatctcagctcactgcaacctctgcctcccggatttaagcgattctcctgcttcaacctcccgagtagctgggacgacaggcgcgcaccaccatgcccaggtaatttttgtatttttagtagagatggggtttcactgtgttagccaggatgatttcaatctcctgacctcgtgatccacccgcctcagcctctcaaagtgctgggattacaggcgtgagccaccacacccggccaaagcttttaatttttaatggtcctccaataaatacattataaagtttcaaaccattttggggtcagttagttttga

SEQ ID NO: 526504 - DNA, 284 bp, Homo sapiens
gattgctagaaactagaagcacttgcacggtgtggacagagcctcagctggatgagacggctagcgatgggtggacagcttgtataccagtccctgaactgagctgtataacagggactggggaggctccacccagaaggcttacatttgtactctgctgggagtgacagggaaaaactccttccctgctgctgcagtggcagcagaggctcatcctggctttgcacccaccagtccgttgcagcacagcctcccaggagcaagccagggcacaagcacagggt

SEQ ID NO: 526505 - DNA, 178 bp, Homo sapiens
tagaggatccacttcgacggtgttctgaatactcgaatggtagaaggcatggtacaacaaaacaaaacacaaaaaacaggtattagcacttcttaatagttccttcacatagggccctttcaattttctgacagctcttgcctatctcatcatgtcactttatctaggacttcacact

SEQ ID NO: 526506 - DNA, 172 bp, Homo sapiens
tccgttcgttgctctcgttggtgaagacaagtggtagatagggctgatcctcacgtcgtactagggcccttgagcagcaggaaggagcactccagcggtgccgtgaccttgctcttgaggaggagctggggacagagcctacagaaggagcccggatggcagttcttcttct

SEQ ID NO: 526507 - DNA, 237 bp, Homo sapiens
tccagtacccgagcatgcttgtcatggcttgtcgggtcgacgtgtattcagctactggggtgcatgtcctccctggacaagtaccgtcgacacgtgagcaccgttgctgagctccaaatatcgttaagctggagcctggtcgacgtgtattcaccactgcggtgcatgcctccctgtactagttccgtcgacacgtgagcaccgtgctgacctccaaatatcgttgagctggagcct

SEQ ID NO: 526508 - DNA, 570 bp, Homo sapiens
ggcacgagtatttttagtagagtcagggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcattacctcctaagcagggacatcatgggtgtcatgaagcattcatgtgtgatggcatttctttgcttctcatttcttcatgtgtttgacatttctcctagctccaaactgggccagctacctttcctatgaaatctagcagtagctgtgggattgacgtggttgctcttttcatctttttagattacccattgcttctctcgaaatcctagtacatgatttttttttatcctatgagcagaaatcaggaaaaaacagattctacatagaatttgacagatattatttcaggccaggtgtggtagctcatgcccgcaatcccagca

SEQ ID NO: 526509 - DNA, 234 bp, Homo sapiens
gcggccgcctactactactactgctcgaattcaagcttctaacgatgtacggggacatggcaaaaacctgtctgtacaaaaaatacaaaaaatagccaggtgtggtggcaggcacctctggttccagctacttggaaggctgagatgggaggatcacttgagcccagaaggcagaggtttcagtgaactaagattgcaccattcaactccagcctgggcgagagtgacaaaaaa

SEQ ID NO: 526510 - DNA, 128 bp, Homo sapiens
tcaggctattggttagaatgagtaggctgatggtttcgataataatctacgctataggaggatacagcggtgtacagtgtgccttgtggtaacgaagtgggctaagagcattttcaatgcttcagagc

SEQ ID NO: 526511 - DNA, 927 bp, Homo sapiens
  misc_feature (682)..(682): n is a, c, g, or t
  misc_feature (701)..(701): n is a, c, g, or t
ggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcactctcaaccatgctgaagtgcagtggcgctaccttggctcacggcaacctccacctcccagattcaagcgattcttgtgcctcagcctccnaagtagctgggattacagntgtgagctaccatgaccattctggccaagaatgagaaatctctgtggaaggagaatactgggattcctgaggaggtttccgctatagataactcacatctccctccctggggtccaggccatgggtgtggcttgggcagaggtcggagaggccaggtgtgccccggcctgagatccgcctcagggagagagaaagggcagtctcttcaccacgtaatactacccga

SEQ ID NO: 526512 - DNA, 329 bp, Homo sapiens
tgaattagagaaggaacaggtggaaaatggatggcaacacacagagtccgggggacacacggccttatagatgaagtgaacgagtagacactgaataggatccacgctaaatgaacggtccatttcaaactcattcacatcccaaacggaggttcatctgtcttctggttggtgacagttatattctattaggagtcttattttatatgcattatcattacaaagtagataggttctaggcgtaccttattctttacttgtggtttactcatcagttatgaataaggcataccttagaaacttgggttaccaaatataaacgatggaat

SEQ ID NO: 526513 - DNA, 769 bp, Homo sapiens
  misc_feature (682)..(682): n is a, c, g, or t
  misc_feature (701)..(701): n is a, c, g, or t
ggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcactctcaaccatgctgaagtgcagtggcgctaccttggctcacggcaacctccacctcccagattcaagcgattcttgtgcctcagcctccnaagtagctgggattacagntgtgcaccatccacactgaggtaattttgtatttttagtagagatggggtttgccatgctggccaggg

SEQ ID NO: 526514 - DNA, 588 bp, Homo sapiens
tcctgtattccagtccagaaagccaaagtgatagtaggacatacctcacttggtttcattctctcagggatcacagtcgcatactcactgatttcattgtctgaaaacaatttttttcatgtattttgttcagtttttctaattgtttatagcagaaggccaagtctagtaccagttactccaacatgtgaaaagaattttacttttatagttttctgattttacattttttactttatagatatacagtatcacctgcagtaataataacttattatttctaatattttctttttccccccaacacaacgcggtgtgtagttagttatcttgtctaattcattggctagtacttccaggacaatgttaaataatagtattgatattttcctggtatttttctgtaagggtagatgggacaacattttaaagggaggccgggcatggtggctcacacctataatcccagaacttgaagctcaggcaggtggattgaagaatcacttgggcctgggtggtggacgttgcagtgagccaagatcgcacccctgcattctagcttgggctacagagtgagattccatctca

SEQ ID NO: 526515 - DNA, 472 bp, Homo sapiens
ggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcaacaatagccctcttcccaccaggcttttttctgcataacccctccccaggaagagcgtggccagaag

SEQ ID NO: 526516 - DNA, 409 bp, Homo sapiens
aacctagtctctctaatgagcatacttattacaggctccatctagactaacgagagagagagaccttaaatcgatgcattgcatactctatcaatcagacacatagccctcgtagtaacagtcatactcatccaaatcccctaaagcttcaccggcgcagtcattctcataatcgcccacggacttacatcctcattactatactgcctagcaaagtcaaactacgaacgcaatcacagtcgcatcataatcctctctcaaggacttcaaaatctgctcccactaatagctttctgatgacttctagcaagcctcgctaaccatcacttaccccccaatattaaccaactgggagaactctctgtgctagtaaccacgtactcctgatcaaatatcactctcctactta

SEQ ID NO: 526517 - DNA, 1118 bp, Homo sapiens
ggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcactctcaaccatgctgaagtgcagtggcgctaccttggctcacggcaatcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcattacctcctaagcagggacatcatgggtgtcatgaagcattcatgtgtgatggcatttctttgcttctcatttcttcatgtgtttgacatttctcctagctccaaactgggccagctacctttcctatgaaatctagcagtagctgtgggattgacgtggttgctcttttcatctttttagattacccattgcttctctcgaaatcctagtacatgatttttttttatcctatgagcagaaatcaggaaaaaacagattctacatagaatttgacagatattatttcaggccaggtgtggtagctcatgcccgcaatcccagca

SEQ ID NO: 526518 - DNA, 130 bp, Homo sapiens
ggacctctgtgacttggtgaacaagacgacactgcctgcctggaacggccattggcgtggaaagctaaccaaagggtctctctacctacagggcgaagcgcacacctagcgctgcgcacacccgctcccc

SEQ ID NO: 526519 - DNA, 894 bp, Homo sapiens
ccaacaacctcatggctaggtgcgaggcttgggtgtgtggagtgctgctgctgcctgctgtgcttccccagtcccctgagtgccccgccgtgccccgcagagcgggagtgggacccagccctagtgcatgaacccagtgcgccgcagccctgggacgcccgcggagagatgccactcccgcccacgtcccattatctgcccctcgactgtcctggagtccccgatatgccagatctaaccatgagctaccctgttgctatacccccgcccccaaggtagggctaacctcaccagctgcaccaggtaggtggtccctgtgtgtgagtgtgcttgcctaccctcctaccgcccatgcattgccccgccatcggggctggactaactgtggtgccacctagtagcgtgtggcaagtatcaaccacgtgactatctctctgagtgaactaggcgtgccaacactagtctagggacaatttagtgacgtgacgccaacagtagcccaagcctagtaacccttgaagagccccttgaggagactaggcatagcgcacgacccatgttgcccccaatgtgctgagcgtattagaggagctaagcacccccccttcattgcacaccagacacgaccctggtaaccgtacccctaataggagatagtagttcccaagcgccccccaggagtgacgggacacaccccccgacacccgcttcccaagatcaattgcccctatccaagtaattcccatggccacaataaccgcatagaggatggcacacccatatagcccatggggacctagtcaccccatacgcaggcacccccggtagacgagcctagaccacaccgcaaggggccctaccgcctggctgcaagtcagacgaggtgtaccaacc

SEQ ID NO: 526520 - DNA, 126 bp, Homo sapiens
atgcgaatactctactattctatctgcttccttgagatcctgtgtattggcctgatgttttaatcgagagagtctcactccatcgcccccctgaagattgttggtggccctgaagattgttggtgg

SEQ ID NO: 526521 - DNA, 673 bp, Homo sapiens
ggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcaatttggtggcccaggttggagtgcaatggcacaatctcagctcaccacaagcttttcctgctgggttcaagtgattctcctg

SEQ ID NO: 526522 - DNA, 318 bp, Homo sapiens
gaggttgcgcgagcgcggcgggacagactccaggcaggcaggcaaagggcacgagggttggacacgaagccagaaagctacttgggttcctccttcttctcgtttgccataaatctgcttctggtgcatgatctccgtgtcccatctgcttgcgaggtgtgaactctcggcgtgtgcagcaacaacttcgtccattgtgacctgcaacaatttcgtccactcggacctttagctcatggggtatggtgcctcggcgtgtgctgcacacgccgaaaatccagaccccttggtgacacagatcgtggtggacgaagtagt

SEQ ID NO: 526523 - DNA, 122 bp, Homo sapiens
actgaacagcggtggggacgcggtaacggggaacgggcccgaccgacggtcagtactgggaacgccgaaggtgggaggcatttcataacatttcttgtagatcaaaccagcgtggacacctt

SEQ ID NO: 526524 - DNA, 1013 bp, Homo sapiens
  misc_feature (188)..(188): n is a, c, g, or t
agcgtgggggagtggggagagataaggcgctgtcatggacggacgccgccgccgccggtggctgaccgaggcgggtccttgagaggcaaggagcagccgccagctgtcaggccacggtgatggctgactgaaattcagtccaaagcaaaatgccaaccagacaagctgacagtctaatatgctgagcnaaatccacacattttgcacagaatcaagccacggaaggtacttggaagtatgctcacatgagatgccaatccctgcacctatgctatgcctttgttaatatagtgataaaaacctggattaacatttactattctctattaacgggagagtggtcagcaggtatttatccatcgatttctccacataggagagtggggcgcacaaggttgtccagcgaatgacttccattgagtagcctacgaatagatacatgcattgaccttgtccttgtgacctcctggtaatgagtgacattgagaacgcacagagtgcctataaatcatggattgatggagcactgtgtgcttaaagccatgctcatgtgtggcctgcctcgtccgtgcactgagctccaatgttcgcaggggagcgtgatcgtcagcttgaggaagtggcgctttgacaatagcgatgcatctcagcatggaccgttggcatgtcgagacctccttgttgcccccctactgttgcctttgaggaatttgaacgaccttgtagcgtgagctcacaaaacgttctttgcgagaaggcagaccccctggtgctgaattgcctaggaatattaatgagaggagttcttccgcatgctgctgggcctcccgtgcccgttgaggtgcgcctctgtatccttgcgacgggcggtgggcacccgggttccccagcctttttgttccccatttgaggtgaaggggtattaccttttccgacccttcggggttacctcgaggactcgaaaagcgtgttctcccggtgttgtcagcttggtatcccgcgtcgcaagtcca

SEQ ID NO: 526525 - DNA, 257 bp, Homo sapiens
  misc_feature (20)..(20): n is a, c, g, or t
  misc_feature (37)..(37): n is a, c, g, or t
  misc_feature (140)..(140): n is a, c, g, or t
ggcaaactgctagctgctgnggggtttgtagccaaancccaccccagggacaaatgtaagtaatatgctgacactgtgcaagacagaaactgggtgatatataagatctggtttttaataaaacgaaggtggttttgaanccaaagatcaggttttaaattccatcatttttctaaagctatcatttaccaaataaccagccaagaaaacatacctttgcatttgttcgttgtcttatccaaaattgcctttgtgga

SEQ ID NO: 526526 - DNA, 124 bp, Homo sapiens
gatagccgaagcctgatagcctcgctctcttagtcgcgcatgagactggtcactcgcaggtgcgccagaatacacaggatcagaggcgcatctaacggcagatcacctggagctctacgcctcc

SEQ ID NO: 526527 - DNA, 692 bp, Homo sapiens
taaggtatttaaactatttattaacaaacaaggcctacaaacttatttcttcttggacacacccacggtgcggccacgggggccaggggtcttggtgtgctggcctcggacacgaaaggccccagaaagtgacgcagccctcttatgggcccgaatctttcttcagtcgctcccaggtcttcacggagcttgtttgtccagaccatgggtctaggacctcggctgttatttcccatcctttactatcctcttcgtgtctctgtgttctcaaaaacccacgtctcgtgggatctcttgtggatacgtggcgtgtggattctcgtgcattatagtgggtgatctcacagcgttctccacctctcatctcttctcgaggtgaagttctcctcccgcccacctcttgtggtgtaaggctcaatgtgtgtcgtggcattctccttacaaaacacccacacatgtgtagccattatttcttgtgcggccccaaaacccccttaatgtgggcgagtgtgagagtggccaaagagggcctcaatatatctccgcacgcgccccaattcgacatgtatgtgggtgtatgtgcagaataacctcgccaaaaatatttatggcgtggaaacacatttatccgagggggaatccactaaaaagaactgtggggtgtgtgcaaccacaaggcgggcgcccggtga

SEQ ID NO: 526528 - DNA, 345 bp, Homo sapiens
tgctgtatgacggcaggagatatctgagtaatttcatgggatgattggattaatccatcaccaaaatcagcaagtaactaacttccttcctcagtctatttatctgcctgtggcttcctttatgcatggatttgtgcattcagccatttattcgtgcaagagtcgtttattaagtacccatatgtgcaagctgttagtataggtgtgagggcgatgtggcagtcttccaggtccaatcaaaaactggagctttccagcaccagtcttgatatgttgctttaggtggcctggagccatacaaaggtagatgtagaaagtgtctcatggaatacccatgcagacatc

SEQ ID NO: 526529 - DNA, 1463 bp, Homo sapiens
ggacgcgtgggtcgacccacgcgtccgcagagttttcatcggaggcatgcagagagttaggcttttctacgcaacttgctttgcagctcttgtgatcttctcggcacagcttcaaccctgcttcagctggcatcctgacttgcagcagcgatgctgctcaggcaggaacgcacaactcttgaaaccaagaacagctgtactgcacgcgacgcctactctctctcacagccttttgctgcgactgacacacacttgcggcaacgcgccttccccctcacagctccacacgcctctctctgcctctacgcgcagctgactacacacccctaacacctgcttccagcacggcactgccaacactccacaacctactgctcccgctgcgcctctcacgcatccccttgcctactttaccaacgcctcttctgcgccaccgcacccacactgcgcgcacaccactctgtcctgcacacccacaccctgcacccaatctcctccaaactgcgcaaccaccacgcaccacgctgctacccaacaccacacttcgcctgcacgctgcacacaaccgctctgcgaccaccgcgccactacttacacactccttgttgcccttaaaacacctccacgcgctcgcactacttcccctctatcttgcctccaccccctctacctccacacatctgcaaacactaactctcaccacgccacccctacccaccacaacttaacttcaaacgctctccgccgtctgccctttccccccttgccactccacgcccctctctctacctctgcacggccacttcacccctactcctacccttcccccttcgcttgcaccctgggccacgctccctcgccccccactgccactctcctccagcggagcctggcgccaccgcctctaccccctaccaccccccactcccccctaccttcaccaccgttcccactcccttcccctgccaacttccggcccgcacctaccccaccctacctccacccacctggcattcgctcacccccgcaccttccacgccttacactactgcgccacgcctgcaactacctcgccccacccacctcggctccaccctctaccccacaccacccgcactcctaaacttcccacacccctctacctaaccccaccactgactacctactcccctccctgctcctgaccacacacctctgcacaccacaacttacccccccacacatacaccgcccactataacacatccctgagccctcacacaactttcctgccccctccaaaccctctcccactaaccgatacccccccctcatctctacaactccatctctccaccacctaccagcaatcccccctcaccacacatcttcttcccaccctctccacccacccccgccaccacccaccctcctcagcgcaccacccatatactctcagacaacaacacaacacctactccact

SEQ ID NO: 526530 - DNA, 716 bp, Homo sapiens
gacggttgcggggcgcagccttgcgaagccctaacgcagcgctggggaggggggaggacgtaagggtagcggtggtcggttcgtgcatggggagatggtatggggcccgggcttcagagtggttatggagggaggctggcggcgtgaactgcgcggaggcggtgctgtagtttggtggtaggtcacggatgcagctgacctggttcgagtgtgcgctatttgtttgaggatacaggggtagatttttatctggtgtctttggtcattaattcggactgcgaggagacgttactgcagttgtggctatggttgacggagccggcgggtggttttgtacttttcttttgaatcgggatttcttctctaccatgctgtttgttgctcgcgtgggttttctaatgttgttagctatgtattgttatatgagctgcctattcgttgttgtatatcgcggttatgtttcctatcaggtcctagttccttggtttgaacaacttcttttctagagtgtacagtattttctctgctctgctatcgtacttggtctttcacctctgtgcggagtctttggctatataatggtttatctctctcttcatttttgctcttatcatatattgctcttaggatcttttccagtgtactttctatccttgtatctgtgtctctgggctatcatttctcgctccgcgccatcgtttatttctgtattagcg

SEQ ID NO: 526531 - DNA, 364 bp, Homo sapiens
tcggggacaccggccgtcactcctctctggcgggaataggctctgtgcgggcctcacagcagcgtccaaccctgcctctcggaccggggtacctgtccggcgtccaggaagaattaggtcatatgaacggattgaagagtagtgtatgcggggatttgattgagtggtggctcctggtgggatgggaactggaaagcagacggtgaaagagggtcatctttccctgaagccgcaccatctgaagttagctgcgtctatctgtagtcttcaacactcttgctgcttctctgctcaccgctcagccgcttgtgttgctctgcagctgaagtcttttttatggccacaggataggggcgtggcaggc

SEQ ID NO: 526532 - DNA, 945 bp, Homo sapiens
cgagttcgggctagttgttgcattccggcatgatgggactagtaacgcccctatgagcttggtatggggtgcactttgcaattgaacttgtagagtgcgacgagcgtgttatggcgcgatatcgagaatgcgatgagcgcatatggctcttgtctaggccctagcagtgagcaccggatttcgatggccttggacatgtgctactataaagcaacaaagaactgagacacgaaatagtttgataagactctgacaagggttgattccaataagacatgatcatttggagtaaggcttataatgaaagtcttgtaagcaaaaagtctttatggttacaatagttgtattaagggagtttgacgtggatgaagaatatttttgcgaaccgaacgtgcgatccattcactaaggctctttggggtttcaaatttattgagcccaacacaggaaacaactggtttagcaagatgagtcatgggagccgctcgaacattgaacggccaatactcctgctttcgtgagaaaatacaagcatctggagtaaaccgcataccaacacagtcatgttctcctaagttaaactggaaacttttggcagttgcctttgaaaaccggttgtctatgaattgcgcacaatagaaccatgattttgcggattaggggaagtggtgggggaccacaatgataatttgaaatatatggttaactactaggggattcggaaagattactaaagaaggacgtgtataaacatataggactattatatataagggtagccagacagataacaaattggtaacggtaccgcaatatataatttagagcatatacacataattatcagcggctcggtataaatgtgggcgcccacattgaaacttaacctatggtgttgagaggcaacatattgggacagagcatcttcgtgattaggaaagtgag

SEQ ID NO: 526533 - DNA, 786 bp, Homo sapiens
agcggagcgggcagacgagcagagagcgggccgacatcttgagatccgtacagtgcccgggccggccagagcagggggccgaggacaccaggtctgtcctcataggcgactggggccgcggcagactgatctgccgccgatgatctggaggcttattcactctactaatctagcaaggagtggaggtgctcatcttcccgaagtctaccgacgatgacgactcggcgagtgaacgctacgttggaatgctcattgtcgaggttcaatcgttgatccagtgaccccgggcagtcagcgtgcgacagcgccctgatctagcaagcatcgtctcgacgacacagcattcttccacagcttagatgcggtcctacatcagtttggtctggacacgtcacgtgcacctaagacagatactgctcaaacaggcgttgccactgggtcgttcgatattcactctattaacgacctgtgtgtgtacctgtgcattcgtgctgccttatcattcgggcaacgtatcacgctgatggaattgacagtcaacgacacagaattttgctcgcttcagtactattcgagtcctgcctgggacgtgacgtacttcttacgatcatctgtcgggctttacccccaaacaagccaactttgccctgatggaacgagagccgccggcttgaaaaaacgcgtttcattctagctgcacagcaccgggacagttcaaccggaggttcacgcaattcacgatcatacacggacacgagcgagttgtacctgcattcgacccatccc

SEQ ID NO: 526534 - DNA, 190 bp, Homo sapiens
gggagaactcatctctactaaaaatgcaataagatttgccgggcattgtggcgcatgcgttataccccagttacttggcgaggtctgatgcacggagaacttgtttgaacctgtgtggcggaggttaccgcgagacgaggtcgcgtcgttgcacttcagactgggcaacaagaacgaacctccgcttgcg

SEQ ID NO: 526535 - DNA, 506 bp, Homo sapiens
  misc_feature (12)..(12): n is a, c, g, or t
  misc_feature (69)..(69): n is a, c, g, or t
  misc_feature (145)..(145): n is a, c, g, or t
  misc_feature (170)..(171): n is a, c, g, or t
  misc_feature (179)..(179): n is a, c, g, or t
  misc_feature (184)..(184): n is a, c, g, or t
  misc_feature (212)..(212): n is a, c, g, or t
  misc_feature (219)..(219): n is a, c, g, or t
  misc_feature (230)..(230): n is a, c, g, or t
  misc_feature (234)..(234): n is a, c, g, or t
  misc_feature (249)..(250): n is a, c, g, or t
  misc_feature (346)..(346): n is a, c, g, or t
  misc_feature (493)..(493): n is a, c, g, or t
gttccccactgnggatcccagaccatggagtgagcctctcccccaagtttctcctcaccatctggtgtntgtattgttgtttcagacagatctgccacaatcgttgctgacttgcacctccaacgcacccctttccctcaccacnacgttctggaaagacagggagtaanncagtgctntcccnatacagtgaacagcagtggggtgccatntggggtngagcagggagngtgngagggggcgcgtggnngggtaggggagcctctcacaagtccacatctgggcctcccagactcgaaagacagctgaaggagtggtagccaggattttgctgccgtctgggggncagagcaggttggtcaccccacctcctcgaaaccagggaagggggacacaggtctctgttgagacatcccatacccggatagcagcatccacgggtgaagctgagagcagccgccccccactgggggcccaggccaagctgggtaanaggtgtatgccca

SEQ ID NO: 526536 - DNA, 405 bp, Homo sapiens
  misc_feature (310)..(310): n is a, c, g, or t
gtctcatctcctccccctcccctgatccgcggcggtcacgggcttcctggctggctgtctgggaactttccaagcacgcaggctccacccgcaaaccccctccggcaccggcctgggttcccggacctcatctcctcccggtcccctactccgctgcggctatctggcttccttgcggcttctggaactttccaagcacgcaagctccaccggcaaaccccctccggcaccttccggggttcccggacctcatctcctccccctccccggctcctctccagaaggcaccaccacagcggcccacttcggnaaggttccatccccggcaggcctggtctccacgagctccgtgtcctgggtcgggtcctccccatccggctgccaggtcaggaagagaccggcagg

SEQ ID NO: 526537 - DNA, 835 bp, Homo sapiens
  misc_feature (325)..(325): n is a, c, g, or t
gagagacagaattcctgagtgaacgaacagagcagctcctcttccatctccagtaaatgacctccaccttcaagccccgagaatgtaaactgtccaaggcaagaagggcaaaactatggccttcttctctgcgtaattgagaaggacaccagacgggcctagcctggttccggggtgcgttgtgagaaaagatgtaagctccagccagagaatgggctcggcactgtctagaggatgcggacgacagcatgttctctcatggggatccaatgtgctgtactttctggtaggtacctaaacatgaaagcacacactatgactaggntgttgttgcgcaatctgagtcacgaaccagagtggtgtaattcaagatgacattctatctaccgattctggattggggagttcctcactgtagaaccagcatgtgataaatcatcgggttggagcttgatagagagttggggtcagataggtcagaacggagcaaacggtttgagttgataagtactactttcccctgtgatgacatggaggtgtgccaaaccttggatcccagaccccggctctgctatctcagtgcaagggagaggatggctacgctagtgtgcttctcctcgtgaacaactcgtccaagcgtaaaaaggcgggtgtacatgacctgatattacacctcatagggtgtggcctatggagagctggagggctggcgtgatgatccccttgaattgacgtgaatggcgagactgttgaaggctgcagcccatgaggaagtggttggcacggtgcacactcaggaaacctgttcatgttccggcggtggacagaaccgcag

SEQ ID NO: 526538 - DNA, 939 bp, Homo sapiens
  misc_feature (939)..(939): n is a, c, g, or t
ttccctccattctactaggtgctgtgtctttaagctctagttggggaatctgagagaagagaaagaagagtctcaatgacagaccctgtgcctgccctgagcagtctgtgaatgaatgcacctagcccacgtttctaaaggacagcagttctttgtgggcctcagcctgtagaaatgaccagagagcaacaatgtgcgacatctttgtgtttgcctgatcttggcccttacctgtcaggttttgaatgtccttccatgtttccatcctaacaaagaaggaagcaggctgtagagtgcattgtgggagggagaccccaagcctcttctcagggatgtggggatgtgaggggtctggatttgcaggacatgctccattgaatttgcaacagcgctgttgtggcttctgccgctgcagccctcaggcattccctttctgattgaaagaccttgttgaaagcttctccaaagctcgtaggtctggataccttcgttggaggctgggaattttaagaggaggactagagggaagagcctgttgcagagtgagtttttctaggtctgctgagatgattgacacatggagggagcagggttgggggcaggggtccctgaagcacattccagtgcaacgaaggtgggggaagggatcaagttcgttgggatttaaaagagacgcttggaggatatcttagttgtctagtttcactcacccgtggatgttgtaaccgatgtagttgagtgagcctgctgggggatcaggggttgctccattcctggtcgatctatccccgtggtctggggtttggttacaccgcttgggctgacacgcgcttttttggtggttgacccgggcccctaaagttgggttctgttttaaaccccttgtaagttttgcacacctcttgtttcctacactttctctgcagtttaatacttcgn

SEQ ID NO: 526539 - DNA, 195 bp, Homo sapiens
  misc_feature (182)..(182): n is a, c, g, or t
  misc_feature (186)..(186): n is a, c, g, or t
ccggggaaggcttgagcagagaattgctttaaacctgggagtgagctgcagtgagccaagatcgtgccactgcactccagcctgagtgacagagcaagactcgtctaaaaaaaaaaaagcatttttgccccccttgagcccatcctttccttcgccaataggagttatttcaggtgcggtgntttntgcgctttc

SEQ ID NO: 526540 - DNA, 336 bp, Homo sapiens
  misc_feature (58)..(58): n is a, c, g, or t
  misc_feature (214)..(214): n is a, c, g, or t
cgactcgcccttgtctttgctgaatgcaattccgctaacaactattatagcaaaacanaaagcccttgtgtgggctttgctaaatatttataatacaccgactatggcacatctgcgaattcgggtgttttggaattgtgtatttactatcaccgaactctgataaagggaatgtcttaccgtctaaatcacgacaaattgaacatgcaccagngcttgctatccattcagctttatgcacatcagcgttctaaatatcacgagcttgtctgctgacctgagattctagctccctccgtccagagatgacgttgcagactgggtaattaacgacgt

SEQ ID NO: 526541 - DNA, 306 bp, Homo sapiens
atgaccgcattcccaggtcacatcaaatacatcggagccagtcgcttcggagggtgccagtggagacctgggggcctcctcttcagagggctccagccgctagtgtcaggtccccaccggcactcctggtagatgagctgcggtgcttgtggtggaccatgggcgctcagcgctcggtgtggcagggtcttggtacaagaagaagccctggtggtggtaccagatactccgtcagatccatcaggtcccccatgtcgtcgtcctccagcagtgagcggtagaaggtgctgtccaagggactggctg

SEQ ID NO: 526542 - DNA, 372 bp, Homo sapiens
ggtcgtcgaacagtcggccacacgcaggaagccctgaacaacgcggccgacgaggtccagaagcttctgccacgccgctgacaccggttcaatcaaggacaggcgccctgcccaccgggacatggcgcctgtccgcatcacacgcatttgccaacttggtataacggttttgcaatggtttgagactattaccatcagggacaaccaccggcttgaaatatgtatcccggatacgtactcgcgccggaccatcaatccttgctggaccagccatcgatgccaccaaccgaatccggccacaagacggaaaagcgtattgaagaacgcaagcggacacgcctgcgctcaggaaagcttgcaacgcttgaaggc

SEQ ID NO: 526543 - DNA, 238 bp, Homo sapiens
aaaaatttttccccccccccccccctgggggaggggggtaaaaccccccccccccccccccgggggatttttttttttttggttttttttgggggccgggggtccccccctttccccccaaaagttttttccccaaaaggggggggggggggcccttttttggggggccccccatttttttaaattttgggccccccggtgttttttttttttttttttttgttccccccccccccca

SEQ ID NO: 526544 - DNA, 258 bp, Homo sapiens
gcccgagagcaagtggaaaatttcaggatacaaagcccataaccccccataaaagatgattatgtttttagaagcaagagccaaattatggaacctctaaagatttggggcatggtaccccatttgaagaaaattttcactaccggccgctcctcccataggagcctaccctaaggccaagggtgagcccttcccaggctagaacccaaggagggagagaggcttttaaacggaaaaaaaaaagcaattccccccccc

SEQ ID NO: 526545 - DNA, 523 bp, Homo sapiens
  misc_feature (101)..(101): n is a, c, g, or t
  misc_feature (137)..(137): n is a, c, g, or t
  misc_feature (360)..(360): n is a, c, g, or t
  misc_feature (372)..(372): n is a, c, g, or t
  misc_feature (384)..(384): n is a, c, g, or t
  misc_feature (441)..(441): n is a, c, g, or t
  misc_feature (494)..(494): n is a, c, g, or t
aaacgacctaagtgtctattggtggacggattggtcgttttcatagtttggcagttgtggaaatgctgcagtaaacatgggagtatagctatcttttgaanataatgatttcatctcttttttatatgtatacccanaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcgggtttgatttgcatttnccctaaacggtnggtgatactgancatttttgcatacaccgggtccatttgttcctttgttggttgaacttgagtcccttnatataattttggatactgctgtgggcctgaatgtttggtttcccccaaaaatnccgtatattgaaccccatccctaaggtca

SEQ ID NO: 526546 - DNA, 451 bp, Homo sapiens
ctggactcaaatgcatctggaatggagaaccacccccagtgctgcagagccacctcattttctatcatctacccacctggttttcggaggaaaaactttgttccttcagccatcttcacaggccagggactggcacttcctccacactctcagcacaccgccctgtgcatcctacagttcctaaagagtggaaattccccagttgtgctcgaatcaaacctgcccttaagtaccatatttgtataaactcgtgtgagatcacactagcttctcagtgggtgcatcatagtgcaagttaatttcagatttaactgatttgacatggattgaaactgttaagatatttgcaacatgctaccactaaataactattactttgtcctatattgggaagtagtttgtgggatttggggtaggtggatgcaaataaaagcatttatacttatgcaaa

SEQ ID NO: 526547 - DNA, 183 bp, Homo sapiens
gatgggagattgtcgagcaaggtgacaatctcatcaaaagtgatatcccagtgggtgtaagggttgttctgtttctttcggtctctgggtggttccttgaggacttggaggatcagggcagaggcagaaggcaccacctcaatcggggccggtcggtacggaagggtcagttgcacggtaatc

SEQ ID NO: 526548 - DNA, 1719 bp, Homo sapiens
  misc_feature (608)..(608): n is a, c, g, or t
gacggcgatgatggtgccgcgtacggatccaaagaccgtgaaaaagggcggcccgggtcatcatggcaacagtacgtagcaacgcagccatgggactcagcggagcgtatacgcatgaacgaagcaagccgcctgatggtgactggaaggcacggatcgacacgactctgagtcccacagtcaaaagagcttccgtggagcaatgataggccgggttatgtcatcgcatctggatgagaggcgatactatcagaggacggcgcacacgataaggatggatactctcacagtgcaaggtcgtggtcgaggaagggtagggagacgatgagatacggaggaacgaccaatttcaattgtgttcgcgtgaagtggtgctcaatgtcgcttgtggcattccaggtggagaaatatactccgacggatagaacttcccgggaaccacctaacaaggggaaacatgtccttgaaggccttgtatgtgggaacatctacgggtgcagtgtcatggtccaaaatagcgtctgcagagctccaatatacgaaaactcgtgaagccagattaaggggtcatggagagatttgtaacacagcgcacctgttccatccgnagaggggtaaccctgtgcttatagggaacacatttgtggtctcatgcgtaggtggaaggagtggcttgggttcacttgaatcttgttctaccacatttgcagaaacttacctgtggggagaattccacaagcgacagagcacattcggcacacggcacacagaatagcacttggactcgcagaaagaggtgccacattctcagaaggggttccacgtgtgtgcgcgcgacgcatgaaacacagagacgtgccaaaccgcgtggaacagtgtggggcatacatgggtcgggccccacaaaaaagggaagaggggtaccccagtgcatggcaccacgagggacgtattccccggggggatgaaaagcggggggcggacaacttgtcaggggcgcgcgaacgcacaaccggcaattgataataagcgggcgagggaccccacggtactggtacgacaagtggtccgcgcttggataagaaacgacggcccacggggggttaaacccctgggggggaaagctcaaagtgaagaattgagcggggggagcaaaaacagcgccacgggccagagcaactggatatccggaaacggatcacatcggaactgtggtggaaccccaaaaaggggcgagagcacacaacaggggccatacaccaacgagggggagtcacacacaccaacaaggagaccatgatgtggaggcaccacaacagcaaaaagggaaaggcgtaggcacaccacgagccacaaagcaaacccacagccggacaggcagccttgcagccaaacagcgatgaggcacccggcaacacgggcggcgcaacggcgcaatcaccgggaaacacgaaggaagagaccatgaccaaccgaaagagggacaacacgcccaggtgccgccaacacggcgctaaccacaaccaaccgagcaacagcgcaaacaaccaccagcacgcacagatcatcacacacagcacgtggcccaccagtgtaccacccccacatcaacgagacaaggcacgaacgccgcgcatcactagacaacgcagcgcccaccaagacgacaaacacacccatactgaccaagaacacaacacacaccacggatgaagagga

SEQ ID NO: 526549 - DNA, 293 bp, Homo sapiens
gacacgacgactgggacacggcaggcgcggccttcgtagtcagtagttctttgatgtgaaatgggcagcacagtcatttaaacattgatccaaccatcatttgcatcttacacaagttaaacagactaaaagaccgtaaaatacagaaggcaatgcttgtggaatgtacagtgcatattggcggcgcacgcctcattacgattcgcctgcttgctatactcctgttcaatcgtatctttggaaggcagtggatttttctcttgcatctcgtctcttctcttgtataaagagaa

SEQ ID NO: 526550 - DNA, 756 bp, Homo sapiens
tccgagtagatagcaggcggggcgaagtaatggcttgagaatcgccttagtccagaaactgacatgcctctggagccaggcgacttcttgggaaactggtcatctcccgactcctaccctgaccagccctccgctcagtgtggctcctcagcccacagaggggagggagcatggggccaggtgccagtcatctgtgaagctagggccctacccccgcagacggagtggccccggggggcccccttgctagaggagcaccatctacagttgtgccattcccccagcacttggcttcatggctgccccgccggactggcagaagcatggtgtcagccagctgcctttgagtcatcaagattgctctgcagccacaattctgacctaacttgggagggcccagaaatcctgaaaacctcccgctgccttttgtgatacttcctgtgctccctcagagagaaacggagtgaccttttgtcctttacctgataggcacttcgcagtctatctccctgggtagcagacgggtagtgcccttctctgggcatgttctgaatgtttacactggtaccttctggttcttctttagagccccctgcaagctgcaatctaggctttatcagcggggccgagcgccctaagggaaggtaaagccacggtttgcggccaaatgtgcttaattgtttaaaaaaggggagctattcccgtcatgttctcccatccgacagtggttgcacgggccggagcgagtgccgtaca

SEQ ID NO: 526551 - DNA, 827 bp, Homo sapiens
  misc_feature (819)..(819): n is a, c, g, or t
agccaacatggtgaaaccccgtctctaccaaaaaaaaaaatacaatagatttagccaggcatggtggcaggcgcctgtggtcccaagcggctgggactacaggtgtgtgccaccatgcctcactaatttttttggttggttggtttggtgttttatagatgcggttctcaagactagccgtgggcaacatagcgagacccgtggtctctaccaaaaaaaaaaaaagagaacatgtgttccaggtgggcaagtttttttcctcggcaaggttccgtgggaagggattccggtaaacaatttaacccttaaattagctggcaaaaccaactcatctggacaacgaggggagggctccgatgatggccctgtgattatcccactaacgtgtaagtcccttgttctttaaccatttctagtgcacttcatctacaagaacacttattgggaactgcggagggtggaaaagtgccggttgtatgcaggaagcatcaaatcggtaaaaaccttggcgggagttcaccacataaacatgccccaaagttaagggtcccttacaagagggggtgtcaaaaaacactggctctgggtcttgggaactacgcaactggttccaaaccgcgctaatcgggccctctgggccaagtccccctctggacccaccaagggacgcgaatgagaaagagcacccgttatgccggagaacacgccgaaaatgatcgaacggaggcatggtattaccttgcataggagacgagacaactgaatctgagcggaggacgtatcccctcacacatctgtcaatggaagtgttattgagangaggggtg

SEQ ID NO: 526552 - DNA, 202 bp, Homo sapiens
tggtttcggaccctctgaggacttgctctcgtgtgagcgtcttctgcctgtgagcccagggggcaggcgtggctggtacccttaggtcctcccagaacctggcggatcgccttgctctcaggcaggaggcgatgcatgacgcctccaacttccgccaatatatcccaaggatggctgctttaactaaaacgcgtttgtctga

SEQ ID NO: 526553 - DNA, 851 bp, Homo sapiens
tacaaaaaccaaaaccagtttccatttttggatggggccccacccccgtgaacgtccgggggagaggggccccccaaagagcctttctctcggggacaaaatacaaagtggcgaggagagggctccatacgagaaaaaaaagcgtctcgtgaggctcctggcgtttttataattaaaagtgggtaagaagtcttctcggtggtggggccctcccgagcgtgggacaacgcttgaatgggccgaggagtctccgagggtgcccgaggtgtggtgaccctcagcccccttcgcccgtgaccaggggccgcgtgggcaaaagccataggcccgacaaaaaggcccggggctgtgccgccccattcaaacgccccagtggcacactccctgggcggaagaactggggagaagaagatgagagggggggaaaagggccgcagggggccaagtgtaacaagtatcccggagaaaatgtgctgggagaacccggccccacaggggaacaatcggggggagaacatggggcacgggggcctggggagtcccttggggggaaagagcaacatggggcgggtgtgggcgcgaaacagaagaaaaagagaaaacccgcgcgagagagaggggggcgcacgaacacagcgaagagcgccaaaaccgggcgagcacacccacaagcgagcacgcaccgcgggcgggccaccgccggggagcaaggagggagaggcccgagaaagcaggggagaaactccgaggaacagacagacggacaacaaagaaagatacacaacgagggcaaccgcccagaacagccagagcgcgctaagaaggaaaccggggattgacacgcgcacaac

SEQ ID NO: 526554 - DNA, 234 bp, Homo sapiens
caccgctgcacgattcagacgagccttccctagtacgagacggacccggagtggccacacctctggtgtatcggttgtcacgccagtggcacttgccgagtcgctaagtgtggaagagatacccgctgaaagcatctaagcgggacactcgtctcaagatgagtcttgccggggccttgtagccccctgaagggtcgttgtagaccacgacgttgataggttgggtggtatcag

SEQ ID NO: 526555 - DNA, 363 bp, Homo sapiens
gtccctcgctgggggcgacatgtgaggggaagaggcagacaacactcaatcccgagttacctttatgtctggaagacatgaatttcttcccccacaaggaaaactcgacctgacatagaagctgtatatccagggtgtgtatttttgttttggtttattgttgagacagagtctctttctgtcacccaggttggagtgcattagtgagatctcagctcagtacaacctccgtctcccgggttcaagcgattctcctgccgcagtctcccaagtaggtgggattagaggcatgcgctaccacgccatgtgtggtcagcagctgtgctgtggggtagtggcgatgtggaggtccccagcgaggga

SEQ ID NO: 526556 - DNA, 135 bp, Homo sapiens
agacaaggaagtgcaggttagtgctaatttaagaaggcctatactaatgtatgtgaaggtagctataggaactagttagtgtattcttaaaatcccatattgcaagccgttacactgtacctcgacttagtgact

SEQ ID NO: 526557 - DNA, 212 bp, Homo sapiens
cgacggtttctcgcgtgacctgacggttttactgtgtaactgtggtgggtgacgtgacgccccactggtgttgtggtaccactactgtacgacgggacgtactacagggctgtgacctacgtactgttgacgtcctagtaccgtacggacgacgtgactacttgtgactccacggacgacaccgtgagttacctacggcacccgacgaccgt

SEQ ID NO: 526558 - DNA, 367 bp, Homo sapiens
cgtgtggtcgtctagaggatcccatctcaggccaggacgaggaaggatgcatgaggtttttttttttggaaagggagtctcgctgttgcctaggcgggagtgcaggggcgcagtctcggttcacggcagcctccgcctccggggttcgggtcattctcgtgcctcggcctcccgagtagctgggataacaggcacccgccaccacgccgggttaattttttcttttttttttggtagagacagggtctctttatttggcccaggtgggtctcaaaccctgtgactcaagtgatgctctgtgcctcagtttcccaaagggtgcggggataacgggcataagccacggggctcgtcctgggccggagag

SEQ ID NO: 526559 - DNA, 571 bp, Homo sapiens
ggagccgaagactggcgtccagcggggggagcgcacctaccccaggcgtcctgctggcttcaaccggcccccgagccaagcccaagactgtgtctggagctgcttcagagagaagcggcttcaggaggcccgtgccaggaaggccacccggggcccggtggtgctcgcggggggcagctgctggtctcctctgtctgtgatcctccagccccctctagcacaaccccacacggccgcacagcccgggtcccacacgtcttaaattgtaccgctctctgggcctggggcacccgaagcagccaaagctggcacttctggctcctggcaagaggctgggacttcaggccaacggaccaagagactcatccaccatgcaagccctgacccactccggctcctgtctatctcagaggccgagggcacagaccctgctgattcccaagcccatgacctagggcaccggacaggatctcatgtgaggctgacccgagagtggactcgggacaagtctcagggccaccggatgactcccggaagcagggcctgcatgaggagacaaccctaactacgc

SEQ ID NO: 526560 - DNA, 297 bp, Homo sapiens
  misc_feature (18)..(19): n is a, c, g, or t
  misc_feature (34)..(34): n is a, c, g, or t
  misc_feature (38)..(38): n is a, c, g, or t
  misc_feature (44)..(44): n is a, c, g, or t
  misc_feature (50)..(50): n is a, c, g, or t
  misc_feature (63)..(63): n is a, c, g, or t
  misc_feature (65)..(66): n is a, c, g, or t
  misc_feature (69)..(70): n is a, c, g, or t
  misc_feature (121)..(121): n is a, c, g, or t
  misc_feature (124)..(124): n is a, c, g, or t
  misc_feature (129)..(129): n is a, c, g, or t
  misc_feature (132)..(132): n is a, c, g, or t
  misc_feature (138)..(138): n is a, c, g, or t
  misc_feature (140)..(140): n is a, c, g, or t
  misc_feature (155)..(155): n is a, c, g, or t
  misc_feature (166)..(166): n is a, c, g, or t
  misc_feature (176)..(176): n is a, c, g, or t
  misc_feature (184)..(186): n is a, c, g, or t
  misc_feature (203)..(203): n is a, c, g, or t
  misc_feature (244)..(244): n is a, c, g, or t
gattgtgtgtatgtatgnntaatataacatgacnggcnctaggncgtctncctttttaaggcngnnccnntaagggtttttgtttttaaacttttttttgccacccaccctgtgcaatatnccntgtanaanatttgncntaaaattcaaggccncaaaaacaatntttggggganaaaaaagnnnaaatcatgccagctaancatgtcaagttcactgcctgtcagattgttgatatataccntctgtaaataactttttttgagaaggaaataaaatcagctggaactgaaccct

SEQ ID NO: 526561 - DNA, 128 bp, Homo sapiens
gcggtgagccatctgatttcattgttttagtggaatatctaggtagcagaactactttaccttggctcctccgctgcattgtatatgctggcatagtgcttataaaaaaaatggcataagccaggtgt

SEQ ID NO: 526562 - DNA, 123 bp, Homo sapiens
gacgacacccacggtgtggcgaggcaggcagcgccggcgcctatcatcgcgagggccgagcggcggctgatgcccgtcttgcgggtctcgtcatcttcctctccctgaaccgggtttcgtttc

SEQ ID NO: 526563 - DNA, 237 bp, Homo sapiens
aggagagcttgccagggctctgctccccaaaagactgtactgacttagggccccccaaaactgaggccaggcctttatccagccaccctctttatcaagaaagccttgtcctgttcataggtagttctcaatataaatggatgttagacaaaaacacacagtaaataccactttaagaagaaacacatatagagtcctaataagagcttcttagtaaacacactggacaaagcccca

SEQ ID NO: 526564 - DNA, 141 bp, Homo sapiens
gcttttagtttccggagtctctgcaatggcggctctagactccctgtcgctcttcactagcctcggcctgagctttcttatttcccgcgagacgctcaagaactcggctctgagctctctatgttgcgcgaggccgctact

SEQ ID NO: 526565 - DNA, 349 bp, Homo sapiens
ttttccggtttcagaaaaaccccatgattccccttaattaaaacggcctggattggatatatatccccctatatatatatatcccagccaaggggaatggtggcttcctaaacagggcgggataattttgattttttttgaaacccctggggttttatattttttttgccgcccaaagggaggggcttataaagccctttttttcttttggtaacggtattagcaaatctttgggctttattatcccggggcccgttcccgttttatgtaggctgtgccctgcgccgcttttttaaagcccttggccaatcaaaaatggttctagcgggttttggatgcccttttttta

SEQ ID NO: 526566 - DNA, 461 bp, Homo sapiens
  misc_feature (206)..(206): n is a, c, g, or t
  misc_feature (254)..(254): n is a, c, g, or t
  misc_feature (313)..(313): n is a, c, g, or t
  misc_feature (319)..(319): n is a, c, g, or t
  misc_feature (333)..(333): n is a, c, g, or t
  misc_feature (336)..(336): n is a, c, g, or t
  misc_feature (358)..(358): n is a, c, g, or t
  misc_feature (374)..(374): n is a, c, g, or t
  misc_feature (392)..(392): n is a, c, g, or t
  misc_feature (410)..(410): n is a, c, g, or t
  misc_feature (451)..(451): n is a, c, g, or t
agcatggaatccctccctcaggcctctctggacggtgttggtgggggatcaagatgaacacactgcagacgaggacacgagccccacaggagctctttgtcccgccggagaccagcggacccacgtcagagaagatgcttgtatcttttcacggctcttctctgagaaatgaagccacaccacaatacggtctggaagaggaagcngggaatgggagatggcaacagtccctgtcactggaatgctggcctctntggacaagccacccttttggaaccccatcccttatgaccctggcagtggaacggtgatntatccngcctggccgccggngtntgccctgtcctccctcctgctntgcctcacctgtttcncaagtgcctcaatgcctntcgctgacgcccaatgtnttcaacaaagatgacttcccagtccgtcagggagacatttnttcgaaaaaa

SEQ ID NO: 526567 - DNA, 822 bp, Homo sapiens
gcgggggctgacatgtcgtcccggcctgggcgcgaggacgtgggggctgcgggcgctgcgggtgtgccggtgtgagccggccgggagcaggagctgcagcgacgtcgggagcagaaagcggggggacacgacgcgcaagcaagctgcagcaggttcaaggcacctggagtccttttaagggaaaaaactcctcgtgggcttatcagggacgatgacgactagagccgaggaagattggcatacccagatgtcccgtggcatttgaaacagggccagagggaatattttcgtggcttcagtgcaaccccaactaaagaggggacttgtggattgccatctggggggacaacgaacgtccaaatgttattgccaggtggttgggcggttgcgcaaaccggctatgggtccacccggaggggggttgaccaaaaaggattgccccttttcttttatcaagagggcaacccaaaaaggttacgagcagtcaagaggtggcacattgaaagatccctgtggttttgcctttcattacggaggacaattaaagcggactttgaaacggggcggtaggggactaccaagcagttaacaacccgttcacgtgggggagatcctaccctcagattgaagaatagggagccagcttccaatgtcccttctgaagggtacacgccaacacatagacaaactatcataacaacaacaactttttggggcgcgctgggcccgcaagaagaggttttaaaaaccatctgttggggcccggcgcgcccaatgtgggatggcatactgcgcattcgtgtcccaagggactccgggcag

SEQ ID NO: 526568 - DNA, 439 bp, Homo sapiens
gcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaatggccgactctccctctgaacttaagttccttcttttagcaggaaaaggcctttaatggaattgaaaaaattaagttaactcgggcatttttggctgtagaatccgtgaccctaaagttaaaggaatgggaactattcttataaacttgaaaaaaataaagtttttattttcta

SEQ ID NO: 526569 - DNA, 362 bp, Homo sapiens
ccagaggtatcccggcacagcacgcgcgtatcatatactttatacaaagatgttatatagagttcaactgtatacgattagagcatttattaaacctgttgtccaaagcgcttataaataaagcatcttcgaggcaggcggctcacttgaggttaggaggaaagcagactggccaacatggtgaaaccccgtctccaccgaaaatacaaaaaaattagccaggcgtcatggcgcacctgtagtcccagccactggggaggccgagacacgagaatcgtctgaacccgggaggtggaggttgcagtgagccaagattgcaccactgcactccagcctgggtgacagagtgggactctgtctca

SEQ ID NO: 526570 - DNA, 405 bp, Homo sapiens
gatctacaggatctgtcagtctgcacaggtttttcattggattagctttcaaaaaaacaacttttgctgaattgtgccccaaggttggacaatctgacactccttcaacaatgcggaaaaaactggtttggcgggaatgttgcgggaagaagccaactattccgaaaagaagttggaatgggcaatctggtaaccaaaggccttgggttggaattggggggaaaaggaaaagtggattggcgggttgctcaagccgtcctcctggctcatttctctccagggtgatgctgacagggacactgtctgaccggcagccgggtgaactccaactcttccggaactacgatgctccagaaactgtccgggagcctcgtttcaaccagaacgttaacctcaggcctccag

SEQ ID NO: 526571 - DNA, 203 bp, Homo sapiens
aggtggaacaacatcttttgcttctgacgtcttcattgtggggtatggtcttctgcagttcccaacaatgccccaggtccattctttttttttgttctttcttggtataattaagacagacacagggtctcactctgtccacctcaggcgggcatgcagcagtgtaggcactcctacaggtagctttgcacccaccaaatcgg

SEQ ID NO: 526572 - DNA, 238 bp, Homo sapiens
ccaggtagacctacccaggtagtgggtgtagagcttgaacgctttcttaattggtggctggttttaggcctactatgggtgttaaatttttataccaccatctacaaggttttttcctagaagtccaatagagcagttcctctttgagactaagcagctaaatttacaagggggatttagaagggttctgtggtgcaaatttaaagttgaactaagattctagttaggtctacctggg

SEQ ID NO: 526573 - DNA, 141 bp, Homo sapiens
cctatcgccacataggactcccaatgtctgtatggtgaatgttaagaactacggacatcataccatgaatacgatcagccataaatggacaaacctttacacaggcacaacttggaagaactcaaggaaatatgctgagtg

SEQ ID NO: 526574 - DNA, 107 bp, Homo sapiens
tggtgcttgtaactgtcacaccaacatgcactgacaccacttcaccaaccaccacccccagccctccaatcagcaccacaaccacccctccgccaaccaccactccc

SEQ ID NO: 526575 - DNA, 213 bp, Homo sapiens
ggcccttggctatgcccagcagcagctccagatccaccaggaacatgtggacatcccggtggaacacaactagcttagcccggcttaactggaacattttcttagggtcaggggctggaatcatgcttcccttcccggcccccaggaacccattggaggctacttccacataaaaagggaggcttcgggggtctttttcccccaacctgtcag

SEQ ID NO: 526576 - DNA, 711 bp, Homo sapiens
cagatatgaatacctcgggtgtacacgtgcagtaatattcaccatagtagcctctgacacagtgctatctatatgtgcacatggctataagcaccaatgtcatggcacgctaccattgaacagcctctatgcagaacatacatgatctacgcagttccaagtatccaaagtcaatgtccaagtgtccataaatgaactgcatgacacattgtaatgtagcatcttcgatgtacgcatcatcgcgtaactgctgccacatatactcatctcacgcattccctccacctcaataggcacatgtataagatgcatgtcagcttcaggtccttcatagcacaagcaatctgtagctgttcaggttcctccattccgttcatcaagatccacgcttgacgcacatggtatgctaatctgcgctctacaagacatctatactcatattccagagcacactctggtagttcagaagtacaccatgcgcctaacccatccaaatgtataatccactgtaacctcttatctacatgctcaccgagttgcttcggaccaccagactatgcaaggctagcccctctgcttacactgtaaaccacagtttacctggcagcttcatacagccccactagagttaagttcgagaccagagcgggttcaatgataactgctcaccgatctaccatattgatttcaggtccgtacgcagacactgcg

SEQ ID NO: 526577 - DNA, 433 bp, Homo sapiens
tgggctttatgggcctaaataacgctgaattataattagccccaccaataatgagaggtttattttttttttttggctcactccaaatcagcctggtaaggtatatttccttctacagcctttcctgattttgcatgttctcattcccaaagtagtctaccttagtttacactcaaaggtagcacttgttgaaactacatgacagaaacaggctgcaaaggtggacaaggggaagcatgtccctcttgtcttgataaatcagtgccacacacagaacccacattttctgagacattatcttcattatagagccgtttgattccatcatagaagtcatccacttccatttcctctactttgcgtttagtagaggtctgcttgcacccactggcagctgggagatgatggtaaaaggctgctgtacctctgactg

SEQ ID NO: 526578 - DNA, 1478 bp, Homo sapiens
tggataaattatttttatttaaataacagaggaaaggtgaaaccaacttcttcgacaaacaaggctccgtgaagcattgagcacgtgttgggctccgagggaggggacagaacaagcagcgggagttaagacgcccggcgcaggtgccgtgcggttccgtcctagaggaacatcaggctcgtataagtgtggggagggaaaacggggacagcagatattctgagcgaactaaatctccaggtgccaaggggaagatatttcaaaagcctcttgagaaagaagaaaccacccacaatgcagcgaagcagaagagagggccggggcagccaggctctctgtgaacaggggaagcgcggaaggtgcgccgcccgaagcctccgcgttacagcacctttgtgaagagggacattcacttagagacaacacgataatatacacaacatgtggccttgacagagaaggctcaagggggcggcagacgggggcgcgtgggacacggggggaacattttgtgggggtgacccttcacagccgtggtctactataatattttctcacgagacacaaaacaggcagccgagcacccacaatgtgggcgtgtgttgcctcacccaacgtggcacacacatgttgcacaagcccgtggcgtgaacgctcctgtggcgaggcaagtgcgggcgcacagaccaggccctttcccgtggcaattttgcggcagtggcctataaagaatatacgcgggggccttatagagaggcatacaggcttttcttatttaccccgcgaggacacaaatacaccacagtggaacccaattcttttccttcttttaacaaaaccacacgaagatgacttcgttatatgaaccaccccaaaaaaaaaccaccagaggggtacttccactcgacacggtacttcctggaacaacgctcgaagggacatacactcccgtggaaccttgcaaagaactgtccttttgcgcacgaaagaagggcggacaaccacggagggtcacggcggatgacagctccccacacggggggcccaaagaaaaccctttttctccaacaaaaagcgccaacattatgacccccctctgctgttccacgagcgggggctcctcaccaagaaaaccccacatcatgttggctctctgtgggcgcaaccatcgtttggacacccttggtaataacaacagcggcggcgacacccgggacaaacagatcaaacgcactgtgtgggaacaaataacgccgcggggcaagcaaaacagtcggcctgtcgcaccacgagcgcgctagcagcaacaaccgttctttcccccaccacaagagaggagggcgaccccccaagagaaagatccacccccatactaggacgcgacaacaaaacaggaggaacaccctacgccacacacatacactcaacgacgcacatagcagcaacactagttcgatcggtaggacggcgaccacgac

SEQ ID NO: 526579 - DNA, 255 bp, Homo sapiens
caggatttacctggagagctcatacccacagctagacaatatttcaggctttagcatacaactgtaaacagtgactaggttacaaaaataaaataaagtaagtggacttttttttttttttttttttggaaccggccaaatttcctaaaacccggggaattgaccaccccagggttggttgggtgggttaagggttccggacaaaagtattcggtgttaagggcagatgcccttgacattacaatgtaccctcag

SEQ ID NO: 526580 - DNA, 204 bp, Homo sapiens
cggctcctgcaacacgtagtaagtcctaaggcaagattccaagccaagcgcttcagcacataccctcgagcgtgccagtgcgtgagagcctcccctgcgaggaagcctagcccagaaacgcctcccgaaacgggtagtggccctggggcagaagcttccctggaagagcacaagaaggtaaacatgtggcagacatcttaccat

SEQ ID NO: 526581 - DNA, 99 bp, Homo sapiens
tgggactgtttggactctgggcactatttggactctgggcctatttgactctgaagcgaatctgcgattcatcaactgcggcgctgacatgtttgaggc

SEQ ID NO: 526582 - DNA, 439 bp, Homo sapiens
  misc_feature (122)..(122): n is a, c, g, or t
cacatttcgtgtcacatagggcgcaattgtgtgaaaacaaaacaatttggagctcgtggatttttgagccctgcgtctaccaccaaggcataatataaattgagttagattttgcaagtccncaaatgaggtcttgcaacagaactcccagccttttgacttttttcccctaactttagcaagggaggatcttgagccattaatttttgggttttttttaaaatccagaagggaaatagaacccttttcagatttttcatgtgatttgttcttgcagaggttcttctaacaaaaaccttattttcccctacagaaatttgtggcccaggcagatactgctgtatttaggcatttctatttcagttcattaaaaacggcaaaaccaatttggatcatggcccaaactgccttaaaataaatctacaggtttattgaatta

SEQ ID NO: 526583 - DNA, 286 bp, Homo sapiens
aggggcacaaaatctagaaaggtgccaaaaaaactcagtagtccagataaatactattttactgcaatattttttaaaaattgaaattagggcaaataaaatccaagataaacaaattttttttttttaattagctgggtgtggtggtgtgtacctgtagtcccggccacttgggaggctgaggtgggaggattgcctgagtccaggaggcggaggttgcagttagctgatattgtgccactgcactccagcctggaggacagagtggagcactgtgctcggccgg

SEQ ID NO: 526584 - DNA, 1547 bp, Homo sapiens
gcgtgagtgagttgatgtctttgctgtcctgctttcgtgccttctgtagttgtttcttgtgctttgtttcctgatacgatacgcgacgctggttgcctcccggctccgtctatcttgtatgtttgctcttcctgttcgcgactgtgtctgcgctcacagtgttctgtggttttgctctgtgctttgttgtggtccttttcggaagctctgcgttgtctcttgtcctccgttcggtggttactctgtgcctcgttctccgctcttctttcgatgtgggtgcgcccgccctcgtggccccccgacaactgtaatgcagtgcccccctgtgggttctatgaaaacaacccagttttatgctaccacctattaatacttcgaaggatcctacacaagttcgaccacaaaatagctcagggcctgtgtatatcctacggtccacgtgacctattcccggtcctctaaatgtatgctaatccacttgtgttgcaaaatttttcgccactatgggataataatggaataattcaggggcccccgtgttcgctgttcaaggacacaccccccctccaaagtggggccgatcacacccggctgggcatttgtgggacacacacgttgggaggcccccccgttctcttggggggtagatatatcccaggcctctaccagattcgtaatggccccccgggaccttgctttttatgggctggggtaaactcggcgcgtgtctaagacatccaaagaggttgtttcccccggggccccaatttgtgtcttgtgtgaacacaaccacgttggggtgtgtaagcctagtggacacccagagcccacaaacattggctaaaagtgcgcgcgacgcacaaggtgtttgggtgggatgttggtataaaaagaggcgccggtaagttatcactcccccccacatgtggggaacaatggggtgtggaccactcagacgacacgccacagagggacctaagatctgtcttcagcaaccgcctgtggggccgcccagttgcgcaataagttgggtggcaacacgcccacacagagggcaccacacgagtgtactgcgcgtgtgtgagtgtggagatagccccccacagctgttgcacgcccccgcggaatagaaaagattgtgtgaaattgtcactatagagtgagcaaattgtataccccacagctgtcgcacacgcccccactgagctataccacggaagaaaggggtgacaatctgtgtgtgggtgtgcgcgaagtggcacaccttgggtttggctaactaagtagcccggggctatcccctggggctccacagtacctgctggagaaagggagactaacaaaggacagcagcaaactttggggccccgcaaccctcaggtacaagtccctgcgctgcatccccgaacaagcacaggggcacacccaatgtggtgccttccaacccctccaaactatgcccacaccccccatgcctcctttccccgaccccggtttgctgccccagaaccctcccagacctcccaaagatgaattaagttttactt

SEQ ID NO: 526585 - DNA, 299 bp, Homo sapiens
ataactggtagaataactgcacagaaaatactgaagtgacattaagttacagatcggataagacagataacgtcagtatagctgcagtctcatcgtgaattagcaactgaacagtcattaacttaaagttaccatagttgaaagcaagaacgcacataacaatgatactcctaaatgtagaaatatttgattttaaaatacaatatccaggaacagaacatgaaatgtgaccaaattcctcaaaattctcattaccctacaaattatttaatttgcttgtacaactactacaaaatcag

SEQ ID NO: 526586 - DNA, 244 bp, Homo sapiens
ggctttgcagcccattcccaagtcctgtccagtccagggtggggcagggatcccccagggctgcgcggcccttccccagaaccagtcaaccgtcggcaccccaggatgtctacccaccacccacctgggcacccacgctgcagaccgggagctggtcagcattttcgggggactgcttgtcccgtgcccaggcctggaacatatctcccgtctcatcctgaaacggcccaagcccgaggcctct

SEQ ID NO: 526587 - DNA, 581 bp, Homo sapiens
  misc_feature (500)..(500): n is a, c, g, or t
  misc_feature (535)..(535): n is a, c, g, or t
  misc_feature (578)..(578): n is a, c, g, or t
ggctcggtaccgggtcagtacggatgtcgggcgatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatgaacttgcttgacaagtcncctgctcctcactatgaagatcactgtcccccagncctgtgtccccgcactgtgctgcacgtccacatccgtactggnccg

SEQ ID NO: 526588 - DNA, 240 bp, Homo sapiens
taaacgtagagctagcggccacacgtagatacattttaaacatttttttctttttgagacagtcttgctctctgtgacccaggactggagcgcagtagtgcagtatcggctcattgcaacctccacctcccaggtccaaacgattctcctgccttagcctccctagtagctagaattcacaggcacctgccaccgtacccggctaattttggtatttttagtagatacgaggtttcacca

SEQ ID NO: 526589 - DNA, 1496 bp, Homo sapiens
  misc_feature (367)..(367): n is a, c, g, or t
ggctcatagattcccactgcttaaacacagggtaagtctttgtggatgccaatccagcgattctcagctctatccgaatcggcaccgtgcccgtcgttgtaagcccctagggagtgctgactgacataaccgtttcgcctgggcatcgcatgatgacactccttgcaccgaagggagcgccctctatacacccggcccaccatctaccgatttatcgctactagatcatcgaatccgatcttcatgctcaactagccgctactgccagcttcctacatagtagtaacccccactaccaacttcaaccaaacccacatgagaggcgaacatgcaagcgtagtgccctcgcgttacttggtgatgtccntacgtcgccagcacgtgcgtgaagcacattactcgcgttcttcacattcgaactacgctacgtaggagtgcaacgcgtctcgtacgccatcagaaatcatcctggtatatggctcctagttccgacttctgctgggaagcttgcgctgggcgcgcgcccacggggtccttccaggtctgagggcgttgcacttcgcgtaagcgcagatcaatctcccataggcttagtcgagattcctctacttaccctcaaagcgtcgttcctcctgctatgtagaacctttggcctctgagcgcccatgtatctcagccggggcagctatagggcagcgagcccatctcctcgcaatataacctcgcttgtttgaatccccccggaaaccgcggagagaagcggttacattgatggatatgtaactcgttttcgccaaagcttgagttcgagcaagcaagcacaagctggaattggccccgcgtgtgccgtacccatatggcgccaggataagagccgcggaaagctttgcggaccggcttgagggtggcgttccccgttgccctcttcccaaaccatttactggagagtcaccgaacgcggagagagcccccccttttccgaagcgctattgacttgtgcgctcccacccctgtccttggcttcattggagcgataccattccccttaattgtggagagttccccccccatactagggcgaggatatccacactccccttttggggcttaagaaggagggccacattcccttaatttggagcgggcatttgtcctccccccctctgggaggggctatcttagcgggacacttccttttctcccgccgttggggcacatgggaaaagcgcgtctctttttttttagaaccctccctctggggtcccctcaagatgggaattgggcgaaggtcagctttcccgccccaggagtggtccggggtatcgagctcacccttcacagtgtgcccccctgctttactcggaagagaaccctttgtccctagtgcacactataatgtcgtcttgaaggggtttacaccgttgaggatggtgacctattgtgcgctcgcgtgtacccgcggtttttccccttttccccggggacttccctccccg

SEQ ID NO: 526590 - DNA, 573 bp, Homo sapiens
  misc_feature (567)..(567): n is a, c, g, or t
ggctcggtaccgggtcagtacggatgtcgggcgatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatggggttgatagaaaggtctgccgcggcaaacaaaaagatgagattgtgaaaacataaccaagagaaagggaaaaggaaaaagcggngaaagg

SEQ ID NO: 526591 - DNA, 649 bp, Homo sapiens
  misc_feature (492)..(492): n is a, c, g, or t
agcgggcttccgagctgggtgcgcgccgagcacaggagattgcctgcgtttaggaggtggctgcgtctgtgggaaaagctatcaaggaagaaatcgccaaaccatgtcttttttgctgtgttcagagtagttcacaacagatctgagtgtgttaattaagcatggaatacagaaaacaacaaataaacttaaggctttaactttcagtctggaccttccactagtttgcttagactccctggacccggttgacctgttggctctgtcccgctggactgctcatatcagcgatggctgctctctcgactatctcagccccgtagtggtgcacgagaccttcgggctcgcggtgtcttctgacgctgctgtggactggcctcgagctctctgagactgtcctgtccgacgtaggagtgtcagctgagactccctcaatagtggagccctccttgctgctggtcactcctgacgtttcttatgtgatgtggtacnctcagctcttccccactacgaatgtgactagaacgcgtgtaactgggatgtacttctatgagatatgagccgattgtacagacaagactttcacttcacacttcgagagcattcaaactgctctcatcaagaatccatttctggtcattctggtgac

SEQ ID NO: 526592 - DNA, 1314 bp, Homo sapiens
tttttttttgtggaaacgagcgaaaattaatttatattaaaaatatttgggtggtggtgagtttcttaactttctcagggtgacccatctgtggggacccatgtggccccacccaaaatgtgggcccatgtctctgggggcgcaggggaaaaaggggagggggtagaatatgagaaaaagagcccggtttcttctctcagtggctggggggtgttgggaagacaccacccctctttctggtgtgccctctccttcgtggggcctctcgagagaagaggaagaaccagaatgaaactatcttcgagcgcgcgtggtgggtttctctccaaccacccgagtggtcgccccgcagaggtgtgtgggaggggaacgccttaagagagatatgaagacaaagagggggcacaaggaggccaaaaaaagatgtaggtgtgtgttctaaaaaaagatatgaaaaacaccgggggggtgtgagggggctgtgaaaggggaaatatcaagagaataaaaatcaccggtttataaaacaaaaaaaaaaaagagagggggggggggcgcgcctctctatagagagattttctcccctcgcgaggagggggggccccaccaggatgttatataacgcgtggttcacccacgaggttttttttcgtgtgtactcaccagaggggtggggggcctcccctatatatgggtgagaaagatctgcgaatattattatatagagcctaaagagacacgtggtgcgtccccggctctgtttatcttcacacaaaagaggtgtgacgtgagtccgtgtgcggagaaacacccggttgcgtatacgactgtggggaggagcatctcctttgtggtgggagcaagggggggaccacctcttaataactatctcggtgggggggggggtggggtagcccaaccaattattctgttgtgcgggcccacaaaacaatgtattaccatgctcatcaagcgaggggagagtaatctttttaaaaaggggcgtctttcataaagaggggggtacactcttagtttagagaacgtcgttgttgtcacgaggggtggtgattattagcgggggggtggcctctaacacacaatcaaggcgctgtgggaaaaatatttgtgcagtggtagcagtggcttagagaaacaaaatcgtttctagggaggagcaataaaacgagggggagaaaatttgacaggatcattttgatcagctggagactcacttttgtttttctcagacggagatgatagagtattgatagtgagaatagacaaataataagcggagcgagaggggagagg

SEQ ID NO: 526593 - DNA, 721 bp, Homo sapiens
cgcaggtacttgggaggctgaggcaggagaattgcttgaacctgggaggtggacggttgcaggtgagctcgagatcacgcctacgtacactccatcctgggctggtggagtgatgaccctgctctaagcaatgaaataaaaaagagaaaacaaaacaatacaacgatgagatggaggtggactacgccgaaaatgaggtgagcagtctccgaggacgaggacactgagagctcgtcggactctccgaggatggcagatacgctcacgaaatggatgagtgaagactgtgaaaagaagaagaatggaatgtaatggatgaaatgtccattcttgaaaaaccaggtttaccgatctcaagagatcaactttgatcgaagaacgaattaagtcaggtggatgcaacaacgtacaagaagtcatagctggacaaagcaccagagattacttgcgaaccgctggcaaactttacaggaaaactatgccacattcgctacaacaggtcgccaggacatcctaatagagagctcgtgcttagaagtctgtaaacgaacaaatatgactgtgacaattcacagcttctcgccagcataggtgagagcgaaacagaggctgtatgctatatgataacaggtccaagagtgaaactatgaggaggaagatacgaaaggcttgaagaggataggcaacagaatagactattacctcagagcagcaggaatga

SEQ ID NO: 526594 - DNA, 326 bp, Homo sapiens
tgctgggaccacaggcgtgagcactgcaccgagccagaagttttgaatttttacgaagtctaatgtgtctgtttttcttttgctgcccatgcttttggtatcgtatccaagagatgattgccacatccaatgtcatgaagctcttcccctgtgtttccttctaagagttttatagtcttagctctcacatttaggtcttttattttgagttaatttgtatacggtgttaggtaagagtccaactttatatttttgcaggtggatatccagttgttgtgacaccatttgttgaaagactgtcctttccccattgaatggtcttgaca

SEQ ID NO: 526595 - DNA, 458 bp, Homo sapiens
gttagagcgggtatccggaccaccaccccacaccatagctcttagttcagaccaagtgggatcatctttctgcatggctggcaacatgttcagcagttcttcttctgctactgagtgaaatgcccaagcaaaatgacttgtagacaggcctgaagaaatgttaaaaatgatgtttataagaattataaatatgcttatatgattatcagaaatgtatgttccatattttcaatataaatgtgtaaacttctatgagactcacagtttaagattggaaatatgggcttttttaagtttttccttcttcaaataactgtatcactccaatgagcacatatatgttttgcaaaaatagcatttttttgaaaggaaaagaaaaaatgcttatggcaaattccactgtgctgatgtatttctgatcctttttaaaaaatgagtaacacttaaagcattatttt

SEQ ID NO: 526596 - DNA, 398 bp, Homo sapiens
aaaaaagatatttatgaaataaatggtaatttgtgtaaataagctttaaggttcccagaatatgccaattggtattaatctacctcccagccacaacaaaagagtagacataaatttagagaataacatcaaacatttaaaacattttttcattttacgtgagcatctataattgtacagggctgggggggcccttggctgcgggaaaaggcccagagccctggaggagccaccaccccgccggccccttgacccctcggcccctcggcccctccgcccgggtttggctcgcccggcccgcgggctccacctcaggttttcacttttcgctccgcagcgagaacgaaacgacaaaaacgcaagaaaacaataaaacgctagaaagcgaagtgaaaaaa

SEQ ID NO: 526597 - DNA, 612 bp, Homo sapiens
  misc_feature (408)..(408): n is a, c, g, or t
  misc_feature (511)..(511): n is a, c, g, or t
gagttttagtaacctgaaatgttttttttaagtgcttattcatttagggcagttagtacaaactcaggtttttttggagttgtgcttgtactcaccatcatgtaattgtgaagtgaacaaatacatcactgtgtggcatctcatgtcgtaggacatgtatttgagttgacaataaatattaaatgactgtgaaagaatgatataatgccagcacggagaagaaataccacacagagttaaattttgcatataaacgttggcaaagtgctgcagtaaattaccgttttcttcataatatgaaattcctttgcatggtgcaaaggaagacctttttaagcaaagagtaatctctggaattcagcattaagactctagttaatttcaggattttgttggtattgctgttgntgcttgttgttgctcctttgcagggaaccaaccataagaaattccttgtgcacaacacgaggaagtttacaagttaattaacatttccgttcactgcatttgntttaatttatattgcttgcaattttgaatacatctggtagctctttttgctttgcggtacctcttaataccgtataagtactttctttttatcaggatgcg

SEQ ID NO: 526598 - DNA, 447 bp, Homo sapiens
taaaattctaacttaaatgttttgatcctcaagctaactttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaatgtgctacagcctaaaatctgcttgttcaaaaaaaaaa

SEQ ID NO: 526599 - DNA, 205 bp, Homo sapiens
ccggaaaggtagctgctactgtataggtgaagtaaatccgttctgtatagcagctgtagtagggtcgtaagtaagtgtcattccagcaagtctcacctctccttctctatgccagggtctatccatatagggatgtatttgtttggggttctgtctctattttctggtcctaccatcacgcacaacttacacaagtaaatggttc

SEQ ID NO: 526600 - DNA, 957 bp, Homo sapiens
  misc_feature (607)..(607): n is a, c, g, or t
cccacgacggtaccgcccttcgtaggcccctaagggttaatataacctatcgttgacgccataaaatgtcttcaccaaagagcccctataaaccagccacatatacacatcagcgtctagatccaccagccccgcaccttgagtctctcaccaatcgtcgtctgtctactatgaaccccccgtccccgatgatctgcaaccccggtgggtgcgtacctcgaatacgtgaagccgtcctactgtatcgcgtactataccgtcatatgctgataccgctaatactgtcatctcaggtcatggattccagaggtgtggagccttctcagagtatcactcagagaaactgtacggctcctgtgtgatcagtgcagtcaactgtccacaccactcataggcctctgatgtaatcactcgtccagtatgtgagcgatctacctcgttatgcaattctcactgcatactttactttagaggattgtacttacaattaatgatcgcgctcagcgtgtctcacagcgatctttcacaaaccccagtgtgtagtctagcacattgattgacagagaacatcacttcgatggcactctacgtcacatgatcggatacnataagtacaccctatgggaagaagcgcatacattgtaatcgatatgtaaactccttttggctaatcacaatacagtcgtcagagacgacgcgtaattggaaatatctcgcccccgttgttgcaagccatttagcctgtaaagggggagcaaaagggccagttattctattagaaatccatctagtggcgtgtacatgcgcgatactcgaaattgactctctcggtgcacgggtcaccatgcgcatttcgtggctctctacgtctacgtgtccatgtagtgcacgaattaattacacatctataaaaggagttttttcccttgaggctataaacagacacaccagtacacc

SEQ ID NO: 526601 - DNA, 631 bp, Homo sapiens
tgccgctcgtatcttaggacagaggcgggctttcagactccagaactcaactcgcagctctctgaaaagtacgcggatggaacgttccaaagccatctctcactccctcccaatagctagaacataaatgttgtgtaaaaaaaaaagagaaacacaaaaaacgggtcaggcataccacctgccacctcagcctagggaaccacatggacatattctagtgcaacactcaaaatacaagcccaaggtgaaacttgctgggagggctcccatacgccaaaaatgtggtccgtcaggttcaatctggctgtggaatcgttctgtatggagtctcgttagtccgaggatcagatacaatttaggaaaacgaaatgtgggtgattgcctttactctggtctcgactgctagacgaatcacgtactgactggccctaagaataaggacttctgaagccatgagtccatacggaacgatcccttgggtttcctttgcttaacatcccatggaatactgccaagaaaatctctagatggaggagccaattgctgtggtctcttcagtctattggctcggcctccatctctgtccctgccttccacacacttccaagaccacaggggaaggaggagccaa

SEQ ID NO: 526602 - DNA, 227 bp, Homo sapiens
tggccgttactcgcaagccggtgatctccgagatacaggcatcttccttgacttgatgcatctgaagaaacctgggcgtgctttgacatatccttgttctacagagatatcatcagcataggagagtgatgatgtgacctcatgggttcacttatgatggaatccaagcaatgctacgaagcacctgattgcgtgaagtgttctgcgccaagtgagaccagtgaagc

SEQ ID NO: 526603 - DNA, 169 bp, Homo sapiens
ttgtgttgcacttttagcaagaaagacattcatattccaatggtgtagtgttgattgagtcctgccatccttatcaacagttacatcattgaggtgaccaaaattgaaagtaatgaatcagtgaagaatccttacaggaacatcttgattaatttcgaaatgtctgtca

SEQ ID NO: 526604 - DNA, 301 bp, Homo sapiens
  misc_feature (50)..(50): n is a, c, g, or t
caataacttttcaaggggcctttgttaaggaaattatatccccttaattnctataatatataaggctttatgaaaagccctttataaaattttaatttaaaaggtcaagaacttaacccttatttttttattcaggacagggggcctttatattaagtatgtgacccagtataaaatccctgaagggtatcatgatttgattgtatcctggaccaagactacttcccttgaatgctccaagatttaaaagtagtatgacatgttctccctctaaaataaactttttttttttttttgagga

SEQ ID NO: 526605 - DNA, 732 bp, Homo sapiens
  misc_feature (128)..(128): n is a, c, g, or t
gtatcttattctaaaggactgaattatttttgtatacagacatacatacagaataaaaacatgtacaactctgcatttatagtctgtttgcatttcaaattattcatcatcattgggagtcagatacnaccctgtctgcctgtattcaggtttcttcattttgcatccatcaaccatgcgggttgggttcattttcgcagtttggcagttgcagcaatcttcatactaacataatcccagtgggcagcacaacaccaactcccagtcatatatctagcacctcagcgcaccacactgtgcaaacatctcttcagcgtatcatcacgcaaatcttaacagttccggcagtcacagcaccttatagcaacgtccatcacacttttcatcaacaatattcctccaactcacagcataggcaatcaggtatcattagtcgcaatcttaaacaacgtacatacttgcctactaaacagtcacactttcgacaacggggacggcctaatgctagggaatcacaccacgtctgacttccacacattgcccacacgacaacttggtctgccagaggccataagacaagagcccaaaaatagaggaacatcaaatgaggaggtaatgaaccacagcccagtcggtcaacaggaccctttagaccgctcaccacgtcatacagagtctacgtacatgggttccaggggcaccaatccggggacggaaaccaaacgccactaa

SEQ ID NO: 526606 - DNA, 683 bp, Homo sapiens
gacagctcggacgctatatgactcgaaagcaacgcctcgccatgccgaggcgcgctacgacaaggggattggtgatcggcgtactatccgccaggctagcgatatgggactgggttctgataaactcgtagctgcccattaccgccgaccctgccaggctgccgatactctggctcgccccgtacaggaccacgagcgtgatcatgtactgaggtcccttcgcgaacagtttgaggaagccaaagatcaaggcaggcccgataaacagcgtcgcaccgaacccaatcaaacactggctcgggtacagttgcggcgcacgcgtgaggctggtggattgcgagtccagatacgctcccgttgcgataaacaacgccgcgaccatgacctgccaggggatacgtatgggcgacaacgtcaggcaagcgacgacaatccccattagcatcgacaccagtacgcacgcaaaacaggacacgcaattgatcgttattgagcccgcccattgatagcaaacctaccgagccgaaagtctgctcggacagcgatagccgaaccagcagcgcaatcgcaacaaaacgcatcaagtcgaaactgcccagccattccaattgcaacagcggctgacgccgacgtcgttcaatgaacaccaccgtcaccagcaacgagataggcgccaccagcat

SEQ ID NO: 526607 - DNA, 163 bp, Homo sapiens
cacatggggtgttggaggtagatgggctccggcgggggcggcggtggatgaggcgctgggcagaagcagacgccgattccagctgccccgcgcgccccgggccctagcgagtccccggttcagccatggggacctctccgagcagcagcaccgccctcgcctc

SEQ ID NO: 526608 - DNA, 414 bp, Homo sapiens
  misc_feature (175)..(175): n is a, c, g, or t
  misc_feature (180)..(180): n is a, c, g, or t
  misc_feature (185)..(185): n is a, c, g, or t
  misc_feature (190)..(190): n is a, c, g, or t
ctggctcaaaggaatggtacccattatgattcctgatacttaaactcttatatcagacaccaaggagacctctgtatgtatccggaatgctaagggtcctctcattgattagggtctcacaaacggggtgcagagaaatgtgtgtgtgggagggttgatgatggaggggggtgtncaggnttggngtttntagcttggcacatacggacaggtgatgtttgagctgcctgaaagagaagcatgatgcttacgggaatacagtttccaagaagtgatgatctggctccaagctcattcttcagttggatttcaagttgcaacgcccatgcttgaataagcactgtgaacgagcattcaaccaacggaatacatgtttcacctgcagggatttgttagcatgcagcagatgtttgt

SEQ ID NO: 526609 - DNA, 314 bp, Homo sapiens
cgtcgaccggggtttcaccatgttggctaggccggtctcaatctcctgacctcaagtgatccgcctgccttggcctcccaaagttctgggattataggcatgggccactatgcctggccataggtcacattctatatgataaaagatgacacaaacaaagcttaaaggtatgaaacagatggagagaagatacaacatggaaaacagatggaaattagtatccataaagtatttttaaaattcctgtgaatatgaaaatataataatggacaagacatataagcaggtaacacccaaaaaaaaaaagtcgacgc

SEQ ID NO: 526610 - DNA, 152 bp, Homo sapiens
gactctacaggatccccatgtatagtccactgaggggcagagctcggccagcagagagaaaggtcatctaccctgacaggcaggccgattctcccaagcacatttcacctttgttagtggcttcttgccccctccctccccggcgatacagt

SEQ ID NO: 526611 - DNA, 247 bp, Homo sapiens
caactgcttgggatgggattaaaaataggcaccaagccgcggtggctcatgcctgtaatcccagcactttgggaggccggggcgggaggatcacttgggggaaggagtttgagaccatcctggccaacacggtgaaaccccatctctactaaaaatacaaaaaaattagccaggcatggtggcgggcgcctgtaaactcatctactctggaggctgaaataacatgtgcccaccaccactttcatcc

SEQ ID NO: 526612 - DNA, 193 bp, Homo sapiens
gtttactgggcagctgttacgctcagattccaaattgataattgtttgaagaagcgcttgacttctacaagcaacaaggtcctgggccgggtcttttgggcctggaaatttgttcctcgtctgcgccaaatcccgagacacacggagggatgggtgcccacacatttttgggtgttttcttcatgtctccttt

SEQ ID NO: 526613 - DNA, 173 bp, Homo sapiens
  misc_feature (15)..(15): n is a, c, g, or t
aaataaaaaataagnacccaaccaatgctacagataataagagctcagtaaatgttgattgaatcactaacaaagataaaagcagacgacacagtacctggcacactactaactgtaaatgttttaaaattgaatctgtaaaatttgtaaggttttatgaatataatattatt

SEQ ID NO: 526614 - DNA, 353 bp, Homo sapiens
aaaaagggtatttattaaaaatagattttttttccttcccctcccccctgcgagcaaaggggcctttcccaacatcttttcccaaatggatgaaccaggtcttggggcccccaatgtggctttctccataacctcccggacccggcttttctgggccagggggtctgctgggccccagaggggacccgcccaagacaccatcagcaaaccctggcccccctaaccccgggctgccttggatcccgggacggcctggagtccctcctgctccagggccaatcccacaaagagagaccccccggcccaacagcagcctcctgggcccccccagaaagcggtgtccttaagggcct

SEQ ID NO: 526615 - DNA, 125 bp, Homo sapiens
gaccgtgatgttacgcccacactaggaggggataaaataagcattgcaggaacttatttgtaaatagcttcctcacctaaactttgacttgacaatcaatactttctactttgtgttggggataa

SEQ ID NO: 526616 - DNA, 671 bp, Homo sapiens
  misc_feature (359)..(359): n is a, c, g, or t
tcagcgtagatcatatgttgcttgccaataaagacagcatcctttcaatctgcaggacttttacttctctttcatgccttttccagtggttaagaccttcagttcaatattataagtggcaagtgccttttttcctgatctgaggaggcaattcttgtgatgctgttagtaagagtgtttcctttacctctatttcttacttttctttttttcttatccctcccttcctttcttccttccttccttcctttcctttcctttctttctctctttccttctctttcttttctttctttctttctctttctttctttctttccttccttccttccttccttccttctttctttcttcctttntctttctttctttccttccttccttcccttccttccttccttccttctttctttctttctttctttctttctttttctttctttctttccttctctttctctctctttgcttatcattctatcctctttcctctctctctctctttcttctttctttttctttctttcctttcttctctccgctggtagatgccctttattttcttgttctgctgagagcttttatttcttaaagccatgtggttttgaatattgcacgccttggataacttattgcattttcatatacacgcatccatacttcctggtccc

SEQ ID NO: 526617 - DNA, 104 bp, Homo sapiens
caccatgtgcggcaaaagccgaaggagtaaggtgctgcaatgatgttagctgtggccacggtggatttttcgcaagaacattactaaactaaaaacttcatgtg

SEQ ID NO: 526618 - DNA, 98 bp, Homo sapiens
ttgccaatccttacattcctgtactgtgcatcgtgagggccagagacaggaatgtaaggattgtcaactgtgttaccattctgatgttggagcgggcc

SEQ ID NO: 526619 - DNA, 472 bp, Homo sapiens
cttggcagagcagaaatacatatacagatgtggagccaatggggcctagaaaaagccatcagcattaatgaggatagcaggagtggcggtagtggttactgattaaacacccttagtcagcccagccctctttcttccaaatctggaaacactagcctctagaggagctggggaaagggcggagaaacaacgtatttgaagacacaaaatggtttaaatgtttgtagatcacctagctggtcagcaatagtcaggggtagaagagaggactggaccagatgtctgcctctgagatgatgggacgtcttaagcaatctcaaccagaatgcattttttattaggtcagaagtccttgacctcttttaagtcccaatgcctctaaatgatttggaggggaaactttggccccaggtcgtactccatcacaagggttcacttcatcacaaactccagatggccacggacaggtcac

SEQ ID NO: 526620 - DNA, 423 bp, Homo sapiens
  misc_feature (371)..(371): n is a, c, g, or t
taatctatgaatctctcttactaatataagcgaggagaaatccagactaataactgctacgatcttttgtcatgcttacttctcatggtgttacctgattatacctctttatgtgaaagccctgttagggaatgctcctggtgtaacctatgtcgcgtttcaagttggaacttgtgctcgcatcctgagatccagaatggtcaattggcctggtttgattgttttcccctaatatcctgggtgttaaattctatccaggcttactttgaagatattgcgagtttggttccagactactttaataaagcaaataatcgcaataaagtgagtcacacaaattttttggtttctcagtgcatataggttatgtntggcccttatcgagctcgataagggccaagttcattggagctggggctgcca

SEQ ID NO: 526621 - DNA, 360 bp, Homo sapiens
gtgctggacttatcagatttgagaaccagtatcacattttcctaataaaatgcattaggtggtcaggtgtggtggctcacgcctgtaatcccagcactttgggaggcagaggtgggcggatcacttcgggtcaggagttcgagaccagcctggccaacatggtgaaaccccatctctactaacaaatacaaagactggctgggcgtggtggtggacacctgtaattccaagttctcagaggctgaggcaggagaatcgcttgaacccaggagacggaggttgcagcgagctgagatcgcgccatagaaacaccatggaactccaacctgggcaacaagagtgaaacttcgactcaaaaaa

SEQ ID NO: 526622 - DNA, 83 bp, Homo sapiens
  misc_feature (51)..(51): n is a, c, g, or t
  misc_feature (57)..(57): n is a, c, g, or t
tgcaaacaaacccgggtaagtatggaacaatgtgtaagtggggttatcacnctttgntgtaaaaatttctattttgtgtattt

SEQ ID NO: 526623 - DNA, 840 bp, Homo sapiens
ctttactttggctagcgagcgcgcattgttggtacccgggatcggccatatggccgggggtgaaaaaaattaaaaaaaaagaaaaaaaacaaaaaaaaaaaaaaaaaaaaaaaaaaaaaaaaaaaaaaaaaaaaaaaaataaaaaaaaaaaaaaaaaaaaaaacaacctaaaacaaaaaaaacctataaaaggggggaaaacaaaaaaatgaccaaaaaaaaaaaacctttttgtttttttttgccccggggtttttttactttagcaattttttttcttgcccccccatttcgccccccttttcccctttccccctttaaggggcctttttccaattccttgcccccctttttccccccgtgtttttggaaaacccccttgtttccccccttttttcccctttgaaccccccccccttttccccctttggttaaaaagaaagggcccccccccaaccccccttcccaaaattttccccccctttttgggaaagggaaatttcaaccctttttttttttctaaaattccggaaaaatttttcgaaaaacacccttttttttcccccctttccccgacccggcccactcccttttaaattaaaatttttaccccaatttgggtcggggttgttccccgttttgacccaaagcccctttttaaaccccttttccccccggaaggccaaaaacccttttttggggggttgcccccccggggccccccccctttacttttttttggggaggggccccaaaacctaattgcccccctatggccccccttattacttcctcggacgccccccctccctattggggcccttccccccttcgccttct

SEQ ID NO: 526624 - DNA, 109 bp, Homo sapiens
gcacatgtgctttttatttctcattaaatgccagagggaaaggcaattgcaggcgtgtagtattccgacatttcagcgtgctgcactcctgcccttctgtcgtcttctc

SEQ ID NO: 526625 - DNA, 281 bp, Homo sapiens
actgtaaggactgccctatctattccagacagaattactcttccatgctgaatacttgtgtgaaatatcgttaaataattgaacattccttgatcacttcttaacagtgtcaaaactggggtagaagggatactattttttcccacaagggtgccatctttgctatctgtggatcagccttagaaaatctaagtatgatcaataaattttaatggttgatggcatcctgtgtcagctggagtagttggttgtgaatattaaaacctagtactattttccct

SEQ ID NO: 526626 - DNA, 294 bp, Homo sapiens
ggacccttaggacatgatggggctgtagctctggggacggcacaggtgcagcaaggaccggctcctctcactggggaacgaaacaggccatcccgcaaggagccttcacagcacgttcttgattccgtgggcagtcagatatctttcaacgcagctggttaggcgggactcacacatggcagcaccgagatcaatgataagtggggcagagagccgaggctttaggtggcagactgcgaccatttgactggactcttgcgcctttgacgtttattcttgaccattgtggccgac

SEQ ID NO: 526627 - DNA, 111 bp, Homo sapiens
acgacacacgcaataacacagcacacacaaacacacagcacacacatgcacacacaagtacacacactcatgctgcagaacatactttaacacagctcgcactgcggccgc

SEQ ID NO: 526628 - DNA, 121 bp, Homo sapiens
gtgggtccaaagaagacgcccctagatttgagagctgttctcctgcctcctcactgggctgccttgcgagtaaatcttttctcttttacaaaacctgtcacagtgatggatttgattcgcc

SEQ ID NO: 526629 - DNA, 307 bp, Homo sapiens
agatgacgcagataacccaggagttcgagaccagcctgggcaacatggcaagacctgtctctacaaaaagttaaaaagattcactgggtggtgtgcacctgtaatcccagctacctaggagactgaggtgggaggatcgcttcagcccaggagttcatgcctgcagtgagctatgattgtgtcactgcaggctccggatgccgggttctctagatcgtctctataatgccgagaaccccaagaggtgaatcagaaaccagtttgactgctcaaatggccattgttataatgctcgtggaaattgtct

SEQ ID NO: 526630 - DNA, 153 bp, Homo sapiens
acatgttgtgtatcatgggtaacataagtcgatcacccattgcagaagcagattcaggaaacttgtaaccgatcaaacatctcagagaattgggagggtagacagcgcggttagaggtgagggcgcgattagggtacgcggtacagggtgagg

SEQ ID NO: 526631 - DNA, 331 bp, Homo sapiens
ggctcgagcggacagcgtctgaatatggtgaaggcaaaaagacgctgctttggcattttgtttgcagcacacagaagtttacatgaagtacaacaaatccttgcagtggtgaaaactgacatggaaagtggcctaaaccaggtctaactaccaggtgattgcagtagcctggcacaactggccaaagtgtaactcccacagatacgcgcggatccttatctttgaaacacaaagcgactggggctacgattcatcaagccattggacagcttcataatgcagcatcccagaatgaccggccgaacaccgtagacctatcaaggtttgatgt

SEQ ID NO: 526632 - DNA, 290 bp, Homo sapiens
gagcagtgacggaatcatggctcaccgtaaccttgaactcccaggctcaagtgtttctcccaccctagtcttctgagtggctaggactacaggcatgtgccaccaatacctggctaatttttcttttttttttttagagacaggggcctcactatgtggcccaagctgatctccgagcctgatctgcctgggcctccaaaaaggctggaaatacaggcgtgagccatggcaccgggcaatttatttcctaagtgttctcctttttttttcactaatgcggcacctgaatc

SEQ ID NO: 526633 - DNA, 1616 bp, Homo sapiens
  misc_feature (775)..(775): n is a, c, g, or t
  misc_feature (923)..(923): n is a, c, g, or t
ggcaccgatggtcggtcggctgagaacaagcgccgttacgaagaggcggcaagaagggagaccaagagagaaacgtggttcgatcgcgactgttcttgagagggacagagagttcgtgctagtgagtcgtgaagacgtcagcacgttgctagtgcttacgactagtagagcagcactattcgcgcatagagagcgcgtcggtacaacagggagccacgggaaccatgaatctggcgttcgtgagtggctctcaaggggctccggtgtggtattcgaaaggtcgagatctctgctcgaattgtgccatgaactgaatgaacgattgaccagtttcagcacaaagttacaaagcgtgagtatagcatgacggaatgcttccgaagggggctgaaaacacaggtgcgcgtgcgacgttgacacttatcgcacattgggacggatcggggagtcatttagacgcactgttggcgacagtaggcagaatggtagctgtcccagatggggttcccacaggagagcaccagttgcggcacagtcacacgaaaagtggagtcttgcacagcgaccgttctaacgcgtattcgcgcaagtaggctccgaaagcggaaccctaaccccaagaaaagtagaggctgaaacggtaatgggcacttcgtcgggggcggtagattatcaatggatgcccagtcgcggggtagtttgtaagccctaataggaaagacatatcggcgggaaataacatattattccataggaagatgagcgcggagaacanggtaaaccccttccgttatcaattagatcgcttcccaggtctaaacacaaatagactaggggacttcacgcggctcccgagatatgttcacagcgggaacaggcgacaagtgactgacacttgtggcgacaaatctcccaattgaaangaccctgagaagaaaagaggttggccaggcaactagaagagttggagcgcttttgagacaaaattgggacaaaagcttgggcttacacaaaagttactagacctgtgtggacttggtccccgaagggagcccagtgccaaagttttttgcggcaaaaaaaaacgcacccagtttaggcgacgcaaccacgggccttttggctctcgaaaaattccttgaatctgttcaagttgcccattgcctttcaacacttgggaaagttgttcgtttgtgcccgcattttaaggggaaccagccacttggttcaacaacactacacaagttgtgcgctcgcaagagcgaaaaaaaggccgccccaaagaagatttctttggacgagagttgtggggggagacaaccggccgtcccaatttggcgcagggcagtttccccgtttggcgttttttcaagaaccgcgggacaagggaatcagcattccctttggggcagaaaagaccggccgccaactcggaggatgtggaacgccgcaatgacaacaccaaggtggtgtggccctttagaaaaggtttttgaagaaacgcggacagccccctgtggaaatggggggacaacaaatcgaaagagtgcccaacacccaagggtacccagagaaaaagcccttgctgttagagaaggttcacacacactttccat

SEQ ID NO: 526634 - DNA, 132 bp, Homo sapiens
tgccgtctaatcaggatcacaagtaggaactgagtattctcaaagtggatcttctagagtgtagtgtcactccaggcaaagattattcagttctcatcccctgcatccactactacctattagaactggctt

SEQ ID NO: 526635 - DNA, 679 bp, Homo sapiens
  misc_feature (629)..(629): n is a, c, g, or t
tagtcttctcacatagttgctagaatgtggtgtaacatctgagtctgcacagaccaggagaagcacgcatcttcatcagcaaaggccccttcgatctggacttaaattcacctctgatccaccaaagttgatattaacaatcatcaaactactactctaataatagtgtgagcttgccacgttactcgtctcatgcctattccacggcactggtcagaggtatatatgcttttaaactagccgaatgtgcaagttctcatggcatcctcactctgcaaacattcaaaccacggtttcataatgctatgagtgttccatcttcttctaagaggtcctgatctggagcatgtgcttcaaattccgcgttagagctgctcgctatggctgctaagctcacttcagtagagggaataaagccattctgttcagactcatagcttagctctatctgtgttgatgactccaggctctcagtattaggaacagctttttgaatctgctgtggcactccattgtcttcaatgataatgtcatcttcttcgctgtcttcatcctctggctcgcttgggtcaatctgctgtgggtagccacgaaggctgttatcagtagactgaccggaactgccagangtccgactgttctcacaacattattcctctggtttgcccgtctcctgttt

SEQ ID NO: 526636 - DNA, 624 bp, Homo sapiens
ggattacaggcgtgagccgccacacccagccattaatacgttttaaaagcccactgccctccggcctgggcgagagagtgagtctctgtctcaaaaaaacaaccaactaaccaacacccccgtccaccaaaaaaaaaagaaaaaaaaaaaaaaaacttgtttgggcggccatgggcccttggaaaaggtttttagaaacaatttggttgtggggcggggggccccagaggggttaagttgaaacatgtgtactaagtggttcccataggaagaaatcgcgggtactggaacataaggtggtgggatttcttacagcaaataacaaaaaaagccccgggggggaaaacaggaagaggttttggaaaaaaaatctccagaatgtgggaagtttcggaagggctcattacagcgggcatacgacaccaagggagatgtcacaaaggagaaagcgcccaagattatcagaaagtaagaccgcccccggcccgtggagagaaaagaaaagaagacaagaaagaacaagaaaacaaaagcaaagaagaacaaagagaaaaacgaaagaaagcagagaagcacagcaagagagaaacagagcaaagaagcagaaacaaggaactgccacag

SEQ ID NO: 526637 - DNA, 1148 bp, Homo sapiens
  misc_feature (230)..(230): n is a, c, g, or t
  misc_feature (1148)..(1148): n is a, c, g, or t
ggtgggagtctcgcttcgtacagaggacaagtttgtgcttcggtgtccagtgtgttactttggagtttaggatgccagtatcctgaggttttttttgtcatcgtgtttcgtttctcctctgtatttaatagtttgcatgtgctttgtaaccacgtgtgtgttgagaatggaccaatcaccaaaccatccctggggaagggggacacgggataacatttaacacagattgntgagtcaggattttgccccaaaatcagcccaagggagaagaggaactggagttgggaaccaactaataggtgaccccgcagtaaatctctcgttagatgtgacaggggtggagtcagacatcgcagacactggagactcttggtgaagcttgttgggcgtagcatgagcagggacatacagagggagagacggagggggcatgtagaccttaggaatcaactcttaactagactcgcttgggcaggactcggtaggagatacgaatatcttcccttgtcagcaagacctaactctatactaggggaatcacattcaggtgtatgttggaacaaggctaattctatgacaacaggaacttccctttggttcccgcgagaaccttttcattgcgtagagatccttccttaatcagacatacacaggggggcgatttaaacaaacatatcctcttgggaagaatggtaaagggcatccattgttgatgtccgtagaatagttattggcaaaaaataggcagaagggctggccaattccaagcactactttaagaagaaaggcatcccccctaaaaggctccatggcggaagttctccagatactattggagactttgggggcctttgcccgttgggcatagggatcggtgccaggggtaattggcgagaggagaactgagcgttcccaaagcagcatggcgttcacgtgtcaatgtgcaagaggagaacagatggttcaacagacactagttgtggccccaaatatttcccaaatcggtgggagttctcattagtggaaacacgggtcctccttagtagggaccattacatgttctggccttggggatatcccttattcgtatgaagaaaataatcacaccgatagagcaatgggacaatggcaagccttgacaagatcgn

SEQ ID NO: 526638 - DNA, 1563 bp, Homo sapiens
  misc_feature (167)..(167): n is a, c, g, or t
  misc_feature (195)..(195): n is a, c, g, or t
  misc_feature (397)..(397): n is a, c, g, or t
  misc_feature (626)..(626): n is a, c, g, or t
  misc_feature (661)..(661): n is a, c, g, or t
tgatcactatccccttaagaagtcacataagatagtgagtacagacgtgcaacaacgcatctcttattctaccactagtcaggtgtccttaggaaagagcagatagaattatctgagttgcgacagtcccactctaacttaagccttgagcctcattcattgaaatncctcattcaaaactagcccgcgagtgcncacttccgtatcagacacaagaataactctagttgcacataattatgcgatgaaatgggagtgttggcgcggcactggcgaagaggcggctgcgcttgtgcgacacgttaagtcgcccttagcgtgatgcttcttgcgaaattacataccctagacaaacgacttagttagggccgctttgaagaaccgttagcggttaatncaatcacaactcttgaaataatacttacgcttctgatagtggcacatactatatagcatgaaactccaggtccacacgataaccataatttgattgaatcttaacgttcaactctagcaattgtgacacactcgaagcgtatctaccccaagaaacgacaacatctaccaattcaaaatatatagccatttgccaatatcagcgaagagcgcaaaccatccatccaggngcgccttagatacatagtgtgccgctagataccantcgcactctacgtaaaggtaaatgctagtggttagatctccgagatagtaacaatatctagaacaagacctcgtgattatttcatgcccctagattgtaacctctgcgaggacacgttattctctccggatgccacgcaactctgcccccttatacctagggacccctccttaaccatcaacactaaggtggtgctggtatggcaaaataccccaatcggataaatctctggttacccgcgcttggtctcatcaaccaatcccactatggggggcaatcgccccaaacggttggcacggcacctaatcacttttcaaacgggggcgcccacgcacacagaagcaactaactggcacagcgcaccaaattcgtgcttttcaccccgtggcattacgtttcaatagcccttccagttttccatccaactcttaaaggcaaaaaattatttgcgcgtctttaaccttaaactcccccctgaattttaccaacggtggaagccaatttgtggatcgctcccaataccattccttggggttattggggtccttgtgggttttgccaccaaaaccattgcgctctcgggttagtgtccccacgagtgccttttagagccatttgtccattttgtgctcccggagtgggggtcgttggggccccatggtccaacgcacgggtgtcccggggattgcgggcaacggggcgccatttgggtgtaccccaataggcttgagcaccggcagaaagtccaggggactccgcgattacccctaaacataaacaaacgtagctttcccaaattttggaaacaagaccatttggctccattgggcttcctcccaacggatatgtctgataacacaacttttggagggataccagcgagaaccggtcacataagaaga

SEQ ID NO: 526639 - DNA, 307 bp, Homo sapiens
gtactacagcatatagattaccccgtcatatgatcatgtacgcgtatgtagttaccccagctgcttcatttagaacccctgtacagttctgtatggaaaccatcccatagtcaaggacactttaaatatatagtctaaataccgttaaggtaggcccacaagctgtgttcacatttccccttgcccaccttaccaggaactttactaacttgggaacgtgaaaacaacaagctaacccacatgttcaccatagaaaacaatttaagtcttgaaaaacaaggactcttacacccgtcactctgccaaa

SEQ ID NO: 526640 - DNA, 240 bp, Homo sapiens
tgcaggctgaacctgaccctaggtggactcctgctctctgccatgcccctattctcatcccctggttccccactgtcctcgtgggtctctcccgctctgctagaatctcgctgagggattggtggggagggggtggtcactgcactcgggtggagatctggtgccccctgaaggccggacaggaagggcccgggcggacaaggtctttgagaactcggatggaatcccgctcctgatggc

SEQ ID NO: 526641 - DNA, 211 bp, Homo sapiens
ccctcgactgccgacaggagagcgggaggtctggcgggagtggaaccagcaccggccagaaggggctccgggcggtacagaggccaatgcattggaggctgagtggtagctgcgacctctggggcaggcgacactgctgtgtggagcccagggtgggcgcccacatggtttgcctggccgcgggtgtgtctagcctttcttgtctcttgtt

SEQ ID NO: 526642 - DNA, 893 bp, Homo sapiens
gacacaactttaaatgctaagaaaaatagcagaattgtaaatggggaagactgtgacaaatatttagacttccatgatgtaaggggctgaaagtctgaaagtaggtgaagaatacagacaacaagcactatacgatgggtagcccatggcttaagcctcaaaaaaaaatttttccagagtcacaagaggatgggagaggagcagtctgcaagcagccgtaggagcaagaccttgagacgtgtccatcaatgctacgatagattctgctttggagatcaacatgctgtatatcacaataatgatgggactcacggcatggaggatggacagaggagctttctcctggagtggtatttctggaatttctagtgtcaggtgctacttaatatctctcacaagaaaagaagaaatccctctgccttttaatgttctgggaatagaaagaataaaggagactgaaggtgaatccaccaaaggagtatagcaatttctattgtctccttaatagtccaacacttcactcacacaacaaatgttacgtagtttcatccaaatgatgagtccagggcccctttcttctgcagaaaatgtcagctcactgcttctgctacaaaatagaaattagagagatccagctttctaggccgatacaaatactttgataatcgtaaaatcagctttaccaattccatacgttccaatggtacttaaccggtgtgcttcaggatcccagggcacacattttctaggattccctagccatgggtgggtttagccggaacaaattggggtgctccaaagtcattaggctgtgccccggtcagggccccgtaaaaaccttagtggggatggtcaaaatggtgctgccgctggtcgtcaggcagagcagtctg

SEQ ID NO: 526643 - DNA, 736 bp, Homo sapiens
  misc_feature (1)..(1): n is a, c, g, or t
ngtgttcaacttgaaccctgtgaagatagattttcgagcccaacgcaaggccccccaagcctttgtcgttcagtaagacagggatcaatttttgggctgaaagtcctattatcaagcatcaaatgttccctctggtggtctaccaaagtggttggcctacatcagaacccgggtgaagggcattatttctcttgcaggccgagatctggtgtgaaagcattccatataactcctggtacatactcaagaccatcgggtatagtctacagtaggtccctgggttttttcgtgcccccatacgtaagccttctgatcaaaagtgtgctctagtgaaggcaatgttcatttatttccttacactcggacagttttggccaagagtatcccaattgtagtagggtttgcctggcagtatcctatctggttgaccaggactagattaagtgtcatatgatgctgcagcccatgttcccctcccagaaggaaccgtttcgtgtagtgtttatcacgggttccacaacccgaccgtacctaggaatgtggtgaacgtgctttccgcttttggcagcaagaaggcgcggggtgttgcacatgtgatgttgaacctataatgttatgttaattcagtgactggtacagttattatgatcgaatcttagcacatatagaccgattatttaaacccttgtcctctactacgttactaactctagggtaaatcttggtcagctaaaaa

SEQ ID NO: 526644 - DNA, 111 bp, Homo sapiens
cagtaaagaaacagaatactggaatcgttagagaaccctgagattttaacagcataactcattccctcttccacctttgtactttatccaggtcaacacatcaggtcgacg

SEQ ID NO: 526645 - DNA, 107 bp, Homo sapiens
atgatggcccagggatggcggtggcacctccttggagcacttcacacccagagcgacgtgtacattgtagtccgcgatagcaacaaatgccgtgcctcgttacgctt

SEQ ID NO: 526646 - DNA, 299 bp, Homo sapiens
cccgtatcctcacagccagcaggtgccatacagaaggagacagaaacggagtgaccgccgttaatgtgacgccctatgaggagaacttgaactacatgtcactgggtcacgttttgcctcatgaacactggccgccactggataagaatgtatatcaggctttaacaataggtatttcttccagtgatgttgaaattaagcttaaaaaagaaagattttatgtgcttgaagattcaggcttgcattaaaagactgttttcagacctttgtctgaaggattttaaatgctgtatgtcatt

SEQ ID NO: 526647 - DNA, 1262 bp, Homo sapiens
  misc_feature (572)..(572): n is a, c, g, or t
agctgcagcggctcggcgcggaccccgaggcggcgccggcctccgcctgcctcggccccggtgccccgcgcccccgtgtctcggctcccgcccgctgctgccctccagcaccgccgcggagaacaatggccagcccctgctgtgtggacagcgtgggggacctggtggctggcagcagcttgctgtgtggggcactgggacccttggctggctgcgggtgcctggggagccatgctgagcggcgtggggctggctcctggtgtcggcgggtggcgcggcgcccccggaggggtgccattatctaacgcgggtttaccgtactgccgagctgcggccaacggagacgttgaagcccggtggtgtccaggcaacgcctttttgcgtggaactttctttgattgccagcttggaaccgatttaccacgccttaaccgaatccccaagaattgccagttgaacttgggtttaccttaaccttggaaacccggtggctttggcctttctggaagagccttccaggaacccgcgagcgcgattaacttttccgggcctcaatcttcccttttaagcgnttgccccaagcgagacattttcaattcttccagggaacttagtgtggccccaaggttgaatttgcccgccttatcagggccaaactttgccaaacaaaaagttgcacaccagggcgcaacaccgggggccctttcccgtgtggcacaagcgcccttcccgcggggtgaagggcgataaaggaaacgccaaaaggtgggaacccctcgccaaagaggtttacgcccgcgcattctttaacaccgcccgattggcgcgcaacggggacacctttgtgaaaacgcgcgccgtttgagccccatttccaagtcaccaaaaggtatatttgagacacaatttcacacctgtgttgcaacaatgcaaaaagctcccggacaaaccataaactttttccaaaccccgttgagagacccaaaagcctcgaaaacctgctttacacaattggtttacccctttaaatttcttggtttccccccaaatgggttttccccaccaaacaagtaccaaaggcccctgtgaattattctcacatctatacttattatcagcctttttaaactttgtggtttggacacccaaactaactacaagcactgctacacactcactcatgaataatactctatcaccacacatgcagcagcggtcatgaagcacgatgatccatcacactataatactgatactaaccc

SEQ ID NO: 526648 - DNA, 813 bp, Homo sapiens
aggaatgttggattttattgaaaaattttttttgcatctaattgagatgactatatggtttttgtttttaattctgtttatgtggtgaatcacatttttttatttgcatgtgttgaaccaactgtgcatcccaagaataaagcctacttgatcatggtgaattaacttttggatgtgctgctggatttggtttgctagtattttgttgaggatttttgtgtctgtgttcatcatggatattggccgaagttttctctttttattgtgtttctgccaaattttggtatcaggctaatgcaggtttcatagaatgaattagggaggagccactcatcctcatttttttttttaaatagtttcagtcggattgataccagttcttttgtgccagtggtagaattggggctgtgaatctgtcgtggttcaaaagtttttgggcgggagggttttattactgaattccactcttgagtcctgccggaggccggttcacgttttcactttccttccctggtttactattagggagttcgcgttgttcccaggaattggtttccatttcgtctagattttcctaagttgggcgtgcactagaagggtgtgtccataaataacttccggaagggaccttttgggacttccgggggggaaccacgcttatccatcccgttgtcaatcccggaaaggagcacaattgggaaccttccctttttcccccctgtggcgcatgttacctaggcctgttcaacctggttgatctctctgtgaaccattatacgccttaattcaatggacacctgcagtgaatggggc

SEQ ID NO: 526649 - DNA, 188 bp, Homo sapiens
gacagagtgagagcctatctcaaaaaacaaaatgaaacaaaaaggttctcttattctggtgattttttgtttattaggttgtcgttgcttccgcttttccatcattggttattttccaggattaggggttattaccttaggcaggttttatataatttacaattactgtgattcaagcattataaact

SEQ ID NO: 526650 - DNA, 773 bp, Homo sapiens
  misc_feature (187)..(187): n is a, c, g, or t
atcgactttacttcagattgtaaggaagtgtgctattagaggagtacactgcattctctcaccaacaggtctccagtgctcatttggtgggataagtgtgtggccacgagatgaagatggtggtgagtggggaatatgcttattattctccagtataaaaatgtacgcgcacttcaaactttgcaangtacacggtacctaagagctatgacttggtcgttgacttgggtcactctgcttagcgcctgggagggcatagatcaggtcaaagtcctctcgttacttcaatgtctaatacataatagattagcaccatggagcctcaggtgtcaaatggtccggacatccaatgacgaagcaatgggaccctccagcaacaacagaaactgtccgttctgcccatgctaaacaggggtcgaaccacagatgacagcaaaatcaacctcatcgtcaagctatttaccccagaatatgacccgaagacagaatctcagggagtctcttcgaggagcgatctggtcgaaatgagaatcctgcgaaacttgtgagagacaaagattactggacagagtatagggtatggattcgttaactatattgatccaataggatgcatgagaatagccatccaacactttcaagatggcactcagactccagaccagaaccatgaaagcctattaaactgcagggaagtgtctccgtgggcgctcttatcctcatcgagagcaggtctgacgcagagtaggacaaaagagaaacctctccccaga

SEQ ID NO: 526651 - DNA, 343 bp, Homo sapiens
taacagagatttgaggagagttagtgaacccaatgggagaatttgatttatcggtattatcaaaaacaatggttacgcttgccttggtaacacctgcttgaccacgcttatagatcaaatcttgcaggctagatgctcgcacagtgctcattgatgctataccgagcacgaagcaaatggcgtccaaaatgttcgacttaccggacccatttagacctgtaatagcattgaattgagggtcccaatcagtaatgactgttcttgtagcgtatgatttgaaaccatcaataatcaattcctctaccttcatgcggtaacgatactaaaattgacttgtatttac

SEQ ID NO: 526652 - DNA, 135 bp, Homo sapiens
gcagcggtggcgacccgaggaggcctgggcactggaagaaagcaagatatttctgtctccctccccggctcaggtttcgcccttccctttcccttcccggtggacaatcccgagcttcaccgtcaaggccttttg

SEQ ID NO: 526653 - DNA, 825 bp, Homo sapiens
  misc_feature (15)..(15): n is a, c, g, or t
  misc_feature (63)..(63): n is a, c, g, or t
  misc_feature (73)..(73): n is a, c, g, or t
  misc_feature (92)..(92): n is a, c, g, or t
  misc_feature (113)..(113): n is a, c, g, or t
  misc_feature (118)..(118): n is a, c, g, or t
  misc_feature (141)..(141): n is a, c, g, or t
  misc_feature (159)..(159): n is a, c, g, or t
  misc_feature (213)..(213): n is a, c, g, or t
  misc_feature (216)..(216): n is a, c, g, or t
  misc_feature (221)..(221): n is a, c, g, or t
  misc_feature (236)..(237): n is a, c, g, or t
  misc_feature (244)..(244): n is a, c, g, or t
  misc_feature (254)..(254): n is a, c, g, or t
  misc_feature (256)..(256): n is a, c, g, or t
  misc_feature (269)..(269): n is a, c, g, or t
  misc_feature (274)..(274): n is a, c, g, or t
  misc_feature (278)..(278): n is a, c, g, or t
  misc_feature (302)..(302): n is a, c, g, or t
  misc_feature (304)..(305): n is a, c, g, or t
  misc_feature (307)..(307): n is a, c, g, or t
  misc_feature (319)..(319): n is a, c, g, or t
  misc_feature (327)..(327): n is a, c, g, or t
  misc_feature (331)..(331): n is a, c, g, or t
  misc_feature (336)..(336): n is a, c, g, or t
  misc_feature (342)..(342): n is a, c, g, or t
  misc_feature (348)..(349): n is a, c, g, or t
  misc_feature (352)..(352): n is a, c, g, or t
  misc_feature (354)..(354): n is a, c, g, or t
  misc_feature (363)..(364): n is a, c, g, or t
  misc_feature (380)..(380): n is a, c, g, or t
  misc_feature (383)..(383): n is a, c, g, or t
  misc_feature (402)..(402): n is a, c, g, or t
  misc_feature (430)..(430): n is a, c, g, or t
  misc_feature (434)..(436): n is a, c, g, or t
  misc_feature (438)..(438): n is a, c, g, or t
  misc_feature (448)..(448): n is a, c, g, or t
  misc_feature (471)..(471): n is a, c, g, or t
  misc_feature (490)..(490): n is a, c, g, or t
  misc_feature (531)..(531): n is a, c, g, or t
  misc_feature (535)..(535): n is a, c, g, or t
  misc_feature (556)..(556): n is a, c, g, or t
  misc_feature (565)..(565): n is a, c, g, or t
  misc_feature (567)..(567): n is a, c, g, or t
  misc_feature (579)..(579): n is a, c, g, or t
  misc_feature (585)..(585): n is a, c, g, or t
  misc_feature (589)..(589): n is a, c, g, or t
  misc_feature (628)..(628): n is a, c, g, or t
  misc_feature (634)..(634): n is a, c, g, or t
  misc_feature (637)..(637): n is a, c, g, or t
  misc_feature (645)..(645): n is a, c, g, or t
  misc_feature (680)..(680): n is a, c, g, or t
  misc_feature (730)..(730): n is a, c, g, or t
  misc_feature (820)..(820): n is a, c, g, or t
ggacgagctggccancaagctgagccggcggctgcagatggagggcgagggcggcggcgaaancccggagcancccgggctgaaaggggcancggcggcggcggcgggggcanccgangaggcggccgaagcgctgggcancgcggactgcgaactgancgccaaaatgctgcggcgcgcaaaactcaaaaaaatcatcggcgaaccccaatngcncaacngccgcgtcttcaaannctaaaanaaattcaaananttctccaagaaanaaaanaaanaaaaggaaaaaaagttcaaaaaanannangccgggcggganggcttcancaanctganggaacnaaaaannaananggaaaaaannggggcccctcaaaacnaantgggcctgaaaaaaaaaanaaaaaaagtggataaagaatttgaaaanaaannnancttccggganttcctcctgatcttccgcaaagnggcggccggggagcttcangaggacaacgggctgtgcgtgctggcccgcctctctgaaancaangtctccaataaaggtgtcaanggggccaanancttctttgaagncaaagnccangccatcaacgtgtccagccgcttcgaggaggagatcaangcagancangaggaaangaagaagcaggcggaggagatgaagcagcggaaancggccttcaaggagctgcagtccacctttaagtagcggggggctgcagcngaccgccctgctctggccccagtgtggtgggcgagggtggcgcatgggaggccgagcctgaatccttgcctgtgtctgacgggacactantaaaa

SEQ ID NO: 526654 - DNA, 252 bp, Homo sapiens
  misc_feature (190)..(190): n is a, c, g, or t
  misc_feature (202)..(202): n is a, c, g, or t
gaggatccaccaaccatagaacggccctactaatgaaccacacaagctagttgcaccactatagaaacacaaaactacacatctataccaataaaaataacaactactccaattgcccatgtggtattgtcgcagactgaaatgaattatgaatttaggttggttaccaatatcggcataaaataaactntgtaaggctcantatgttgacagtaagctcttgtcaggtgtctaatgaggtaaaagcatttt

SEQ ID NO: 526655 - DNA, 382 bp, Homo sapiens
gtgatctagaggatctcatctgaggagcctttgggggaacactagagctatggggaacttgaaagaagattttaggactttggagaaaaggtgagtcccaaagacataggggttgaggaatacagagaggagagagagagggagtaccagtgagccaggactataaaggacctatttctttttcctcaactccgtcccttagttttctcctcagaacttaaaggcaatgctggcttcctaagcccgtaaacccaggggcccccagaaagttggctgtgaatctctcatctgaattgaaaaggctacatcagggcagattgtcccctaaaaaactggaaaggtgggtatgggggtaagtttcggacacatgcatgcacccagg

SEQ ID NO: 526656 - DNA, 197 bp, Homo sapiens
atacacctcttttatgcgcgtagtttgacatttaattgggttaaaatttaatccctccggtgtgtttgtgtatgtgtctgtgtgtgtgtgtgtgtgtgcatgtgtgtgtgtgtgtgtgtgcaatgaaagaacatacatacactaattctccaaaattcctatgggtgacttactcaacagtgtatctctgaagcttc

SEQ ID NO: 526657 - DNA, 160 bp, Homo sapiens
ataataatcatcctgtgattcatcgtcatttgctttgtacttatatactagaataaatcgtagcccatggagtatattagtaagtattcagagacaagtttcagaataccaggtaagccatgatctcttggaaagtagtatgtcccatttatagtgaaca

SEQ ID NO: 526658 - DNA, 830 bp, Homo sapiens
ggaattccgggtccccagaaacacaatctgggttatatttaaaaattttggcgcgtcgttcccgaaggtaaaagaacgatcgtgtgcccccggacagtattgtatggcaaaagaattctgcgacctaaatttcctgcgtccataattattgggcgaaaaaaattgatattgcccatattattgagggagcatgtactatttggagtcccgccacctcacggtcgagcacccgatctggagttcgctactccctcttcgaagaagggtcttatttccacccactccgctgtcacctagctgtggtcgtataaaagaccacccagatatgtaatttctgccttgtcgaaactttacaggtggttaatatcaaccaagacaaccgagtgaactcattgtgggcccccgccaatattattaaatggaacaacttattttctggcgggaatcctccttgtattttcaagacacgtcggccagatgaagtatacttccccgcgcgctatgtatccaaactggaacttcattcgccccctagacgagggtggcacaaaagagctaataaacttgctgacagtcccacggcacataatttgtaaataaccctgggtcaattcccactcagataccacaatgtaagccccctaattgtcattcaaacattcccgccgccataaagcaccactctgtgatgatccactctggtgagaaaacacttcgcacgaatctctgggattggtccaggattgcgccacgttactcacctcctcctcctccatgaaaactccgcaatttttttccccaaaaaaaacatttcaacccccaaacaaaac

SEQ ID NO: 526659 - DNA, 287 bp, Homo sapiens
taggttacagatgagccgagattgtgccattgcactccagcctgggtgacagactgagactatgtctctaaaaaaaaaaaaaggattaagctgtaaggcttctacactaccttgtatttcaaatttttttccacaaggcttttatattcaaaacagtatgacatttgttattaaaattggctacttagtaccagttggaacagtagacccttagaatatgattccacgcattttacagctcaatttgatctctttgacaaagcccacggatcaactccacggggaat

SEQ ID NO: 526660 - DNA, 395 bp, Homo sapiens
taatattcttttatgcttcagaagttgatattaatctcacctattgggaagctaagcacaataattaaaaaatacactgctgattgtctctgcttatgtaaagaaaacagtgtccttgcttaaatggtgtattgcgatggggctatgatcgttcagaaagtcatgaatgcttaattctgtaccaagcccagtggaaccagttagttgaaactgactctttgcatatgtgacctaatctctgccttattatcagaatcccagaaccatgcaaatggggacagcacagcaaccctgcagattcagccaattattcccaaacagatcatccaactgtctaaaaaataccaacttttgtaatagcttgatctcattgctcctctgtatagatcaggtac

SEQ ID NO: 526661 - DNA, 783 bp, Homo sapiens
cccacgcgtcggacaaggccacccagacgcccctgtcctggcaagagctagaaggtaggagctgaggatggtgtgcacggagacagtgtccgccgtccatggtgacggaggcatgagcgaacgggaaaacgcagagtgcgcacagtgtgaagagcgagaccagacatgcagcggacgggacgaagcgcctggagagcagcacaggggcagagagaggcagagcggagacggaggcggacgagcgcagagctgccctaggggggcatgcgagagagccagcgagacgagaggcgagaccaacggtgcagcggagagaatgccacacatgcgccgagaggtcacgaaccatcacacggcactcacccagaatgcatacggacaaaaccaacaagacgcaccagcgagggcgtggacagaccagagggccaggaccacctgagaagaagcgagcacgacaaaccccacaatcacacgccgtagggagccgaccgggctcaataaaggccatcgaaaacgagaagacgaggagaggaccgacacacgacagcggacgaacactgacaaagcacagaggagatcgcaatactgaaattagagtcccaccaaagaaaagaagaggcgacaaaaaacagaagagaaaacaacgaaagagacgccacggacacaaaccaaagaaaagaataggcaagacgcccaaagaaagaacagcagaaaaaacacgacacagtacagatacacagacacgcgaggaaaggcaccaaagggacaaaacaaacaataagg

SEQ ID NO: 526662 - DNA, 142 bp, Homo sapiens
aattaatttaaagatcatgtgattgcctaatgatatgcaaaacaaaaaaaaagctatctttcctttacaatctatttgctcaggttaaccatttagttgctaagagaaaccttctccatgaaaagagtattgtgttgggtga

SEQ ID NO: 526663 - DNA, 384 bp, Homo sapiens
ctactgattgcattgtacctctttccctgatgggagcaagacgcgcgcatcttctcccatcagcattactaataagtggctcctttaacctctccacccttatcacaacacaagaacacctctgattactcctgccatcatgacccttggccataatatgatttatctccacactagcagagaccaaccgaacccctttcgaccttgccgaagggagtccgaactagtctcaggcttcaacatcgaatacgccgcagccctttcgccctattcttcatagcggaatacacaaacattattataatacacacccccccactacaatctccgtaggacacatatgacgactctccctgactctacacacatatttgtcacagccta

SEQ ID NO: 526664 - DNA, 377 bp, Homo sapiens
ctgtgatgatctcatcgccatgcatgttgacagtgcgagtctgtgttgccgtcagctgcgattgttgattgggatgtgacatttatctaaagggttcactgatccacttattcacgaattacagggtctcggaaaccaacaatctcctcatccatgactaatacgctaaaacatggggctcaattcatagttttgcttggggtgacactggcgaaattaaatcatcaatgtagttcccaaatttaagtgcgtcatgtgaaaacaaaggactgtggaatgataatagtgtaatctataattgatttcttgtacatctgtactttagtacagaaaggaagccaccagcaatcaacatattgccaatcaacatactggat

SEQ ID NO: 526665 - DNA, 191 bp, Homo sapiens
agtggagaaagctgcccagggaagctgatcgttatccatgggaaggcaggcctgtttttagaagggcagatccaccccgagctggaaggagtctccattgtcatcagtgaaaagggggcaagttcaccgctgatcacaggctttactgatgacaaaggtgcctacagtgttggccccctgcacagtgacct

SEQ ID NO: 526666 - DNA, 190 bp, Homo sapiens
  misc_feature (14)..(14): n is a, c, g, or t
  misc_feature (51)..(51): n is a, c, g, or t
caatctctggtccngtagtgcctaggccatctgttgcgaataagtgcgtantcagcccatgagttttcattactcgtagaggattcattaccccctgtggttcattaccccctgtttttgggaggtgcctctgatgatttctggcgcggtgttgagtgctctggagaagagggaaacgtttcatagtcca

SEQ ID NO: 526667 - DNA, 362 bp, Homo sapiens
  misc_feature (320)..(320): n is a, c, g, or t
  misc_feature (345)..(345): n is a, c, g, or t
tgaggtcgggagtttgagaccagccaggccaacgtggtgaaactccgtctctactaaaaatacaaaaattaggccgggcacagtggctcacacctgtagtcccagaactttgggaggccgaggcgagcggatcacgagttcaggagttcgagaccagcctgaccaacatggtgaaaccccgtctgtactgggaatacaaaaattagccaggcatggtggcgggtgctgttaatcccagctacttcaggaggcttgaggcagggagattcactttgagcccaggggaggcgaaggtttgccagttgagtttgagatttgcnttcacttgcatttccagcctggggncggacaaagcgagattt

SEQ ID NO: 526668 - DNA, 2134 bp, Homo sapiens
agaaggaaagttcctcaacataacagaagccatttatgaaaaatctacagctgatggaggaatattttccaagcaaatggaaagcaaaaaaaaaaccagggattgcaatcttagtctctgataaaacagactttaaaccaacaaagatcaaaagagacaagggcattacataatggtaaaaggatcaaagcaacaaaaagagctaactatcctaaatatatgtgcatccaatacaggagcacccagtttcataaaaaaagttcttagagacctacaaagagacttagactcccacacaataatagtgggagactttaacaaccccgtgtcaatattagacagatcaataagacagaaaattgacaaggatatccaggacttgaactcagctctggaccaagcagacctaatagacatctacagaaccctccaccccaaatcaacaaaacatacacttttctcagcaccacaatgcacttattctaaaactgaccacttaattggaagtaaagcactccttagcaaatgcagaataagggaaatcataacaaatagtctctcagaccacagtgcaatcaaattagaactcaggattaagaaactcactcaaaaccacacaactacatggaaactgaacaacctgctcctgaatgactactgggtaaataacgaaatgaaggcagagataaagatgttctttgaaaccaatgagaacaaagacagagcatatcagaacctctgggacacatttaaagcactgtgtagaaggaaatttatagcactaaatgcccacaagagaaggcagagaagatctaaaatcgacacactaacatcacaattaaaagaactagagaagcaagagcgaacaaatccaaaagctagcagaagacaagaaataactaagatcagaacagaactgaaggagagacacgaaaaacccttcaaaaaatcagtgaatccagagttggttttcttgaaaagatcaacaaaataaataggccactagccagactaataaaaaagaaaagagaagaatcaaatagatgcaataaaaaatgataaagggaatatcaccaccgatcccacagaaatacaaactaccatcagagaatactataaacgcctctacgcaaattaactagaaaatctagaagaaatggataaattcctgtacacatacaccctcccaagactaaaccaggaagaggtcgaatccctgaataggccaataacaagttctgaaattgaggcagcaattaatagcctattaaccaaaaaaaagtccaggaccagacggattcacagccaaattctaccagaggtacgaagaggagctggtaccattccttctgaaactattccaaacaatagaaaaagagagaatcctccctaacttattttatgaggccagcatcatcctgataccaaaacctggcagagacaatagaaaaaaagaaaatttcaggccaatatcactgatgaacatcgatgtaaaaatcctcgataaaatactggcaaaccgaatccagcagcgcatcaaaaagcttatccaccacgattaagccggcttcatccctgggatgcaaggctggttcagcatacacaaatgaataaacataatccatcacacaaacagaaccaatgacaaaagccacatgatatttacctgtatacctttttaagtacaaataaatctgggctgtcattatttatgctaacactggttttgtgtccctggaatctatctatctaagtttttttttctttttttctttttccattttccagtacctattagacagaatggctttcaattttttctcttacttccaaacttagtcattataagaagatgtaggccaggcgcagtggctcattactgtaatcccagcactatgggaggctgaggcaagtggattacttgagtccaggagttcgagaccagcctggccaacatggtgaaaccccatctctactaaaaatacagagattagcagggcatggtggtgcatgcctgtaatcccagctactcaggaggttgagtcaggagaatcacttgaacccggaggcagaggttgcaggcagattgtgccactgcactcctgcctgggaaacagagcaagactctgtctcc

SEQ ID NO: 526669 - DNA, 248 bp, Homo sapiens
  misc_feature (41)..(41): n is a, c, g, or t
gaccccaggagttcaggctgcagtgagccatgatcacaccnactgcacttcagctgggtgacagagccagaccatgtcacaaaaagttagaaaaaaaaaaagagagagggagagagactatacacaggctaattttggtatttttagtggagatgcggtttcaccatgttggccgggccagtctcgaactcctgacgtcaagtgatcttcccgcctcgactcctgatatcaagtgattgttccccgct

SEQ ID NO: 526670 - DNA, 922 bp, Homo sapiens
agctaattctagatcggcgagcggacgccttgttatctgtacagaacttcagatttgctatgactgctgtgccagtagaaagcatgaagcttttgagatcatgtagggcttatgtagagggtatcaatgggcctagactaagcaaggattgaatttaccagaggctaagctgcagatagtaagaactaagtggctgtatggtgattggttcttataaacggtcaaccgtattaaaataaggtatctttccttttccctcttactggatttttcaattgtctcaaacccatatggcctaggctaactttcacacttgaaaataatatagatttagtcgaagtactattgcagtgaagtaagtaacattttaatatatcacattgaaaattatcgcagggctgactgaatacttggtgtagcccccctcgtttctggtttcacatcatgaggatcagttagctgctgacaatgaatagtcatcttgtgtctgacgtagattgaattctacctggtagagatctattacggaactggaaaacagcaagtcatggttgatctcatcatgtcaaggctagttacgtgctataaatgtccctgcgaacactgaattcgcaaattttgaacctacgggggaaatcacaagggcttcatatttctcggaaggcccactggtccacattgtcgcattcacgccacgtctgacactgttacctccctgttcgtacagacacgctcgattcctataaaccgactcccttaacattcgcagtcccgtgaccaccacacaccgtacctcaattgccactgaaggtatgttgcacgattaaggaccatacagcccacgcaacgcccttttacccctttggcacccgttgttgccctagcgccttcgatggggggccactctagcgggcccccacaa

SEQ ID NO: 526671 - DNA, 299 bp, Homo sapiens
cacgaggccgtaccccacgtcgtcagggggtcgatggcggtagggaggtggttttccgctccccggtaccggcccaggttccggttaaaggaaaagggcacggttggttggggagggggaggcaggtcaggttggtaggtcacaaaccccaaaaaccgcttggggggagagaggaagagatgggcggggggccgggggccggtaaccgctaagcggtggggcggttcgctaggcggttgcggtacggggcccggtaaggggtgctaggggcgcggtgcgtgcccgccagccccgctgaa

SEQ ID NO: 526672 - DNA, 220 bp, Homo sapiens
agtcagctccgtcctgccaagcgtagtacccaagtactgggacgtacaggcatgcactccacgccctgctaatttttatatttttagtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 526673 - DNA, 336 bp, Homo sapiens
aaaataaaaagaaaacctttttttaatgggtttttaactaaaaaaaatttaaaaggcagccggggggctaaaaggaccaaaaaaaaaaattttttaaacctcccaaaaaattttttttaaaacttttcctttgaaaagggaaggggggtcaagggttccaaaggggaaccccaaaaatttacccccggaaatttccctttaaaaccaaaaagggataaaatcaatttaaaaaaatccttccttttgggggccccaaaaacccaatgttccctccccccccccctgggggggttataagggaaaaaaccgtttttcccccccccccccaaaaagggg

SEQ ID NO: 526674 - DNA, 209 bp, Homo sapiens
tgttaaattagcgacgcttgtggttcagaaatcatgctagcaacctgcttgatggtgatgatattggtagaggtggtggtggtggtgatggagatgatggtaagaatggtagtggaggtggttagtggtgatggtggtgatggtggttgtggttgtgatgtcagtgatggtggcgatattggtgagaagggtgatggtggtgcgtcggc

SEQ ID NO: 526675 - DNA, 142 bp, Homo sapiens
caacagtgggctctgtatcttcccttctacacagcctgcactgctcacgggtgtccctgactcagcggaagtcagctcagtctcgccagtggctcaggccaaagtcctggggctcttgttgacttctgtctctggtcgacgc

SEQ ID NO: 526676 - DNA, 333 bp, Homo sapiens
ccgctagcccgacaggacgaggttcattctgcgtgtattgattgtgcagatctgtcatgcatcatggagcgatgagaatgatcgttccccatgtctgtcacctgctcttgtctacgggtgagtttgctatagaggaagaaggatgccgtacagaagtccatcagcggagattgcgtagtcttgtagttggttctccgtctgcccattgctctcccagtccacggcgatgtcgctgggatagaagcctttgaccaggcaggtcaggctgacctggttcttggtcatctcctcccgggatgggggcagggtgtacacctgtcgggctagtcgggg

SEQ ID NO: 526677 - DNA, 907 bp, Homo sapiens
  misc_feature (463)..(463): n is a, c, g, or t
ttttaaagaaatagaattaatggctcaggtggattggccaagttttcaaagcaaaacacagaattgacggaaagacttacgttattaaacgtgttaaatataataacgagaaggcggagcgtgaagtaaaagcatggcaaaacttgatcatgtaaatatgttcactacaatggctgttgggatggatttgattatgatcctgagaccagtgatgattctcttgagagcagtgattatgatcctgagaacagcaaaaatagttcaaggtcaaagactaagtgccttttccatccaaaatgtggtactgtgatgatagggagcatgttgcaacggtggtggattgaaagaaagaagaggcgagaaaataagacaaaggtttgggcttgggaacgtcttggaacaaataaccaaaaaggggtggattatatacattcaaaaaaattaattcatagagatcttaagnccaagtaatatattctaagtagatacaaaccacgtaacgatggagacttggcactggtacacattctctgacaaaatgattggaaagcgaaccaaggagtaagggaactttgcgatcacatgagcccagaaacagattttcttccgccacgcactatggacgaggccgtggacctctacgctgggggcctattcctgggttgaaactgcttcctgtatgtgaccctgcttttggaaccatcaacgttttcaccagacctaagggattggctcatctccgatatattcggcacacacgacacgcccctctacgacaattctcgccggaacctggggcggctaccctttgctatttaggctgctgggtgcgaaacccggtatactcgccggccattgtcgcctctgagagtcaggccgcgcgcgcccatttcacgcccggaccccc

SEQ ID NO: 526678 - DNA, 170 bp, Homo sapiens
ccgcagcttataactcaacaccccgctccgccataccagtgacccatgagggacaccctggaacatggccaccctcctactctacccgagacatacccacacagggtggacgtggactgtagtgctcccctaccccaccccataccctactaccatagatataccatgcg

SEQ ID NO: 526679 - DNA, 604 bp, Homo sapiens
  misc_feature (4)..(4): n is a, c, g, or t
  misc_feature (11)..(11): n is a, c, g, or t
  misc_feature (23)..(23): n is a, c, g, or t
  misc_feature (59)..(59): n is a, c, g, or t
  misc_feature (65)..(65): n is a, c, g, or t
  misc_feature (82)..(82): n is a, c, g, or t
  misc_feature (87)..(87): n is a, c, g, or t
  misc_feature (106)..(106): n is a, c, g, or t
  misc_feature (113)..(113): n is a, c, g, or t
  misc_feature (115)..(115): n is a, c, g, or t
  misc_feature (130)..(130): n is a, c, g, or t
  misc_feature (135)..(135): n is a, c, g, or t
  misc_feature (137)..(137): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (156)..(156): n is a, c, g, or t
  misc_feature (174)..(174): n is a, c, g, or t
  misc_feature (184)..(184): n is a, c, g, or t
  misc_feature (213)..(213): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (267)..(267): n is a, c, g, or t
  misc_feature (269)..(269): n is a, c, g, or t
  misc_feature (276)..(276): n is a, c, g, or t
  misc_feature (278)..(279): n is a, c, g, or t
  misc_feature (287)..(287): n is a, c, g, or t
  misc_feature (301)..(301): n is a, c, g, or t
  misc_feature (312)..(312): n is a, c, g, or t
  misc_feature (318)..(318): n is a, c, g, or t
  misc_feature (320)..(320): n is a, c, g, or t
  misc_feature (339)..(339): n is a, c, g, or t
  misc_feature (343)..(343): n is a, c, g, or t
  misc_feature (362)..(362): n is a, c, g, or t
  misc_feature (366)..(366): n is a, c, g, or t
  misc_feature (378)..(378): n is a, c, g, or t
  misc_feature (405)..(405): n is a, c, g, or t
  misc_feature (410)..(410): n is a, c, g, or t
  misc_feature (415)..(415): n is a, c, g, or t
  misc_feature (418)..(418): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (457)..(457): n is a, c, g, or t
  misc_feature (462)..(462): n is a, c, g, or t
  misc_feature (480)..(480): n is a, c, g, or t
  misc_feature (488)..(488): n is a, c, g, or t
  misc_feature (493)..(493): n is a, c, g, or t
  misc_feature (539)..(539): n is a, c, g, or t
  misc_feature (568)..(568): n is a, c, g, or t
taanatttcanaattttattaancctttaaaaaacaccccatttcttttgagtaaaaanccccancccgattacccccaaanatggnttagtttgattctgttacnaaattcngngaataattatttaancaaancnacnaaanantagaaaaaantccagcaagacttaaaancatgaaaaanagaattaaaagtttaaacccaccaaaagncccatggcccattatttagccgggaatgagaaacggcaggggganaaancngcncntttgacngnnaggaaaanttgccaatgcaggnagcgaaaaagngaaggnanacggggggggccaaaagantacnttttttttttttttttgcnaaangcagggtacccnaaaaggggcccacccagaaggcccccncccgnaaacncantaatttttccaaaganaantngggggtttgaagaaaaanggcantaggccaagaaaaaagcnccaaaggncaaanagccattttagacctgaccaaattttccccttttagcaaaaagccnccctgaaaattaggggggggaccaccccnaaggggccacaggttcattttacaagattggattta

SEQ ID NO: 526680 - DNA, 304 bp, Homo sapiens
acaagattttttttttcttaaggtagatgaaaattagcaaggatgctgccttgggtctcgggtttttttaagcttttttggcatatgtttggtaagcaacaaattttttggtataaaagtcccgggtctctcgctatttctgctgctgttcctagacggagcatggcatttctggatcaaccagatgattaaacggtggtattaaaaagacccggggtaaacctgagccccccggtccgcacccgcgcgggaagaaagcgagagacgagagcaacgaataagagaagaaaaaggacacgcgagg

SEQ ID NO: 526681 - DNA, 640 bp, Homo sapiens
agtaccccacttatgtggtgggagagacaagtcaagtatctttcaggctgagagagcgtgcactaattcattttaagtctttcatgaatactagagatggtgagcgctagattaacgtgatataaatgatggcagttgttatttttaggcaagtttgcatactggctgttgaggcagagtgcagtgtaagagcctaagctcgcactgccaggacgtgagtgactgtaacgagagactttttcgtttaccttcgatatttatgtagagagccctctagttccagggccacgtggttaagtgtaggacttgtaggatacctggctgacacgcaggtgacccaccagtattaattcggacagacgagccaataaggtgtcatgaaactcgtggatttgtgaggctcatggtggaggttgagatggcgaccctcacgttacacggtccttaccatcaatcaaaccgtggcatttcgatgacaccgttaatcgaggactggacactatgagggcaagctttgcaaacgaccctctgatccaggatgactctggagttgaccctggctcaacagcacacatatcagtgttgctttgcttaacatgatgcacttggtcctcccacgggatccgtgcacgttaacgat

SEQ ID NO: 526682 - DNA, 255 bp, Homo sapiens
ggtgcgcacactagtggataccaaagcattcgcccacgaccgtttattccagtcaacccgagcactctgaggttaaggaattaaacacattccaaggtaaaatgactatgggctattagctcacagtgaatcgtttgggtctttcaggtggccatgtgtgaagtccgatttgagcacgtgcgtgtgcccaaagagaacatggtcctgggccctggcgacggctttgagatcgcccagggagatctgggccccggc

SEQ ID NO: 526683 - DNA, 446 bp, Homo sapiens
  misc_feature (12)..(12): n is a, c, g, or t
  misc_feature (61)..(61): n is a, c, g, or t
tttcctaaacantacccctggcactttgtgccttaacccagtatttttaattaataacaantctttcctgtaaggcctcttggttgttatcttagtcctgtttgtgcctgcctgtaacaaaatacccacagactgggtaacttaaaaataatagaaggtggccgggcattgtggctcatgcttgtaatccctgcactttgggaggccgaggcgggtggatcacctgaggtaagatcaccagcctggccaacatgatgaaaccctgtctctactaaaaacacaaaaaattagccagctgtggtggtgggcgcctgtaattccagctactcaggaggctgagggaggagaatctcttgaacccatgaggtggaggttgcagtgagccgggattgcgccactgcactccagcctgggcaacaagagtgaaactctgtctcaaaaaaaaa

SEQ ID NO: 526684 - DNA, 263 bp, Homo sapiens
cttctccaggcagccttcttggatgtctgccaggagacaagcatctctttgctaatcaggcggggtacagctttgtctctccctgttacttgaaagcttcatacacaagacctgtctcccctgccagcaattcgaagacaggtaccatggctaactgccacttctgactttgcttacctaggtgctccttatggacaggatgccatctggcgtcactttttgcctctttggtgcccaacacgtgttgggcacacaatatggag

SEQ ID NO: 526685 - DNA, 355 bp, Homo sapiens
tgctgagatcgtggcaatgaacatggaccagggcacctatgaggattatgtcgaaggacttcgggctgttatgacgagggaggaaatggcgccgtcatgggtgctgaaatccggcatgttcttgtcacactgggtgagaatgatgacagaggaagaagtagagatgctggtggcagggcatgaggacagcaatggttgtatcaactatgaagagctcgtccgggtggtgctgaatggctgaggaccttcccagtctccccagagtccgtgcctttccctgtgtgaattttgtatctagcctaaagtttccctaggctttcttgtctcagcaactttcccatctcgtctcttctct

SEQ ID NO: 526686 - DNA, 281 bp, Homo sapiens
  misc_feature (134)..(134): n is a, c, g, or t
gttgcccaggctgcagtgcacttgtgcaaacgcggctcactgcagccccaatctcccactcttaagcaatcctcccacctcagcctcctgaatagctgggattacaggtgtgcactgccacacccagctaattnctttaatttgttttatttttagtagagatggagtttcgctatgttgtaaaggctggtctggaactgctggcctcaagcgatcctcccgccttggcctctcaaactgctggggttacagacgtgagccaccatgcctgggcctgctca

SEQ ID NO: 526687 - DNA, 1222 bp, Homo sapiens
cttcgaaaccagacttatccctcaccttggctatcatcacccgatgaggcaacgcagccgagaacgcctgaacgcaggcacattacttgcttattctactaccctagtaggctcccttcccctactcatcgtcgagctgagttatacacgtcacgaagcaccctaagctcacataagacagttgctacgtactacactctccaactgtccgcatggaacagctattccaaaacctacctgtagcaccaaggaactgtacagtactgaagctagacttagcaccagatagtgctgtttagtagtacagcggactagcctccttgtaccgggatcttccatctgtagtgaacttccactgaaagtcccacatgttccagaaaagcccctgcatcgactgggcgtgcagtaagtaacttttcgcgcgtcgagctaactcctctcacaaaatcgtcacgtgcggcgccgtaattgggtgactacaaattagcggtcgcatgcaatcgaccttcgatttgccatctatagccccctctcctgttatcaagacactagccatcgaatttagtccgttatcgcacccatgttcccttgtgtgattgcgttattgccccataaattgcaatgggtcgactcagatttgattaaacgagaagtcgttccctaatccttgggcgtcactggaatcaagacgatgatcgcatataatagtccgcctacaatgggcctattcacgttctttacatatttcgatgcccagccataagtcgcctgcggtagttagacaagacgcatatctttcgatccaaaattcctcctgaaaaagcttgcatcgcggcgccgcatggtccattatctccactatagtctgcgctcactgggacctttaagcagtccctccatgtaacctatttcctcgccctaggcagagactcagaacctttacggaatcggcaacttcaacaagatcaggctatgcatgtaagattcccgttcgtgcttccacagggatcggtgtcagaaaccttcgtgcttcccccaccataatgtcagcctttttttggatcgaactttcctacaacaagagacacgtcggcctaaaaccgttggtccatttatcccaccccatcttagtttaaaccgtaaccttggaggaagaaaccttcattcttggtggcctagggttataacccaacaggtgtcttcccttgatcccacaccttta

SEQ ID NO: 526688 - DNA, 368 bp, Homo sapiens
ctacagtgatctttagaggccatcttccagcttattaccagacacggcgatcactcttattccttcagctctagcaaacttgcatgcaatcgtgagccgtgtaggctatccaatacaggggcatagccggcgctctatttggcctggattgttcaggataatcacctgagcagtgaaaccagctgcttccattggtgggtcatattatgcagtcaccagcaacgttgccacgacgaacatcctatgaaagacacattcttgacatttacagcccacgattgtccccaggaagagcttcagtcaaagcttcatggtgcatttcgacagattttacttccgtcgtgacgtggaaaggataaaaggtgaaa

SEQ ID NO: 526689 - DNA, 497 bp, Homo sapiens
  misc_feature (429)..(429): n is a, c, g, or t
  misc_feature (450)..(450): n is a, c, g, or t
ggaaagcggcgttgataccgtggaaggtttgtgctgttgctggcccttgattgctggaaggattccgaggtgcagttttcgaagcgggagttttgttcgtgttggttgcttagcgtgtgttactgtcgctaacgggagattctcaacgtgtttgcattgggccgtttgcatcagttgggaccgttgttactgacctcctaggttgtgtgttgcgtttacacgcttaaatccgggtttcacggtctcttagtactcgcatattaagctcatcgcgcgtaccttacttctacgcgttcacgtcggttcgtccgggcctataaagcgccgctgctttttggccgtgtgcgctttacgttgcacctttacgtcggatcactggggtccatcagcgccgtatttttgaactggccgggcgtgcttcgaagcgcntagttgcttcggttcactggntgcggcgtgacgatcacggcactcactcagtcgcccggtctccgttc

SEQ ID NO: 526690 - DNA, 89 bp, Homo sapiens
ggggggggggttttgggggggggggttttccccggccgggggttccccccccccccctttttttttattgttttccccccccctgggga

SEQ ID NO: 526691 - DNA, 397 bp, Homo sapiens
ggaatacaggcatgcaccaccatgaatggctaatttttaaattttttctagagatggggtcttgctatgttgcccaggctggtctcgagctcctgaccccaggtgatccgcccgccttggcctcccaaagtgctgggattacacctgtgagccactgcgcccagccagtattatgtattttttagttctcttaaaacatgggcatcagaatttgattttcaaacaaattatatataaaagtagaagactctgagtgctatttcaaggttacctgtgaagggaaggagaaaaagggtatagccagtaaaggtgatcaagagatccaagagagctacagagtgagaccgtatctcaaataataaaaacaataataaaaacaaaccatttttgattggtc

SEQ ID NO: 526692 - DNA, 192 bp, Homo sapiens
  misc_feature (118)..(118): n is a, c, g, or t
tcagctcggcggccccggcagcggtggacaggctgtcggccgggccccgttgggcagccgtcggcggttgtttctccttgctgccgccttacgtggttgttgcttccccgtgcagcgnctgctcgacacggatgccggccgcttgtgggcgcccagatcggtgggctgcgcggagcccaggctggcggccgc

SEQ ID NO: 526693 - DNA, 337 bp, Homo sapiens
  misc_feature (47)..(47): n is a, c, g, or t
tgagtggagggaaaggaggatacggagagttggttaataaacacaantatactgccaataggaggaataagttctagtgttctgtagctttgtagggagactatagttaacaattgtttgttctatattttcaaatagctagaatagagtattttgaatgtttccaacacaaagaaatgataaatgtttgaggtgatggatatgttaatgactttgatttgatcacaacacattgtatacaggtagcaaaatatcacactgtgctccataaatatgtacaatttttatgtgtcaactaaaaataataataagagaataaataaatggaggttgagag

SEQ ID NO: 526694 - DNA, 829 bp, Homo sapiens
  misc_feature (131)..(131): n is a, c, g, or t
agcggagttaacgaagcagcaagcaggaacgagaagacgctttctaaccgcggtcgctccgggataatccgaggccctacgattgtccaactcatcccagttatcagacgcagatacaggggagaataaangattagcggacaacgttgagccagacgctggacgcactgttgtggtgatgaagacctagaaagcgaatggaaggccgcgagacgggtgaaggagcagcagttccagaatgtaatttggcacagtcctgaatatctctcttgtatgagcttggtcgcatagctctaggcctatgtatgccagcgctaggcactagtgtcaagtgtgcccgactgaaacgtgagttgctgtgctccttctggtggccaggtttgtaactagatgactctgggggcctgcagactagggaggaatcttgctgttgacgggaggcccagcggctcgtttccataacggactaaacacctgtgcgtttgccaggtgtcgatactagtcaagaaccggcggaatatcggttgagtttaccatcgaggaaatctgggcactgaggatgtgacgctcagtgcaggaccccatcggaagcgactgttgtcctagccatttcccaggttggtgcacctatgaaaagactccgcctatgcgggtagtttgtcgagggcgggagcctaccgcgacttaagcggcactggtatgaattgcatccattcgcccctaggtttttccccataagtagcacaaccggataaattacgttattttgcaaaacagttttcgctagcaaatagttcactccagcatcccatgggcaacccgtcaactc

SEQ ID NO: 526695 - DNA, 231 bp, Homo sapiens
ctcagctgatttcgtatatatttggtagagacgggttatcagcatattagccaggatggtcttgaactcccgacctcaggtgatcctcctgccttggcctcccaaagtgctgggattacaggcttgagccagcacacccagcacattaatgtattcacacaaagtaagataaagtctgtaatagccttgttactagccgttgttaggtcaacccttgccgaagcttgatca

SEQ ID NO: 526696 - DNA, 142 bp, Homo sapiens
ttttcattttggtttctgctcgtgtcttgttgctgaatcatctaatcccaggaagaagtactgttcgcccacagacgggtatagtttgcttttgttccagggagacacagaataaactgttgtcatcaggcggtataagctt

SEQ ID NO: 526697 - DNA, 300 bp, Homo sapiens
  misc_feature (134)..(134): n is a, c, g, or t
  misc_feature (257)..(257): n is a, c, g, or t
cttccttccttccttccttccttccttcctttccttccttccttccttccttccttccttccttccttccttctttctttctttctttctttcttttctttcgacagaattttgttgcttatcagcccaaaggntcggacgtttcaactgcgcgacgactctcagctcactgcaacatccgcctcctgggttcaagcgattctcctgcctcagcctactgagtagctgggactacaggcgcagcgtctacctaatgncacctaggcgtagatgtttatgttatttgtttacgtacgccag

SEQ ID NO: 526698 - DNA, 115 bp, Homo sapiens
tatctagaggatcccatctcgggtctgggtacacaaccaaaaatatatgcttaaaactaggccgggttcaatggctcacatctgtaatcccagcagtttggaagaccaagatgga

SEQ ID NO: 526699 - DNA, 918 bp, Homo sapiens
tccagccccgcgtgatcccgcgcgcccagtgacgcctcctcccgctgctggccctggccggcggccctgacgtgcgctgctgctgctgctgctgggccatggcggcggtcgggcgctggggcgcccgggccctagtgaggcgtgcgagttgtgcgtgcggctgtgactgtgtgccccctcgcgtagcagacggctgaggactggaccagtgagccgtcactagcaagccacctgtacacggacgacatgttcacgcacgaggatccacagcgcctgctgacacttcgtcatgttcttcgcgccctggtgtggacactgccagctggctgcatcgcgacttggaatgacctgtggagacaaatacaacacgcatggaagatgccaaagtctatgttggctaaagtggacttgcacgtgccactccgacgtgtgctccgcaccagtgggtgtgcgaggataccccaccttatagcttttacaagccaggccaagaagctgtgaagtaccagggtcctcgggacttccaggacactggactaaactgtgatgcttgcagacactgaacgaggagccagtgacaccagagccggaaggtggaacctgcacatatgcccccgatgcatcatgcaacggctggtatgagctctcagcgagcaagtatgagccatgcacgttgacaccaagtgcgaacacaacattagtccagcttctacgctcccgtgactagtgcacccctgccaacatgtcccccttggtcttccaatcacttgtcgacgctcaatccttgactcctgagtgaccttgtacgcatttaccggcaacacctgtccacagcaattggcacagggaactagcacatggctgcacgcccgccaactccttgacacatccgtccaccgagaaacacaccagggtacg

SEQ ID NO: 526700 - DNA, 949 bp, Homo sapiens
  misc_feature (136)..(136): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (166)..(166): n is a, c, g, or t
gtccagcatgaaacatggatagggacccacttggaggacttgctgatatgtttggacaaatgccacgtagcggaattggtactggtccaggagttatccaggatagattttcacccaccatgggacgtcatcgttnaaaaantcntnnaggccatgggggacacancatgcctcccacacaatcgcagtttggagagatgggaggcaagtttatgaaaagccaggggctaagccagctctaccataaccagagtcagggactcttatcccagcgtgcaaggacagctcgaaggactctgccacctcgagtgtttctaagacaaggacagctgtaatgcagcatgcagattagccgtgagggcctgctcagctcggttcctaatgacatacaaaattcagagtgccacaagacttcaggccccaagcatacactactgatgtccgtcctaggtgcacaagccacacagcgcagctcagaacacccagcctcgggcgacagagcaccttcgagctggcgtctcaagaagctaagtccaccgaggttatccaggcacaagcctgccagagaccaggcaaaacagccaccaaccggtcaaaggcaagaactccttacaactaactggacacggctggtgactggacatatctaaatagctggcaaatggcaaatgaggctggtcaatgggtgtacagagaaatgaggggctcctaaaccactttcttcctgagatgtaaagcaaaaggtaatcattcctgtcactagattagaagcgatgaagactaacgacaaaaggcaagttctaaggaatcagttgacgtaaaaccagcgacagcggctagcccaacaggtggaccacaattcatggccgggcatttccctggcactggtaatggcaccagtgtgtcccaaatcttgacagcgtggacattcccttggggggacgtccta

SEQ ID NO: 526701 - DNA, 1299 bp, Homo sapiens
  misc_feature (136)..(136): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (166)..(166): n is a, c, g, or t
gtccagcatgaaacatggatagggacccacttggaggacttgctgatatgtttggacaaatgccacgtagcggaattggtactggtccaggagttatccaggatagattttcacccaccatgggacgtcatcgttnaaaaantcntnnaggccatgggggacacancatgcctcccacacaatcgcagtttggagagatgggaggcaagtttatgaaaagccaggtaagtcatatttgagtgtttaggcaacaaatgttaaattatgcaatatatgtgatttcatttgctattaaaacatgaaactattttaggagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagcgtgcaaggacagctcgaaggactctgccacctcgagtgtttctaagacaaggacagctgtaatgcagcatgcagattagccgtgagggcctgctcagctcggttcctaatgacatacaaaattcagagtgccacaagacttcaggccccaagcatacactactgatgtccgtcctaggtgcacaagccacacagcgcagctcagaacacccagcctcgggcgacagagcaccttcgagctggcgtctcaagaagctaagtccaccgaggttatccaggcacaagcctgccagagaccaggcaaaacagccaccaaccggtcaaaggcaagaactccttacaactaactggacacggctggtgactggacatatctaaatagctggcaaatggcaaatgaggctggtcaatgggtgtacagagaaatgaggggctcctaaaccactttcttcctgagatgtaaagcaaaaggtaatcattcctgtcactagattagaagcgatgaagactaacgacaaaaggcaagttctaaggaatcagttgacgtaaaaccagcgacagcggctagcccaacaggtggaccacaattcatggccgggcatttccctggcactggtaatggcaccagtgtgtcccaaatcttgacagcgtggacattcccttggggggacgtccta

SEQ ID NO: 526702 - DNA, 356 bp, Homo sapiens
gcgtagtatatgaacaattcaatcacaaaaggaatggggagagtattaagtaaaaccaacctttttagatttgtttgctaacaggtctattaacagatttatttagaaaggacattgaaggcattgaataaaatcatgtttcaaattattagtagacttcaaatatttgtgttatccctaactactaaataaatttgggacctttaatagaattaaacctcgtgtatttttgttgttcagtaggaaattcagatgcatttgtttaaggtcttaattacaaaacctggggtgtttaagggccagctttaaaaggaaacaaaaaactattcactgtttagtatggccgttaatctaaa

SEQ ID NO: 526703 - DNA, 347 bp, Homo sapiens
attgtgtcatttccactcgcctgtggcacattgaagtggttaacctttatgtcccttctttatgtgtttacctcggcttattccaagggtgcgttccgtcgagatgcacacaagactgaggttgctgatcggattaaagatttgcgtgatgaacatttcaaagccttggagctgatggcctttggtcagtatctgtagcatgtggcattcgaagatcatgtcatactagtgatgtgaagcaactgaatctgcagaaacatgtgatgctgatgagtcagctgtacctttgcctgaaacctatgctgaaatggctgactgttgagccaaggaagaactattatagtgtg

SEQ ID NO: 526704 - DNA, 486 bp, Homo sapiens
caatggccagagaggggctggccctacagaccagtcacagcaagggacagggcccagagcctgcacttcagttgccctgagattccaggagcctctgagggagatgaggggggtctgcatgaggtgggaggtggtgtgcgtgggggtctgtatatagttctgaaccggaaatggctggcccttgccagcctggtgtgtgatgtgatgagtttgggaaggacagtttccatgagaagcagtggcagggatggggatggatgccttcgttgttccaggcctgtcagggggcccaggtccctagcagtccctgccctctgccctggactggaagctgactaggagagctacgaatcagaacaactggccattttctagctggagatgccagctccgatggcatggagggccctggggccaccccaggtgtctttacctcatcctggtgtgtaataaatcactgaccatggagccatcatggctgaaata

SEQ ID NO: 526705 - DNA, 934 bp, Homo sapiens
ttgtccacttgtgttccgctgggcttctcctgtgattatggttggccccctgtcaccgtgtccccctaactgtgtgccacccggggcccgcgttttcgtttggggcccgccgtctatagttgtttgcgggaggacacgtacagctccgtgggcgtaggcttgccctgagttccacacactacttgcgcgtggtggtacacccaggtaagtcgcccccccctttggtgggccgctcgttcgtgcgtgcctcttatcaggcaccgggttttggcagcacccccttgtgcagcatctggcgggcatcccccctgttttgtggaaccaccaactgtctccacgcacttgtggcggcgcgcccccttgccgtcccccgtctttacacgggtcgtggagcacacggcagaccggcccggtgaccccacggggggtgggtggattcccagcagactccacgcatctgtcccccagcactcgcacgcacccgcggtagtacacagcgaggcgctgtttcttggccccaatacgagagagttgttttgtcgcccgacgcaaggcccccggcgctgttgtggcgtgtccccgccaggaagttgtgccgccccccttcggtggcgcgttgcaggtggggatgataccccctacgtatcttacgtggtctctggacccccccgggtctcctccacacccactggcgttcctccctctgctcctcctgtgacaagtccccccccacatcgaaccccgggacttcatgggggccccattgacgcgtaagacgccgcatatatccctggcagtgcgtcggacggcgccgacggatttcttgccaccgacgggaggcggggggtgggctggccgccgcggcgcgacttaccggttctgtccccccccccgtaggtcccccggccccacttttttcccccaacatgacaca

SEQ ID NO: 526706 - DNA, 131 bp, Homo sapiens
cccaggctgggttatactgtgatgtatgtcagctctgggcctggaatctgccctggaattagcggaaaacaatggcccagtggtggcgaatctatcaccaagagcctggccacccagccggggataatata

SEQ ID NO: 526707 - DNA, 279 bp, Homo sapiens
tccatagcacagatttgcgacaagggggctgtcatcaccgtcaccgtaacttcatggagctgacaccgaggctacatagcctgacttggacaacaaagtcgactggccgcaacctggccggcacccggagactcgctatgactcagatcgcccgcatcagcgacaaaggcaatgaacgccgtctgcaagccgaacgcctggtaggcacgcaggcattgcaggaagcccaggccctgcggttcaacgtgttcagcggcgagttcaacgccaagctgaaag

SEQ ID NO: 526708 - DNA, 265 bp, Homo sapiens
cctcttccacttgtgtcgagcttgtaacgctttcttacattggtggctgcttataggcctactatgggtgttacatattttactctctctacaaggtttatcctagtgtcccacaagagctgttcctctttggactaacagttaaatttacaaggggatttagagggttctgtgggcaaatttaaagttgaactaagattctatcttggcaccaaccagctatcaccaggctacggacaggtttgtcgcctttacctataaatac

SEQ ID NO: 526709 - DNA, 265 bp, Homo sapiens
cccgaggtgaggagcgagatgcgtagagagagtataggagagtgaagaaaaaacaaaggaaagaggaagaaagaagaggcagtcaatgcacggtgtacaaagatgaggatgacagatagagaaatgaggtcgagtaggcaagtttttaggacgtcatgccgcaatgaaagcgttgaggacgtccagtagaggacaggaagaatatcaaggaaatacaatgggatgaaagatagagatagaaacgaagctgagtaacaggtaaata

SEQ ID NO: 526710 - DNA, 257 bp, Homo sapiens
acgaaacacattgaagagctatttgaagggattcattgaagttcccttcattgcgtttcaaattagaaggtagtaactcctttgtccaagaagggtgaattgagcatttaacaattctccaaagaaatttctacagtggtctgtatcctagaccccttctgtatccttgagatggctgaggattgtaaaaaatgaccggttttacatgggggggctgggatttaaaaaataaaataataaataatggtaaaaactga

SEQ ID NO: 526711 - DNA, 187 bp, Homo sapiens
atgatgaatgagcactgtacaagctactcagctctcagcgtgcacccgtgccatggttacctttgatcacatgacatcatatatgatttccttctccttgcgtaagtgggtaaaggtccagaaatgcctaggcaaatatgaagcgaagttatttatggcatagaatctcatatatataataacccag

SEQ ID NO: 526712 - DNA, 635 bp, Homo sapiens
cgtggcctctgtgggtgcctgaacacagccaacccccttgaaaaccgagcccttccggggcgttaatttccgcggtggtaatgttccgctgggcacaaccaatatgtgggaatattaaagagtatcagccccgatgtttctgcaagttgttctgcagaagggacccttaagacctgcacacggaatccagagagctgggtggggtcaaaggcgtccttcacaaactcagtttcccaaagtgcgggatcacaggagtaaccccccgcgcccggcccaaagagcctttaaacaaagctttggacccaccaaacgcagaggactcgagtttatatgaagacgacgtggtgtcactcgtctctgccctcatgtgccctcagttctccattctggtatccgcggcacagcacagaagagagcgccagtttcacatagtacctggcacagatggggcccatgcaccccccaagctcccgaatggtgctctttctctgtgccacgatgtcagtaagattggtgcccaccgtggcccgtgtcgggggcggctcccacaggtcgcctttcccatcccgggagctcacctcccgcagccgtttcaacaacagtgtcttcccgacgcccgtggcccacagctcgtg

SEQ ID NO: 526713 - DNA, 191 bp, Homo sapiens
gggagaggcctagggcatgcagtgtgccctctgccccctgaaggattagatgactatgctagctgtgtaacatccccgtgcacgggacgccggcagcccatatggacgggacgcctttggttgcctttcagtgcacagtatactccagaaggccgatccttatttatccaagcccgttttctaaatagctt

SEQ ID NO: 526714 - DNA, 979 bp, Homo sapiens
gaggcggctccctgcgctcgcagggccgtgccacctgccctgcccgcccgctcgctcgctcgcccgccgctgccgcgctgcctgacctgccatgcatgctgcctgagatgtgggctgcccctgcgctgcgcgctgcctgccgcctgcctgctgctgcctgctgctgccggctgctgctgctgctactgggcgctgatgtggctggctggcggctgtggtgctgcgcgctgtgagtgtgctgattccgtgctgccctgcccatggacaccccgaagccggctgtggcaggctgtgggggccccgcaggcggtgttagttgcaggccgcaggcggggcggggggatgggcccggaagggtgaggcggtgacgcgccgtcccctggcacttgccgcattgcggccggtaacggcttcgtgtccggggggacgccccgggaggctaggaggagcttggcttggtctccggcgtgtggtgtcgcgcctctgcgtcttggagcacgtgtgcatgagtacctttatgcagcggagtgtcatagcagccccgcggagagcattaggcagagagcgccaagaggggggggcacgttgagcgcctatgcattagttccacacgatgaccatggtaggcctacactgacagactttagctacacacgtgactacgggcctagccattgggttcacttgaggtagcagacggagagacagcctttgggtgacgaacatgccgagcaccggcgggaacctgccaccagacagcgataaataggggctggccccaaaggccccccctgggaatgaccaaggggtttaggcagagaaccgaaagtagggagcatgactttgctccccagcattaccaacgaacagcggggaagggacccaatggagactaggagatgagacaaccccgaacactgtttagagacaacaaagacagacccacgttgaacacacaattaggttatggtagaagcag

SEQ ID NO: 526715 - DNA, 661 bp, Homo sapiens
agcgctcgtgtccgcctctgactgcagcgctgtgtgtgggctgatgtgtgattaccatggcgatggagtctctgtcctggggtgcctggctaaggaaaccctattacctccagtgctcgcttctcatatgtgctgtgatgaaatatcttttcttttcctggttagtggtttttgttggaagcttggattatatatgtgcagtattctacctatacagaattatgcatgaggaaatggactgtaagaaaataatatgtgacaatgtacaagactggagttatttgatgggcctgcatgtaacatgcctttgatgttacagaaactctttactttggaaaatgtttataccaccaatgcccaagcaatccagatgtatcaaatggtgattttgggcataatctaccatggtgtatgtgaaattgtcaaagtggaacaatgctgcttcaatctatgcattttatggaacttgaatctggaaccaagaaaagaaatagtgctattttgataagccaactagaggaactactgtacaaaaatttaatgaaatggtctatagtctcttaagggaccagcaccggtacattgtgccaaacttttgctgaagcacttgctccagacatgcaatcagtgatgccaaacgtcggtatgacggaacacgcta

SEQ ID NO: 526716 - DNA, 436 bp, Homo sapiens
tgcggccgtgtcccctcctgcaatgctaggactcacagctggccaggactccatgtctcccggttcatctgctcgccatgaggaacactatagtaacaaatcacggtccatgaagcatttttgtaattttcagctggatggctgcaggcccacaccaatgggtgcacattcactccccaccctctctgcaggctagcgataccgatccgcaccaccccaggctcagcgggaaggtgctcgtcttctctgccaccattagcaataataacgacttcaacagtcactctgcttactgtcccgggcttaccagattaccagctaatgttttaagtgagtggcttagtccgagggacggaagaaggggtggagtgagctcacaagaagagttaagcgccaaacctagagtcccgtccaaaggagcactgacacctggaag

SEQ ID NO: 526717 - DNA, 118 bp, Homo sapiens
  misc_feature (71)..(71): n is a, c, g, or t
taaaaagtatttattttttactagtgaggatggaactaggggaagaagtgggacaaaaaagatgcagtttnccttggtatggggaaatgtgaaaataaaatggtcaactctttcagtt

SEQ ID NO: 526718 - DNA, 111 bp, Homo sapiens
ggcatcggtgtacaccgcgcggcgctaaccctcctggtgttcccgacccttgctctccttgagcatcgcctccattcagtgagcccaacagacctgattgaagacttgggc

SEQ ID NO: 526719 - DNA, 360 bp, Homo sapiens
gcttttgggaaaaactagttttcccaaatgctttggttgtttgctcttttaaataaactttatcccataaaccttttttaagaactaccccctaaggctggttaggtttccattataaaggaatccaatgttttaaggggggtttttttgcccctggttatatgaaccgcctatttttaggagggggtcctggcatttaaatttgttttggtttgcggatttggcgttgaaaatggccctataaagaattccaggattaatgtctccctgttataatgggtgggggtgatataaagcccttttgtcctcccctcctggattccgttaaaataaagttaatgacttggggctttttaaaga

SEQ ID NO: 526720 - DNA, 796 bp, Homo sapiens
caatagggctatgtacgaggctgggtgctaatcggccgaggctgagtaacaattgcgtgtccgggagtgacaggtgccctctgggccggagcctggcggcagtggtggcagctggtatctgccgccctagctcaccgcgccccttttccagccctgctgactgtcgccgctgcaagctgagtgcatgcggctggcctgcctgagaaacaagtggcccagcctggtaacctgcctgagaagcccttcacaaactgcgtgcctggcaaaaatgaaacctgactgagctggctggtgatcagtgttcccctctgctgattcttgggcccctgaacccctggtaaatgtgcctccgtgttcctgtttcctgcctgccctcctcctgtagccttgcctagtgtagtgatgccccgaggcctccgtcctcttcccatgatggtgtctggggcttgtgccccagcctccatcttctgtctctcatgtgatggctgatgtagcagctggctccaatggctgaattcatttgtctggagtggaaatataaacttggtacggaagatcgggtctggctccttctggggacatctatttgtgcgatcaacatcaccaaccggcgaggaaagtggcatgtgaatgctagaatctcagaaggccagtgcatccccagttgctgtaccgagagcaaggctctataagattcttcacgggtggggtttggcatcccccaataccgtggtattgtccggcaccacagactacaatgtactactcatggattttctgggacctacctcagaga

SEQ ID NO: 526721 - DNA, 146 bp, Homo sapiens
  misc_feature (1)..(1): n is a, c, g, or t
nagctttgcgcagtggcagtatcgtagccaatgaggtttatccgaggcgcgattattgctaattgaaaacttttcccaataccccgccgtgacgacttgcaatatagtcggcattggcaatttttgacagtctctacggagactgg

SEQ ID NO: 526722 - DNA, 675 bp, Homo sapiens
gagacgggtgatgcggtggacagaaagactcttacttgggctggtgtatccagaaacctggccgtctccagttttattgtcgttgtgtaaattattcctttgtgcttcatagcagtgcggtatgcattatgtgcctaataacatggttgtgcaaacaaggtcatgagatttgctggtagacgcatatgggaaagggtggctgagtctccggttagaagatgagttaaggggtttggatactccagaatcggagtatctttgtgatactggaagtgctgatcatcttcccatgactgttcccagccagcatgaatctgggcaatggaatagttgtttctcagtctgttttaattctcacgagtgtgtaggctacagcgtggacttgtctttttcttatttaactctagagcagcgcacttacaaggtttaagtggcacctgtatgacatgttcccctccaaatatagtcaactccttatttggggcagcaaagtttattttgtatagttactttatttccctgaaagagacattacaaaaagctattatttcttcccatttatcacccagtagattagcctaaatttaatcagaaggtcttggagagtaaaattattaaatataggctaataaaatgatggggggcatttatttgatatagatcatattggtctaa

SEQ ID NO: 526723 - DNA, 948 bp, Homo sapiens
  misc_feature (224)..(224): n is a, c, g, or t
gggttgtagccgagctgacgcgctgtcttgttatgatgacgtctgtgggagcatgaagatgttgatgaatttgcactccccctgccttgctcggtttgttatgactcccttctggtggggcggatattattttttaatgacctcagccgcccgttcttgcttcgttacgcggaacaagagcaggccacttttgttttgtttcctcttcatggagacgttatgtntttgtgagactgatccagcaacaccatgaggagcttgctctttgttttggagaggcccgccctctttgtgttttgcaacgcacccccgctgggtggtgttttccgcggcgccgtcgatgatttttttgttttatttgtcgcctcctccgtgggtattcatgatcgctccctcgttaagtttttgttcgtccgtgcgccactccactctccgttgatgtccgtgcgcgcctcctctcctctctggcggtgatctttattaactccttcttttctacacaggcaggagcttcgcacttatcttttctctcacgcccccgatagtagagtttgtgtttggtagaggtttttttcacagacccgggcgtacaaccctcgctttcacttcccccaccacccttttttactactcgctggggagagtactacttcttttttgtgtttaaaaaacgacgccgctcttcttcgtttggatgtactaaaattataactcttcttctcctttattcatagctgctgctacactactttttgtttccacccacccgctagtattacctccttgatacaatgtttataccaccaccacacaccctgggggtgcctcaccccccccaccccggtcaccacatccccctttttcccccaaaacccccttttttttaaacctccccccttttttttttttcctccccccccccatcatttcccggggttttttttttta

SEQ ID NO: 526724 - DNA, 791 bp, Homo sapiens
tgcttccaggatggtgcgctgaacactgtgtcttcacatggcagaagagcattaaagggcccaaggcatgtgtgaagcctcttttataagggccttaatcccattcacaagggaggagacctcattaccataatcacctaaaggccccatctcttaatactgtagcatgggaaataaagtttcacgtgtgaatttgggagggataccgaaccattcaaaaccatatgcacgcagcatctttacttaccttttcctggtagacttactcaaccagttgtggattgacggacctataacggactgacatggttactggatacacccagagacgagaccccgtgggaacccttgggcctataagactttacaacttggatgactaacccacggctctgccgctcccaccacgttgcctatgatacctggatacacctggatttgggtccctgtgacgaatgtggagagaacacagtggcaaagacagttacttgacacaccccttggatgagtaacatatgccagataaatatacttacaagtaccctagtggtacaatggaactcaattctttttatagggatgaacccattgggctatggaaacccagactggacattgccccctaaacccccccaaaagaccgcccagagcacacaacacacctgggttgggacaacgcgcccccagcctagcacggccatatactgacacgtgggcaaccttacttcaataaaacgcatacaacactcggagagcgagcacacggacagtacacacaaacaggtgcacga

SEQ ID NO: 526725 - DNA, 175 bp, Homo sapiens
ctccttatcataggcgtgtgggtagaaatgtctcgcttcatagcaggaatgtttatcattacgagcgccattctccacaagggattttatgataccacaggctatcttcgacttcagggtggtggatataattttctgcagcttgaaaaagcaattcgctatctttcatagatgg

SEQ ID NO: 526726 - DNA, 247 bp, Homo sapiens
gctcgacacaacattctgaagaaggtgtgacatggtttcataagtcaaggttctccagagaaacagaactagtggaagacagaaaagagatttattctaattcacacacaacaatactaaccttaaatgtaaatgggctaagatgcccaattaaaagacacagactggcaaattggataaggagtcaagacccattggtgtgctgtaattctggagacccatcttacctgcaaagacacacacaggc

SEQ ID NO: 526727 - DNA, 145 bp, Homo sapiens
cagaagactggcgacgttttttgccacactagaaagcccagctttaggtgcgccgttggcggtggcaattgcgattcataatgtgccagaaggtgtggcgatagccttgccggtatatatggccaccggccgtaaagattatgcg

SEQ ID NO: 526728 - DNA, 307 bp, Homo sapiens
tcagacttgaaacctcctgtaaagaaagtatcatgccacgatagaaaaaactgtcgagacgtgtcgtctcttcctataagtattttcaatgtacggtaatgaacacaaatccgatgaacaaactgattaaaatttggacattatatcttgcttcactaattatggcatagtacaatgacatagctaatatgtcccttaatatttctttgtttaacagaggatatacatataactactgccattatggttatgggctactttaccagcctcttcaagtattggacacaatctatggttcgctacctac

SEQ ID NO: 526729 - DNA, 1349 bp, Homo sapiens
gccagccttccccgcgagcggacgcggaagcgcctctgtctcgctataattcttattatttcccaccctttacacctatacttaataagataaaaactataatacttattctccccaacccacacataataacacaactattctacaatacgaaaggcaaataaacaaagacaaaataaaaaaaagaaagaacataaacacaataaaactacaaaaacaacaaaataacaacaccaaaaaaaacacaacaaacacaaacacaacctaaaacaagacaacacaaacacaaaaagaacatacaacaataaatagctaaacataatataaaaattaaaaaacaaaaaatctaaaataaaacaaaataaaacaccactaatctcacaaaccacgaaaaacaaaataacaacaatgacacacaacacaaatcaaaaacacatctataaataaaaccaaaaccaaagtaatataaaatataacacaacaaccaaacaaccaaagaataaaatacacaacaaaacaaaaaaaaaacacaaaatagaaaaagtagaaacagcccccaacaagacagagaacgcaccaacaggaagacaagagaacacagacgaacacacaacacagataaacacaggacacccagacctgccaaacaaagaaaaaaacagaacagcccacacatgaaacacgacgagacaacaccaacgagaaaaaaaaaaaaagagaagaacacaaaggaaagaaacgaagtcaagcacaggagaggcgacagccaagacaagagcaaaaacagccacagagacaacagaaagaaaagcaaagaacaacacacaaacacacagcaaaacagacgcagagcaaagcacagagggagcaacagaagacagaaaaaaacacagaacagacaccaaacacaaaaacggacaaacaaaagacaacacagaaacaaaaaaaaaaaaaaaaaaaacaaaacaccaaaacctaaaagaacaacacaccaaacacgcagctacaacaccccacaacaaacacacaccacacgagaagcagctcagcagacaaagcacccaacacaccaccccaacaagaaagaaaacacaaacacaacagcaaacaaaataacacataaaccaatagaacatcaacacacaacgaaccagcaaaaacaaacagacaacaacaccacaaacacaacaaaaaaaacaaacaactaccacaacaaacacaaaaatcaatacaactacacctccaacaccacaaccacacaacaacaccaagacaaaagcacaaactcaaacctaacaacactacgcaataaaaacaacaaattaccacatcacacaacataaccacac

SEQ ID NO: 526730 - DNA, 305 bp, Homo sapiens
agctcgatgaatgaccgagtcaataaaatagcagaggatctgaaactgagaaaatatatttgagtacaaacagcttgtgaaacttaatacttttttttttttgggcttcttcagagggttcaacggaatttacaacggattggccggttcagtatgctgttcagatgtgagaggcgcttctctgtacagcagcctgtacgtgtctcaatcctatgcggtgaaggtgtctaccacgggcaaacagtttttctccccattgggtagtatgtggtgatttcctataagcaaaaagaggctcaccagcc

SEQ ID NO: 526731 - DNA, 933 bp, Homo sapiens
gcaaaaatggcagtgagcctggggcccgggccggttgccctgcagcgccgcggggaccttctgagttggccggtggcagtgagactcgtgcaggggcgtccgatgcgcggtggcccggtggacctcgggtgagagctcagctgctgcgtggccccagacgaggcgacagggatggacttgcgtagacagccatttgccgggcctgcggggctgcgctggtctgggatggggcgtgcctgctgcgggccggggccgcgctctgtgaaccggctgatggcgggaaggggccgccgtggtgctctggcacggccccgggcgtgtggcgggcgggcgagaagcttgagcgcgatcccgggcggcgcttgtgcgcaatcagttgcaggctcccgcccgactctgactcgggcggcgctgacatggtgccggccacaccctctggccccgattgcgccggctgccgcttcccaatgagctggaggcaggagatgcgcccggggcggacagcggcgtccccagagagccagggcccgtgaccgaccgtcgcggggaagtgccgcctggtggggtcacgggcgcctgaagcccacgtgcgccgcgagccgaggtggcactcgagcgcggcgggtgacaagcaacaggccgcctgaagcttgcatcccctggagctacctcccccggaggggaaaaggacttttgaatgtccaaaagaaaagagcaggggagggaatggcgaacatccacggattacgacagacagacaacagacaaaaggacgagagggacaatcacacaaaacaagagcgagacagagagaccgagaagcgggaatacaagacagaagagacaggagagagaagagaaaaccgccgggaatagacagaggccaacagagaaaaggacaccaaaggaagcaagaacaaaaccgacacaacg

SEQ ID NO: 526732 - DNA, 462 bp, Homo sapiens
agtctcagtattttccactacttaaaaaatgttttgggccagccgtggtggctcatgcctataataccagcactttgggaggccaaggcaggcagatcagttgagttcgggagttcgagaccagcctggccaacatggtgaaagcccatctctactaaaactataaaaattagccaggctggtggtgggtgcctgtaatccaagctacttgggaggctgaagcaggagaatcacttgaaacttgaaggcagaggttgcagtgagccaagtttgcgccactgcactctagcctgggcaatagagtgagactccatctcaaaaaaagaaatgtttttagtttacttcattaaccttttatgatctccgggttttgtgatgtgcttggaagaagttttgttctaggttataaaaatggttccagccaggcgcgtcgacgcggccgcgaatttagtagtagtaggc

SEQ ID NO: 526733 - DNA, 157 bp, Homo sapiens
gtccgaccggtatagtgtactcctgtgtggattctctggctgctgactacattggctctactgacgacgacagttttccccacaacgggtacatttatacggtttctctcctgtgtgtgttctctgatgtctggtgaggtgcatgccctgccggaag

SEQ ID NO: 526734 - DNA, 149 bp, Homo sapiens
attggtggaacgagagtaaaggccaacttcaaagaccagtgacaaccatctgcccctgcttcacactctctgcttggagaggactagtgcagctctgtcagttttagaagcaagttaatctatcctcttttcaagaggcaggagactgg

SEQ ID NO: 526735 - DNA, 500 bp, Homo sapiens
aagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgtgccaccacgcccaggaaattattgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacgcccggctaatttttttgtattttagtagagacagggttcagcc

SEQ ID NO: 526736 - DNA, 190 bp, Homo sapiens
ctcgtaacgacacctccgtaacgagcgctccgtaacgtctacgagcgctcctaacccttccgtaacagcgcctccgtaacaccctccgtaacaacgcctccgtaacagccctccgtaacgagccctccgtaacgaccctccgtaacagcgcctaacacccccagactccaccagctggcgctcgttagga

SEQ ID NO: 526737 - DNA, 1053 bp, Homo sapiens
aaccaagacagatgtcattggactctttcaaatggaagctagagatgacttcctcatactatgattacgatgtgtgtgccgtcttgttctgctcatcttggcttcgccgctttcttcctatcgctaagtctgttcgccatactgtaagaactaagtccactgaatgcattgacgtatactgatgagacccgaaactgatggcaaaacatggtcattctcgttcaacgaacgttctcaaaagatgtgacatgaccttctgggtgacacccgtaggtatcattttggtgctacctcgttcgtgaatacaacacgtagtattgcatcgcctcctcgactccagccgtcaattttaaactagtctaagagacgcattcgagtcaagcaaattccactgggggggaatccaggatctcatttgggccaagggacacatgacggctcctctccgaagagaaagtccaacgcgaaaccgaagggaggccacccatacattggctaccagtaactacaaatcccctgggttctcttacgccacggggccgtttatcagtccatctctaacgcaagtgatagggctatccaccatgcgtgtgcgaggccaatgaagtgcgaggggaggttctcagcacccgaggaagcagagaccctgaggactacatatggggccaacgtcgaaaggttggcacaacgagtgcgcaccgacacagcatttttcagcggaacacatgaaaacgtctaccctggcttcgaaaggcgcaacggatggctattgggctttccaacgtgtatcctaccttgttgtcataacatgggttccccggccgagccacattttcgaggatgcctatgggcactcccgataaaaggaaggccccgtacaggtgccttaggcgcattgtggttcagtcaccacttcgttgtcacttagtggtcgaacacgcaacacaccggaggcatctgttgtccaaagcccatctcgtgagacaagggtcgttcaaaacgcagaagacctttcgcaaatcctctaggaatgctacgcccttggagcactgg

SEQ ID NO: 526738 - DNA, 382 bp, Homo sapiens
  misc_feature (240)..(240): n is a, c, g, or t
  misc_feature (249)..(249): n is a, c, g, or t
ctcaaagattttttttttctccttaatttggcctcttttcctatctgtctttttacttatccactgttttcctttagtggtaaactgatacaactgttttcctattcaagcatagcctctttattttcctataatcccatgtataattttcataatttcctttcctcaaatctttaaaaaaatttggttaaattttcttctttctgtgtgagttacaagtgtttctgtgcttcctttccntaaaatggnaaaatatactactcaattcttaacctaggcacttttatgttttctcaggcattggctcagagctcccggtggcagggcaggttgtgaaatcctgagggggaaagacagtgacaggacaggacaggacatggga

SEQ ID NO: 526739 - DNA, 157 bp, Homo sapiens
tgtcactctgagaggatccccctggtcagtctgctcttgtgctccttgtcagtcgtgcttgtgacagttactgacaagtttcatgctaccatggacaacatgctctttatcctgccatattactacaaagcatagctgggctctatgtttggctctg

SEQ ID NO: 526740 - DNA, 490 bp, Homo sapiens
  misc_feature (18)..(18): n is a, c, g, or t
  misc_feature (86)..(86): n is a, c, g, or t
  misc_feature (89)..(89): n is a, c, g, or t
  misc_feature (146)..(146): n is a, c, g, or t
  misc_feature (298)..(298): n is a, c, g, or t
  misc_feature (304)..(304): n is a, c, g, or t
  misc_feature (331)..(331): n is a, c, g, or t
  misc_feature (338)..(338): n is a, c, g, or t
  misc_feature (355)..(356): n is a, c, g, or t
  misc_feature (364)..(364): n is a, c, g, or t
  misc_feature (375)..(375): n is a, c, g, or t
  misc_feature (384)..(385): n is a, c, g, or t
  misc_feature (428)..(428): n is a, c, g, or t
  misc_feature (452)..(452): n is a, c, g, or t
agggacgggaagccgganaaggacaaacaagcagaagagagaggccagagaggaggccagacgaaagaaggacgagggaaaaaacnaanaagccaagggacgagggaagaagccaggcgaaaaaggaaccaacagaaagggaaacnagaacaggagaggacgacaggagaggaaggggaggaagggaggaggccagcagagagagccacaggacgaaaaacagcaaggggccggggaaagaagaacggtgaacgcgcaagggaggaggaaagatcaacggggggcacgcaaggacagntacagnatgatgaccaggggggggatgaacagngataacnggttataatggccatannacagggcncataggagggncaacggggnngccacgaacggaatgcgccaaagacgcacacgggaaagggcanaaaagaagccacaaagagggaggncggaagagggggaataaacaatggacaaagcagggggc

SEQ ID NO: 526741 - DNA, 445 bp, Homo sapiens
  misc_feature (131)..(131): n is a, c, g, or t
aataaaatgggtgtgaaacttttcatactctgctctagcaaaacacagtaaagacctctaagcatctttttttaagaaggtcaatgtagtgattagctttatgtgaaaatgtgactggtctacataccccnaatgatatgggttggctctgtccccacccagatctcatcttgaattgtagtttctataatctccaggtgtcctgggagggacctggtgggaagtaattgaatcatgggggcagttacccctatgctgctgttctcgtgataatgagttctcatgtgatctgatggttttataaggggctgtccccccttttgctcaggacttctctttgctgctccacttgaagaagaatgtgtttgcttcccctttcaccatgatttcctgaggcctcccccaccatgctgaactgtgagtcaattaaacctctgtcctttat

SEQ ID NO: 526742 - DNA, 1118 bp, Homo sapiens
gagttactgagaactcataagacgaagctataattgctcttgcgagtatccactagtcaaccggcgctgaagacaatcgctgcaagaaagcccagagaaaggagcgccatggattactacagaacatatgcatgctgatctggtgcagggtcgacatggtcggtgtttcgttgcatgttctaccattccgtctcgctgatgtgcaggattagagctgagcaatgacaccgctatgaggacataaacctcaattttctttcttcctcagtccggggctgcccacatatgagcttacgagaatgcagtgggtgcgtggactgtctgtactgcgtaggagactatgagtcccgcatcgtcccggacttaagggataccaacgaaaagcagcggatgattctgtggtccagataaagaaagcgggtcaatcacgtccagcaaggtgcccatcctctcgtgcatcgcagttaagggcttatatatccagttagtgaaaccacggggttacgacatgataaatgagagcggtgtttgtcaacaagctgggtaaggagagcgcatcgatcgggctggtgtcccaaacgtggtcaagataaccttatgcgtccaatcttactcgagagaactacgttaaaattggctatgtaaacccaaaacgatgggttgctctatgaattgaggtgtgcgtagagatttattggctaggagatgggatgaacatgaaatgtcaggtggaaaggtagtctatagatggcgacgtttgtgttagaagacataaggaatttcttgcgttatgaatcccaatttaatcgaagtaagaacatgtttttgtggacctagcgggcatcttccaaagggggagttaataaccctgggacaagggcgtatttatagcggggcaccttatttcgcgttccactttgtggattccaccttaacgatggtgaaacataagtccaggcaatggatccttcaaggtgggcgtcttttccacaagtcctgggaaatgggaaactaaccatggcaatttgttatggatttgtgtggtcaaccgcaccttgggtaggaagtcaaaacaggcgccttgtggaaaaactgggttcctgatggtatatggcaag

SEQ ID NO: 526743 - DNA, 603 bp, Homo sapiens
gggaagctggcaggggcacgagccgggggcgggttgaagacgcgtcgttgggtttggaggccgtgaaacagccgttgagttggctgcgggtggagaacgttgtgccagggcgccggtgcaagaaaggaggcccgcctgttacgatggtgtccatgagtttcaagcggaaccgcagttgaccggttctacagcaccgggtgttgcgcgtgtggccatgtccggcacggggaggatcatccgtgggggacctgttacatgggtagtaaaacccttattgtgtggcaattgggctgactgtggacaggtgactcatcaaaactccattgccaagttgtcaactattcagtatgaacgtcactcggaatacatatcgtctgagaaatggtgatattgcctgtgtcctttgggcggcctctgtccttatgtaataattcagtccaaggctggttaagtggagcaatttcttatcaaggtggtggcttgattccattcttctgtaccggactttgggattcgccctcagttgcctgtagcaatagtcttctcactattggcaagaatcaagatttctgatactacctgttccctaaaaatactctggct

SEQ ID NO: 526744 - DNA, 167 bp, Homo sapiens
gtgagccgagattgcgccattgcactccagcctcggaacgagtgaaactccgtctcaaaaaaaagaaaatgctttctcttccttttatataaatatcgttagggtgagcattatggtccaatgattcaaatgttttaaagtttaactcctagcagagaactgccctt

SEQ ID NO: 526745 - DNA, 954 bp, Homo sapiens
actcaggagctggtgggctctctattgcatttcatagacaatgcaaagagagcccaccagacttccgggacacttgactcaggagcacgatgctgtgctcagctgtctggtacaagtcaagctggcctggagggacggggaggatatcatcctcagggtgccatccatgacatcgcgcgttctatgtcgggatgagctgcacacctggtggtcctgaagacagcgccaggaaccaggatctcccccagccagagtctgtgtgcggaaagttccagaggcctcagtgcacgctccctgtcggagagtgcagttgggcccgtggaggcatgctgctggtcatcctggctgcagagagcaaggtcgctgcggaggagcttagctgtctgtaggacaggtcttacaggttgttacacggagtccagcatcgactttctggacagagcgagtatctgatggggcctctacaccgaaccacactgtccctgcacaggatgatcttactacaaaagtggacattaacggagactacgacgtggacagccagacactttcttgcttcccctgaatctgtggatgtgggtggtgaatcacgcccaacagcaagacacatcagtggcagagcgaagcgacagagcacgcgcgccaatgagccgccgtgcggacacaacatgcctgagacgcgcaccaagcgtcatcaccaggtagatcggcatatgccgcacggcggacgagaacccaagcggcgacctaccaggagcccgcaacaacctggcgcggcacgggaccagcggaagagccgcgaattgcggagcctcaccctgacaacggcggacctttggaactcgcaccacctgctaagcgaccggacaccggcagctgcgagcgcggccagcactggcaccacgaaaggcacgggctagcgaccccgcgcgcgcagaacaccgcgggcgcacc

SEQ ID NO: 526746 - DNA, 1987 bp, Homo sapiens
gcgactcgcacaagaaggaaccccgggcctctgtgatcctgctcgcccggctatgctgctgtgtgccgctgcctggtggctgggcctgccggtggctgctgcgctgctttgtggcctggtgaagctcgcgtgtgatgccctgttgcctcatgtgcccctgggcctgcggagggtgcagctgccgcgtgcctgtgctctccctgctacaactgaacatcgtgacaaaccgagcgacacaacatcagtgactctgtgtcgagtggcactactttgcacgtgggaagacgacatgcctggaattactatctccaatgcgagagacgtccgcaggtgttaacggagcctgtgtccacgtggcacgaaatgtcctgtggccacaatcctctggtgcctgattgtaccacgatgcctctcgctggggtcttactgctacagacttatgtgcagctcaccatgcttgacatggcatactacgtgctcaggtgtcatactgtacggttgatggagaggtcgattcacagtgcaatgatacattttgtagagaacctgtatagaagtgggaagatgccagaagtggactatgtagtacatgaaggaaatggcttgaagaggaacgagcgcggaacatcgacacgagaaatgttgcatacgctaatatcactaccgaccacatatctgaacacattgaaaccagcttgttacatccttcacactacttagcccagggagaacggcacacggcggagacaactgggacacaatccccaatctgcacgcgcaatcacgaacaacgaccgacacacacagaccctgattggcctcagcctccacccgatcgcgcgatctacacacgaaccacatgcgcacccaaaaacactaaatcaccaatccaatcgacagcccagactcaacgcactctccaccaatggctacacatctccgataatctctcataacatactcctttcttctgctccccctcttactgatccactacagactaaaacgcaaaccacacaacgaccacagctccaaacacactccacacaaaccaaaccacagaaccaacaacaaatacacgaagcaaacgcacatcacacactgaaaccaaaccgaacgacaacagcacctactactaacctccgcacaaacagaccacccacatacaaccatcagaaccattaagtacaataaccaagcatcaagaatcccagcaacaccaacaactactaaactagccacagacaaccagaacgctacacacagagactccaaacgaccaccaaaacatccacaccacaatcccatacagataagccagcaataataatcgatactgaacatgaacgacacacaccacaacagctacgaacacacatacagtccacagcaagacaccacacatcagcgatcagcgcaagccagacgacacaacgcacggcgacacacgcacaacagacgagcgacagtcgagacgaaagagagggagagcacagacacagagacacgcacgagcagacgagagacgtagcaggcgcaactgctaggacgatggacagcagcaagaaagataatgagagacgacaacaggatacaacgcaagagatgctagacgatacacaacagaacatgatggccgctgacaacggaagaccaacgacaaacactggacagagccgcgcatcagctagccgctgagaaggagcaagtacggagcaggcggcgacgcaggaaatgccagaagcagagactgacagacagggagcacgcaagcgcgagtacgcggcgcagacaagcaccccagacgatagcgcctagagccgatcaagacgcgacggcacagcacatagacgagcaccgtcgagagagcctgggacacagaacgatccactgccgctcgcgcggtcatctggcagcaactcgggcaggagagacagagcgcagaacacacgagagagctggaagtaatcgagacgaagcgagggca

SEQ ID NO: 526747 - DNA, 315 bp, Homo sapiens
gattgtggtgccatgcgcctgctactcaggaggctgaggcaggataatcacttgaaccagggaggcggaggttgcagcgagccgagatcgcgccattgcactccagcctaggcgacgagcaaaacatctcaaaaaaaaaaaaaaaaaaaggaaaccgcacccatttcccagccgggaaaactttttcctgttttcaccatcccaatgcagaattttcaatatcccggaatgaatgtttggagaggggataaggaaggatgagttctgctgggtcaatttaaccataatttttttaacactggcttggtggcaagg

SEQ ID NO: 526748 - DNA, 202 bp, Homo sapiens
tcggtcgcgaatcaggttaccacagcacagcaacacctggtagaccacgttcacctctcgagccagtggagacccagaataccatggagcaccaatgaatgaccctgatggacctgtgattcgctggcggtacccgagcatcgaaattccgtaactcattggtcactagcttgtttccgtgatattacggggcacccccctg

SEQ ID NO: 526749 - DNA, 254 bp, Homo sapiens
ggcacgtctgtgtgctgcgcgcgaacgtcacgtgcattgctgcccgaactgtctggatcatctgtcaacgcagtaaagcaggttgctctgccgttcttgttgccggtcacgagtaccttgctggtgttgctgaagacttcctgcatggtgtccaggtacagacgctggcgggtgacttcaggggccttgcgatattccgcgaccagtttggtaaagcggtctgcctcacccttggcgcgagacgttcgtcacgt

SEQ ID NO: 526750 - DNA, 228 bp, Homo sapiens
cttgttgcttgccagcttctgcaggcatgcagactgcacacacttgtagaaggcagcgggtacctccacctagatttcaaaggctctctctgaaagcctcagggcccaggtagagcagctagccagggatactgcagagaacctccactaggcaatgtcaaataggagttgtagggtataaggcccattgtaagcagagccctagtcaagtaacaagtatactagtag

SEQ ID NO: 526751 - DNA, 190 bp, Homo sapiens
tccagccaacgcgaactccaagcattatgttggcacgtggtcgttagattctaccggcgtcgactgttggagacattatgaacgcggcgtctgcagcgcacacgcgcacgaagtcctcaggagcccgtctatagcgtagcttacagccctgctgcgtaagtacttgggcggtggttccttcgaccagtgc

SEQ ID NO: 526752 - DNA, 1455 bp, Homo sapiens
ggagcgcaagggcaacctgtcgcgcgccgttcctgtcatctgccgccgacgcttcgcgtctctgtaacgtgaccttgctcatccggtgtggatgctataggcgagtcggggggcgccggggtctgctccagcgacgccccgggagtttggagcatcatgggtcgcgggcggcgcgacgtgtgaattgccgtgccgtgtacacgtcagagtgacgtactaaaccgattgaagtgttagatgagcgattaggctccatctggcgacactgcccgctttgcaaacgtcggccagtgtgaatcctgaggagtctcttctccgatcatattcgcagtgcgcataggccccagacggtcgagatcgacggctgcgccgagtagagagaacgctatccaagacatggccacattgttcaaggaggccccccgaaataggtctgacagcgtccttggagaaccgtggccgattccaatctgtcagggtacgtcactacggcacggtgttgcgaaacggcgaagcgacccaagattaggcatgtaccaagcacttttccttggagaggagcccactgattaggttgctcaaggtcgcttgtgaaaccaatctattgaagcttgtccaatggcgcagggccgccattgttcaacgcaaggggccccctgggagagagcaaggattgagcgccagagttcacatttcatttggttaaccccacatatagttcctccaaagagcgtgttccgccgaggagttccagagtcgtgcgcaggcagcccggttctaagaataggggggcacgacagctcgatgtataaatcggttcgcttgggtcacacctcgaagcattatggttaggactgtcaggatccgcttgcgaaactggacattcgatgcagacttggacgcaatgccttgccatttggaagcataaccacgaaaattggtcgagagcagcaatcacaagttccgagaaaagaaagtctccgatgcacaggcaaccaggggccacagagcgtgagaagcagcggccgatcatagggtcgttagccctagtgataccgcaccaaagtacactttgcttagcgccgggggccatccgccgggtattgcactacggagaaggcgttacactaacagacacaggctttaagaacagggagatcgcattggaagcgaattacccagcaaccactatgcgtgcactttccagttccagccccggtggccaagccacggcgcagcttaggcaaagaaacgcgttcgggaagcactataggtagagagcacagggcgagcacctccgccactctatcccatctagtagaaccattcaaacgcgccttgggtgattaaacgccgctccattaaccaattgtcacaatcggaaggtagtcgaagctgaactgcaaacaacttcgcattggtcggactatggaacattacaggataggaagcacg

SEQ ID NO: 526753 - DNA, 960 bp, Homo sapiens
  misc_feature (388)..(388): n is a, c, g, or t
gaaagtgccaaaccattcacgagggatccactacctagacccaaacacctccccctaggccccgtctccaacagcggggatcatatttcaacatgagacttcgaggagacaaatatccaaaccatatcgcccacgtttaggaatgtctctccatggtagatgatttgcaaatagacggtggtatacccattccatggaagcagggaaatatgtttgcacgtctttggttagtcctcttcttttctactgacagtgggcttgtccatgtgtcctgcatgatcaaaatgacaatagcaaacttgatggccacagaagattgaaaagtgcttgggcattgagcttgctctctcttgaagtgcttggagccctgagactgccatgagaccanataaatgatcactagctagcctgctggaggatgagaggtcacttgagaaaccttggctcacagcctgcttacaccagacacatggatgagtctgtcttagactatccagctccagctgagttgccagctgacttcagtcacatgagtgagaacaacagaaggacagcactgagctctgccaaaattgctgacctacagaatcttgagctaatgaatgattgtagctttatgccattaagttctgaggcagtgtgctatacatagcaaaagctaactgatacaaaactaaagatacaatggcacaaacatgaaaagacatgttcaccgaagcattgcctataatagttaaagactggaaacgactcagatgtccaccaactcaggagtggttgaacctactacagtgcattcaccccgtggaatactaagcagctccaacaggggtaggaaatttgtatactttcataaaatgatctttaggatatattgttaagtgaaaaaaacaaggtgtagaatagttaatagagtatgctacctcttatttaataaagggagaatataaataaaaaaaa

SEQ ID NO: 526754 - DNA, 101 bp, Homo sapiens
ttgtctcgttgctgctgctctatgcgccagtctgggttctgcctcctcgtcttgcgcctctttctcgggcatccacgtctatcctggtccagctgcgctgc

SEQ ID NO: 526755 - DNA, 745 bp, Homo sapiens
cagaagggaatggatacattcgaggcggactcacgagtggatgcgatctgtctctcctggctccattcttgccgccttccagctctgaatcttgggaatgtttgttacccttggaaaataaagctgctgtcttctagggaactcagctgtctggcgaggcaacagcatggtgtgccagtcatttcacgactctgatgattctcttatctcgtctatgtaggatatccttatcagccagcacgtctccttctcgcagacccacaaacgtcgtcagcactccgagtacacctagctccagatctgcatcgactagctctgatgggcagagcgtgggccccctgaaacccactgagtcttcaagtttgctcttgtgatgtcttggtgtgcgcgtgttcccctgtgtcgcttctcgcactggggcatggagtgcccatgcatactctgactgccggtcccctcacctgcacttgacggggtctggtggcagtccctcgctctccccagttgtccacagtcactgacccagacggtcggttggaacagtgagactcgagggctgagcgtggatctgaacatcgacaggccctgtacttgggttgcctcttgtccctgaacttcgtagtaccagtgcatggagagaaaattttgtcctcttgtcttagagtggtgtgtaaatcaagggaagccatcattaaatagtgtcatttctcgtcaatgtaaaaaaaagaggggcggcgggtcataa

SEQ ID NO: 526756 - DNA, 338 bp, Homo sapiens
cgggatgcaagtgtctagatgcttgtagcttttgcaccgtagctcaatcctccacttgccgacagggcgtgctgggccggcactcttgtcagcttctcctgtcctttagtcttggtctcagccaatcagatcagctcttgctcagagaaaaaagaaggctaaggggaacttcctcctctttctccggccagatctagaaatctgcccgtgcttgcctcctcccctgccttttcccccatgaggtggaagccgtcctgctagggccagtttagtggtgggacccatgccctccagccttctcaggaaccgtgtgcggagtatcacctgtttcccatgga

SEQ ID NO: 526757 - DNA, 129 bp, Homo sapiens
acggcgagagattcgctatcgcatgacaggtgtcacccccaggatgcatgcgctcagtgactaagacaggccatacgggaggcaagatagaaggaggtcaaggaagagcttctgcattctgagaagctt

SEQ ID NO: 526758 - DNA, 288 bp, Homo sapiens
ctgaccccttatctcagcatgcctacgtgtactaaccccactaaagctcataaaaaccctgtgagggttaggaagccaaggcaggcggatcacatgaggtcaggaatttgagaccagcctggccaacatagtgaaaccccctcctactaaaaacacaaaaaattagccaggtgtggtggtgcgcacctgtaatcccagctactcgggaggctgaggcaggagaaccgctcgaacccgggaggtgaaggttgccgtgagccaagatctgtcactgcattccagccaggg

SEQ ID NO: 526759 - DNA, 347 bp, Homo sapiens
  misc_feature (87)..(87): n is a, c, g, or t
  misc_feature (108)..(108): n is a, c, g, or t
  misc_feature (145)..(145): n is a, c, g, or t
  misc_feature (175)..(175): n is a, c, g, or t
  misc_feature (220)..(220): n is a, c, g, or t
aagcacacgcagttctggaggactttgcgggcaacctggcctcccgggtgcggccgcgcgacctccctctgcttcgtgtacccgctngatttcgcagacccgcctggnagcgacgttggaaagtcagcacagagcgcgagttccnaggcctgggagacttcctggtgaagatcancaagtccgacggcatccggggcctgtaccagggcttcagtgtctncgtgcagggcatcatcatctaccgggcggcctacttcggcgtgtacgatacggccaaggcatgcttcccgaccccaagaacacgcacatcgtggtgagttggatgatcgcgcagaccgtgacggcct

SEQ ID NO: 526760 - DNA, 322 bp, Homo sapiens
gcggccgcctactactactaaattcgcggccgcgtcgactgcccgtgtgctgggggctcactggggctgcataagtgtgatgcccgtgtgctgggggctcactgggggctgcataagtgtgatgccgtgtgctgggggctcactgggggctcactggggctgcataagtgtgatgccgtgtgctgggggctcactgggggctcactgggggctgcataagtgtgatgcccgtgtgctgggggctcactggggctgcataagtgtgatgcccgtgtgctgggggctcactgggggctcactggggctgcataagtgtgatgcc

SEQ ID NO: 526761 - DNA, 448 bp, Homo sapiens
cagaaaataaggacaaggtctgggtgtagtggcttatgcctgtaatcccagcactttgggtgaccaaggcaggaggatctcttgaggccaggagttgcagaccagcctgggtaacatagtgagaccttgtctctgcaacaaaatttaaaaattagccagacttggtggttcccacttgcaatcccagctatttgggaggctgaggcgagaggatcacttgagcgcaggaatttaaggctgctgtgagctatgattgtgccactgcactccagcctgggtaacagtgagaggcctcatttcaacaataaaacccagcttgggccgggcccgcaacaaaaaacctttaatcccagcactttgaaaaaccaagacgggcagatcacgaggtcaggagatagagaccatcctggttaacacggtgaaaccctgtctctacaaaaaagacaaa

SEQ ID NO: 526762 - DNA, 925 bp, Homo sapiens
  misc_feature (93)..(93): n is a, c, g, or t
  misc_feature (925)..(925): n is a, c, g, or t
cagtctctgtgtaaggtctacgcgcttagctcgtcgtgaaatatccgtagaataagattttcctctctgttgaatgcactagatatgactatnaactagcttacccaacaatatcctcggagtcacgggtgttgctcatacgcatatcgcattagacggtttacatgtctttttaatcgctcaagttgtataatattactataaattaatttgtcaatgatgaaaaatgatgtagacccactgtaatgataggagataaggtgaggaaggcaataacgtactaccggaggttagctaaaatatgacaggaggttgttgatgtagcttcttctgtgtagtactccttgtatctaagaggaatagttgcgtgagataggtactactaaaacacgtaattaattctcaaattagaagtgaaacggtatctatatttaataattgacccgagtgattgaaagagattcaaattttccctctaaactaggtctgttgtggtgatctcttacaatgaatctgaaaggcgatcttgtggaacggagataggcatggaggtgatgaacatgatgcattgaaaatacaatgacgcatggggatttgatttatccaaagcttagtttactccattccactgaatactccagacgttccagggtcgccattgagtgtgggagtggtagagcatgaagtcatgcgcagacaccccaaacgtggatgtggacaggctggatccccagcactaccgggagcgcaacatactggctgtcaaacagtatggcctgtccaagaccacacacatggtttggacgcaaaaggctgtccacccccgcacggtaggagggataacaagacagctcgggtccacaagcttggcggatgccatcaaccacatccataacccacccgcctcgcgcgatctctctaccan

SEQ ID NO: 526763 - DNA, 294 bp, Homo sapiens
tgatcgcttagtgggtcctgccagtcctccgcgacaaataatcgactacagagaccaccgggttgaagtgcgcaccggaaaaagtggagaagcacacgatcagcacgtacaagctacgtcgccggtatgccagcagcatatggcagagaacgcgctagacgcatacgtttaccgttacgcacagacgcgtgacccatagattccaagaaccaagctacggtgcacacgcagaactgactgtaccgcagaaactcagccaaagatcttccgctgatagtactcagttgggatagc

SEQ ID NO: 526764 - DNA, 1523 bp, Homo sapiens
  misc_feature (1102)..(1102): n is a, c, g, or t
tggggctctagaagggggtagagggggtgctatagggtaaatacgggccctatttcaaagattttaaggggaattaatttcttaggacgatgtgggcattgaaacgtggtggttggcctccacagattttcagagcatttgaccggtagttatacccccgggtcggtgtagcggttgaaaggtggttgggtttaaaacgctccgggaaattgtgcttcgtggttttataagccctaagtggtggggcaccagctctcagtggagtgtgcaagaacgtctctggggaagtggtacattattatacgaaagtggggggcttcaactcggggaggtcacatacctcgcgagtgtggctcaaggtctcagaggagagtctcgccgaggtctcgccgcgtgggtccatgaggaacattaagtgggggaacagttattgtgtacgggagttgtgaaagaaattagatcgcggcgcggatagatccgggtggatacctcgcgatgaggtgttcagaggtcacccattgtggcgtggggcccaaagtgttgatttttgagagtgtgtgatagagggagggagagcgaaactcgtgtggagaccctctcgtgctctgtgggtaagtgtttaaacaaggaggagttcgcgtgttatgagggagatctgtgggagaagctgtggtgcgagaaattagagaggaggagctactaaagagagattagaaatgtggcgcgcgggtgaccaaggggaatataattgttttccacaaagagacggggggagagtctaccttaaatatttcccctgtgagaagcgctgttctgtgagaaaacaagatgtgttctcaggaagataaattataaggagttgaaggaatatatggggggatgtagtggtaaacgatttgttgtttttcaggggcacaaacccagcagggcggggcgatcattaacccgacggggggcgaccgattaatgtggacaaagaaagacgccaggaatcatttataggggcgcgagcaacacaacagttggggatgctttttaataataagaaaggggggggggaggggtatgggaaacaacccccaggtttggtacaaaaccaaancgggggtggtcggttgcataaaaaaacagagagcgctctcctatcttctattaaaagatggagtaaaacacacagggcgcgcgggggaacagaagataatacatgcagagaggtcttctcttttgtggtttgtatgagacccccccccaaaacaaaaatgttgggcaagagcaacctttctttcaccagctagagcgagccagagacaaaattgatagccacgaacttttctcgtacagagaagaaaccccccctatatatttgtagtcattatcaacaccaggaggggcgaacaaaggtctggggagggtgacccaacgcatggtggttggaaggaagagattgtgtcccccggtggcagagaacgaagaagaagaaatatgtcggtggtcggttatcatatttaatttcaattgaacag

SEQ ID NO: 526765 - DNA, 265 bp, Homo sapiens
cattttttgtgaacgtcagaagtgtaaacacgttaaattttatggggaaaacgttttcgtttaagatttagtgagattgtcgtggacacagtgatatctgatcttaatatggtacaagagacgattcgtttaaaaacagaaagaatttgagtgggaggaagagggatatcacacgatttgaggtgggaagacgacgcttcctctgtccacataaatctgctgtgtgtgtgagtcgtcttgatcgttactgagagacgggacattg

SEQ ID NO: 526766 - DNA, 345 bp, Homo sapiens
ccagaggacagcgatggggcagcgactttatgcccggtaccttcaagcgaacacgcgtcggcaaggcatctatggcaaagggatgaaccgtacctcagcagaagaacgacaggagtctcgaaaaagtatcgacaacaatctagtcgaaactcgcaggcaaatagcacatcggtcgagaatcatacattacggagtagtacatatgggatcatcgtcattcccgaagaaacgattgaggacatccgacgggctgtcgatcttgtcgatgtaataagcgattctgtccagctcacgaaaacaacgacaaaattattatggactatgtccgtaccatggggagcaaag

SEQ ID NO: 526767 - DNA, 431 bp, Homo sapiens
cgacctatcgtatcggggtggggttcatgcgcgtgcaagtagctccctcagtcgatctgttgaaagtcagcccccgatccaagggtttgtagagataataaaaggttttaaaatggggaaaaataagtaaacttttgtacatcaaagatcatgaccaatagcgtgaaaagaccacctacagaatgaggaaatgtatttgcaaattatctgataagaggtttttatgcagaatatataaagaggttgtacatctcaacaacaacagaaaattaaaccacccaattcagaaatgggcaaagaaggggcttgagtagccatctctctaatgaaggcccacaagggccatttcccacatgaaaaggtgtccagcatcaccagccaccagggaagccaaatcagagccacaggtgagacgcacctcagaggatgtg

SEQ ID NO: 526768 - DNA, 175 bp, Homo sapiens
  misc_feature (84)..(84): n is a, c, g, or t
  misc_feature (99)..(99): n is a, c, g, or t
  misc_feature (157)..(157): n is a, c, g, or t
gccaaggagcaatagaatcacagggccactgggacttggagaaccatctgattatcgggggggttctttagatttttttaaacntataattggaacacnccttagtattttaaagaatatgctctttgaaaagatgaaaagagtttctcccgggagncggaggctgcagtgagcc

SEQ ID NO: 526769 - DNA, 852 bp, Homo sapiens
tggggtataaaaatttattatacataaagaatataaccactaacaaatgcaaacaggctaggacatggtacggggtggaggacggctagctcttgggaaagtgaaaggttgggttggcgtgggcctcatgccacactgatgggtcagtagacggggggcacatgccaaacaccacagggcatcagatgctgctcggtgtgctcacaagtgtccccggtcttatcggggccttcgaagggagcacacccagaaagcgagcaactgaagcgaaggggcttcctaaggtgccccttccaggctgtgtctctgaagtcacagcaacacggttttaagcagtatgttctaatgggagtgattctcccacaaactatccacgaagctttctaaccatcacaattcagctgaagtacaaacacactgagtttacaggcggggggaacgagagggcagccccaatggggggccccttctaatacgggctggtcctaggcggcagggagagcgcacaggtcttttttaaaccaagcccctcatttcatgtccacagcgaattcactcccgatgcgattattaaatctcgtttctgccacaccatcttgggccttaaacaagcaaattactacttcttatgttgggggcggccacgcgtggcgaggcaacagccatggacgtccttcgcaaagccggcacaggggcatcttcgcgggggaaccggtttcggtggccctgtagcccctgggcgggccccacggttgccccactttctcttccgcggggctcccaggacgcgcgaattttctcttctctgctccccttcgttggcctggagctttcgccggcgggcccgcgaca

SEQ ID NO: 526770 - DNA, 184 bp, Homo sapiens
ttcatcgtatcgagcggatgtccatggtagcgatagtagcaacccgctacccgaaagtacagtagcgattcgctgttgatttttcggtagcgactcgctaccatgactttcatcccggagatagtcgggccagccgcaagccttcgatcaggcggcttgcggcttgtacggatacggcggggct

SEQ ID NO: 526771 - DNA, 176 bp, Homo sapiens
gtcggctatatgccgttaatttgaacagtgacaatgatgtggaagaaggtcaagaacagccactgaggatggctcctcagctgccagaagaggtgccactgtagagtgcaaagcagtctgaagctgaagttgtaactgaaatccagcttgaagaggatcagcctaaagtgaacgga

SEQ ID NO: 526772 - DNA, 128 bp, Homo sapiens
  misc_feature (15)..(15): n is a, c, g, or t
  misc_feature (58)..(58): n is a, c, g, or t
atagtgaactggaangctgaactagtctcaaagtctcatccacagagcggcaacaggnaggtcatttacagtgatctgccgaagaataccctcatcatcacgtttcctttttttactcacctgcctca

SEQ ID NO: 526773 - DNA, 793 bp, Homo sapiens
aatttcttcagcaatcaccagtagaccacaggaatttaataccttgccaccaaaacttaggcaaattaagtccccagctagaaggagctacactcaatacacagaaagacaaatgttaaggtgaccagcaagtgtaaaaagcaggcagagaagggataagtcgtcatgcttgttgccattatggagagggtataaccttaagaagttgctaatcacatttctattgatggcagggaggagcacctgactttatgcatgagctgttcatgtagttaaatgactgttattcattagaaatacagtcactctgtaaatgatttgtaatgaacacttaggcatacgctgcctggtacatctcctgatagccctggcctggaaattctgctgctgactctgttgagaattagtcctgagactttgggcaaacatagttttctcatctttaaagtgagggagtctgacccttgcaggtctaaaattatttgtctctggtcataaacatatctcgaacttcagactcatttttggttcttatttcttctttttgtgttaatcaccaagttctgttggtccttccttctaggaaggaaattgtttttgaatctccctgttctgtctattctcacagctacacatctgctgttacatcatggttggaccattatagtagcctcccaaatggtctccttgtctctattttctcccatccttatttgtcctgggaaatctctcaatctttttgaaataccaatttccctacctcacttttttgaataaaaactttggagataaa

SEQ ID NO: 526774 - DNA, 435 bp, Homo sapiens
gggaaataggtactctcataacagctgacagaagtacatattgaagaggacaatatggcaagtccttcaaaattataaaagcactaactctttgatccacgtcgtttccacattctagagaacttaacccttcacgctatattttcaccacgctataaaatgaccataccgtacacgaagttacttactgcactcatttgtaactagctaaagacttacgacaacaattacatcgctatggaaccccttaaaacaaggtggctctaaacttccttaagacaagatatcccaaaacaacattacaggggacacaacgggacgggattgcatacaacagcatgttaacattaacactaatttgtctcaaagcaatggggaacagcagaagcggtagtcatgttcaccttcaatcctttgccaactcctgcctttaat

SEQ ID NO: 526775 - DNA, 702 bp, Homo sapiens
gggtaaagtctagttattctgactgcttatcattattactgttgattctggtagtgaaaaaaaacttttgaattccattgagatagtaatgaacacagaattgtaacaatagacagatggaagtaatataaaaacactgttgaatttgaatatttcttgcttttttgctttcacagaaacacattattttacatttactttatataagtgaggtattttatggtgttttctaaattctattaagaacattctaaaaagaaaaggtgactgtgacagacagattaaaatccaatccacaggcagtcccctttggcaaaccactctgattaagtggctctattttatttcaagaatatatatctcttgcccctttaggaaatatgtgaatgttttccaaaagcaagtaaagagtgccacatcttaagcactagaaagcctatgagctttatctgggatctttgctttcataggcttgtgaagaaaatctgaacatgcagacaggcagtcactgtcacatattgaagtttaacagtgactagaggaactataaaagcccaaaactctatattcattctgcagtcatacaaagagcagagggtgaataatttaacttccaaaacaattagtccagtcctttacttcaaattcttcaataatcctccttttcctatagcagtcatcagacatgtacataatacctct

SEQ ID NO: 526776 - DNA, 200 bp, Homo sapiens
taagatatgaatggtgaacagaatgacaaatacagagaggaaaatggagatatatgtggaaaagtacagaaggctccaaacagagaggcagaaagaaaaaggaactgaagttccacagggtctgaggtttcttactcttcattcactccctgcagtttattaggtccaaagcaccagcgcttaccagtgtggagagaggt

SEQ ID NO: 526777 - DNA, 385 bp, Homo sapiens
  misc_feature (24)..(25): n is a, c, g, or t
  misc_feature (115)..(115): n is a, c, g, or t
  misc_feature (130)..(130): n is a, c, g, or t
ctactactactaaattcgcggccnntcgacgttctttttaaaaaaaaaaaacttgtgtgaaataatttccgagtagctgggactacaggcatgcaccaccatgcccaatggtggnacagcctgtaatccntagcactctgggagactgaggcaggcagatctcgagtcccagagtttgagactagcctacacaacatggcaaaaccctgtttcaacaaaaaaatacaaaaaatagctggtcatggcggcatgtgcctgtagtcccagctacttgggggctgaagtgggaggatcactaaagctcaggaggtcaaggctgcagtgaactgtgatcgcgccacttgcactccagccttggggcaacaagagtggagaaccttgtctc

SEQ ID NO: 526778 - DNA, 284 bp, Homo sapiens
  misc_feature (47)..(47): n is a, c, g, or t
  misc_feature (80)..(80): n is a, c, g, or t
  misc_feature (92)..(92): n is a, c, g, or t
  misc_feature (98)..(99): n is a, c, g, or t
  misc_feature (105)..(105): n is a, c, g, or t
  misc_feature (107)..(107): n is a, c, g, or t
  misc_feature (181)..(181): n is a, c, g, or t
  misc_feature (195)..(195): n is a, c, g, or t
gcaagagtccatggatgtacgccaagagggggcaggagtggcgctgnatccacattcacttcagaagttgaagattccanagaggagaatangtggcnngagggnanacaaggaagagggtttggccctgcttcaaggcccactgcgtgcgtaggtgtgttgagcaagatgacgacagatnggaggagagctcanagccagggccctagcgcaccatgtattcgttgcgcttattgagccgaacttggcagaccgagatgcctccgaggaggaggtcaaggcct

SEQ ID NO: 526779 - DNA, 294 bp, Homo sapiens
tcgtgagtcgccgtgatcgcatatgatcaggcgcgcgtgcatgccgtgtgggcagtggccgatcgtttaacagcgtgagcctgcgcaccgccaccttcatcgtggcgtgcgagcgcatctgcgcgcgcgcgatctgcgtgggctctacccctgaaaccccctgctcaatccgcccgggggcgcgctactgcagcggccccttgagcagcggcagatccggcagcggcagcacgggaacgcccttcctccagcaaggccgcggactcgtccggcgtcgcgaacaccgcgaatgct

SEQ ID NO: 526780 - DNA, 466 bp, Homo sapiens
aaggaaatcatcaaatctgacggaggtaagggggagcagaacaaacctccagtaatacatgagctatcagcatctcccacacaagatcactcctacaacaacataggaggatcctccccttcttactgctcacggacttatctaggcttcccagtgcccccaggacagcgtgggctatgtttacggcgtcatccttgctgtgtgtgtacctcatgcattgtggctccagcttatactcagtgatctgtagagagtgtccaccttgtgtcactgtccactcttccagggtgggccccaaccctcccatctctgcaccccacaaacaacatggtcacccacgtatttgtgtgtgtcctcactgaaactgagcgagcagtcttcagagacagccagtgttccgaaggagaggacgaaattatacccatttcagaaacattggcatacacctgtgtctgcccattccttt

SEQ ID NO: 526781 - DNA, 361 bp, Homo sapiens
tttttttttggtagagatggggtctcactatattgctcaagctggtctaggactcctggcctcaagtgatcctcccaccttggcctcccaaagtgctaggattacaggcgtgaaccaccaggcctggctcacagctgattttttttttttttttttttctgagacagagtctcgctctgtcacccaggctggagtgcagtggtaccatcttggctcgctgcaacctccacctcccaagctcaagcaattctcatgcctcagccacctcccaagctcagcaattctcatgcctcagctgagattacaggcatgtgcaaccatacctggctaatttttatatttttcataaagatggggtttc

SEQ ID NO: 526782 - DNA, 168 bp, Homo sapiens
tcgcgaacgtgttactctttcctccagacctatctttacagaaaattgcagctgtcctacaaaacagcaaatagcaactataacaaaaaggcaccccattaatttttttttttttttttttttttttttttttttttttttttttttttttttttttttttttacctt

SEQ ID NO: 526783 - DNA, 1190 bp, Homo sapiens
  misc_feature (443)..(443): n is a, c, g, or t
agcggaataaggctacgggacgagacaacactagtgctgtgcgtgtatgagaagaagccaaacaggttgaatcacagggtgactgacgactcagtgagaattgaacagagagtggtatcaagatcgcatgaagactacatgcttcagtagaggccggcaatccaaaatttcagggctagcgttccggtggatcacagtaaccaaggaagaaagctcaacagggatgagagagaatggactgactgtccaatgctggctggaggctgaaagcataagtacagaacggatgaaagcccctggtatgccgactgggcgtggaagaaagaacgggagaaggcagcgccactagcgtgccgaacgcagaaccctagtcactgtgctccaagcctgtgactgagaccgctggcaaaaagaagggagaaacgtcacttaccagagagagnaaagaagggggaggggtcgatgctggccaacgagaggcaggctaggcccacaccgagggctgctctgcaatcgcatcgaaggagcgagaatggccgtgctcaggccatggaaggatctagacaaagggttgcccacctaacacatgcgtgttcgcgaactagaaattaaagcatacagggcctgctacccttcgcgatagggtgcgtagtaaagggactcgcgcgcaccagtcgcggaatgcgcacgggacggccctaatagagcaaaggtcctgtacttgtgggcctgggcctgtcgttgggttcagtggcatgtttgtggcgggctcccaacccctaacaccctagggttggttcctaggtcaagacggggagaatagcatgtggctttggcgccaaatgtggggcgaaacacgatttggtcacgaatcgccccttaccaagaacaaggggaacagaatgctgggggccagaacagttaaggtccaggcccctttacgacctgggaaggggaaaggaaaaccaatttagggaaaaaggcaatcggtacaggaagttgggacactatccggggacatccctttacccgcgggcaggaggcttggccccctaatgtcaagggaaccggaaggggttcacaactgtgaacacgacggacgtaaaacccatagggaagagggacttcggcagcccaacgcaaaccatgtgggcgcgtggagacaccttcgtgatacacaaggaatggtg

SEQ ID NO: 526784 - DNA, 437 bp, Homo sapiens
cgatctccgaggtgtctgcaaccaaggaaggcatgcgactgcagcactataacacatcagctgcagttgtaagccaggcactgtgcacagtagcggtttgcagcaagttgtagaaatgggccatttccactcaagagcatcaaccaccattgcatttatgcctggctgagctggggaggttgtcttcatgcaggcatcttctaaatggtttcaggtgtcattatccctccactggtagaggccatggggaatgtgaccatagcataaatagaagctccagttcccattcctttggtagatattttcatgaagagcaaaatatggtgctggagtcctcttgagatgtcatggaactagagccataggatccctagagtaaagagttgagtagaataaggatttatcagttattggaagaatacagaacaccgtcgaag

SEQ ID NO: 526785 - DNA, 97 bp, Homo sapiens
acggccgtgtattactgtgcgagagatgggtattacgatattttgactggttattataaaaccggagatgcttttgatatctggggccaagggacaa

SEQ ID NO: 526786 - DNA, 982 bp, Homo sapiens
tggaaatggagtctcgctctgtcacccaggctaaagcacaggggtgtgatctcactgacaacctccgcctctgtgggtttcaagcgattcctcccaccttcagcctcacaagttagctgtgggaccacgaggcactgtgccaccacaccgtggctaatttttggtattttaaatacagacggggttttcaccagtgtggcgccaggcatagtctcaaactctcctgtgaaccttcaggttgactccggccaaccttctgtgccctcccaaaaggtgcgtgggaatttacaaagtgtggtagaccccacctttgccaagcgcctaatagggcgccccctgtgtataagtataaccattccattcggttcttttaccacccccagcgtgcaccattggctaattacacattcaccttgaaaacctcgaggggctcttaagtgcctctctgcgaaactccaaagaaacccgtgggttctcaaaaattcccgcgggttctcacgaaggttatatatcacccgtgtgttgtgtgccacatattgtgcgcgcccaatgtgtctccacttttaaaactttctccttccggagaagcccccctttttgcgccgctcccatttctaactcacacacagtggaagggatagtggcgtaaaattacaagacacccccacacctgtgtgacagccccgggggtgtcgccaaattgtgcccccgcgagaatttctgtggaataaatctcccccgaaggtcccatcttccgagggaaagcccccccaagaggcgtaatacagggcaagggggggctcccccctttttgaggggccccaaacagaaagtctctgcggaaaacaacccaaggcctgtggggcgccaaaccctatatcgcgaaaagaaaccccgtgtggagtactccatcccccgagaacatgacaacacacaacacaccaacgcaagaaccgacgcaaacacgcgacacagaatacga

SEQ ID NO: 526787 - DNA, 646 bp, Homo sapiens
cgggagcagctacccaggcttccctggagttcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctctgtatctacactggtctagcgtggggctctgcgcgcggagcgcagcggagcgtggagcatgagcgtctcatgcgacactctccaagtcaatcgaccagctgtattgagcgcccccaatgaccaggccttgtactgggcgtgaaagagcagcagggactaaagctggccagatctgtctcccaagaagggcccccaggacgcggtcacccctaacctgacactttcttccacaacccaggacccgagctgatccagaaagccaacggtctccacggcttcatgaattggctcataatctgctaacggtgagctgaggagagagccgacgttctagggcccttctctggagtgaagggtcccatctccacccctgacagctttgcggtggggtttcccttaggacagcggggtttccagatggtgtcgctggtgtctctgtcg

SEQ ID NO: 526788 - DNA, 584 bp, Homo sapiens
tctgagcaaggcacatgcttgttcacactgtatgaggctgtatgcaaaatccagaggggggctcctatggagggggcaacccaaagcctgtctgtaacctggaacccctacacctgttctgccgattacatgccatcttatataaattcctttaattcttcaccttcttctgataagctaaatgcactccttctgctctgcagaagaaaattcgcattaaaacgaatgcataccacccaacagcactggccatatgccacaagttcactctatgacaaaacaccgatgttccccaaggaaaatttactgagatctgcaagccatggcaaccaaccgagagacagaaccaggaaggcaaggacagcgatcatgatgctagagccttgtttgcacacacagtataaacagacagtagtctacaagctgactagggcctatgcatagccagatcaaccccacagactgtgagccaggccttaagctgcctatttgtgctgaagcgggctgcagaacgacccgtgttatccaccctgagcaccatcaacactaagcacaaatgacaacaccatgtcacctgtaccctg

SEQ ID NO: 526789 - DNA, 522 bp, Homo sapiens
tggatatctttgaagttatgtgacttatggtccagccaatagtctattcatggggactgggaggtacatgaaaagaatgtaattttcaatgtgggtatggtgttctgtaaacaacaattaggtcatgttgactggtgtggttcatatcttctatacagtgtcccttgctatccacaggggactggttccaggacaccttgtggagaccaaattttttgatgcccaagttgtatataaaatggtgtagagttgcattattacctatgcacaaccttctgtatattttaaaccatctctagatttttataatacttaatacaatgtaaatgctatgttaataattttaatactgtattttaaaaaattgttattttttactgtccaattgtgtttttctgaattattggtgcattgctattggttgaaatctgcctatattgaagaggctgattacatatactacctacattcttgcctacaaggtgcctattcaattactgaggattataattgtggattcca

SEQ ID NO: 526790 - DNA, 281 bp, Homo sapiens
aaggatccccggtgggagacgggggtctcaggcagaagccagatgggcagccagggctggacggggcctcctcctcgagggggcggagacagccacggggtctcccgagggtcccacagggctggtcctcatggcagcccaagccagccggagcacgggagccccaattcccaaccaggtctccctcagaccccccagaaaggggcctcgaaagggccgccgctggcgccctgggggaaagggctggccggtggcagggcctggggccatgccggggttgg

SEQ ID NO: 526791 - DNA, 253 bp, Homo sapiens
gcaggcagtatgtcatattatggaaatataaaagcatgcctaactacaacaaatcccagagctactgtcttctgcagggccagaaatcaccatgctatgaggggaatacatagccacaattcagacagatgacgagcctatctgaagcaaacagctcagaaaaatagcagggaaaggaggtggggagaggcagaagcagtggcaatatttatctccagtgaacaaaactgagctttttaaagatggcagtcag

SEQ ID NO: 526792 - DNA, 125 bp, Homo sapiens
cagacttctccaaagccacatgtaaagacttggttatgtttatctactgttgggtccagaaggaattctttccatccctgtgaggcaatgggggaatgataggacaggaagagaagttctcagac

SEQ ID NO: 526793 - DNA, 356 bp, Homo sapiens
tagatatggggcagtagtgtgattgcaggtggcagtagcattcaggcgtagtagaagtagaggttcaggagggtgatggtggctatgatggtggggatgatgaggctattgttttttgtgaattcttcgataatggcccatttgggcaaaaagccggttagcgggggcaggcctcctagggagaggagggtggatggcaattcaagggtgttagtcatgttcagcttgtttccaggtgcgcagcatagtcagtagggtcgtgcgtgctcggagtttcaagttgcagtcagtcaggcaatgcggtcagtagttcaggcataatcataaatcagttcaacattcaagcaatggttcat

SEQ ID NO: 526794 - DNA, 858 bp, Homo sapiens
aatgagaaggaaccggaaaaacaattctggtaatataagaaaacaagcttctttaacacgcagaaaagatcacactagctcaccagcaatggatccaaacaaagaatacatctctgaattgccagaaaaagaattaagaaagtcaattattaagctactcaagaaggcaccagagaaaggtaaatatcaacttaaagaaatgttttgttttttgtttttttgagatggagtctcgctctattgcccaggctggagtgcagtggcgcgatctgggctcactgcaagctcggcctcctaggttcatgccattctcttgcctcagcctcccgagtagctgggactacaggtgcccaccaccacacctggctaattttttgtattttttagtagagacagggtttcaccctgttagccaggatggtctctatcccctgacctcgtgatccactggcctcgacctcccaaagtgctgggattacaggcatgagccaccacgtttggcctaaagaaatgttttaaatgatacagtgtatgaatgaaaaaatctccagaagaatagatggcataaatttaaaacaatcacaacttctggaaatgaaagacacatttagagaaatgcaaaatacacgggaaaaactcaacaataaaatggaacaagtagagagaacttcagaacttgaagacaaggcttttgaattaacccaatcaaacagagattaagaaaaaataattttaaaatataaacaaaccctccaagaagttggggattgtgttaaatgaacaaacttaaggataaatggggttcttgaggagggaagagaaagctaaaccgtttgggaaagcatattgggagggaaa

SEQ ID NO: 526795 - DNA, 393 bp, Homo sapiens
  misc_feature (102)..(102): n is a, c, g, or t
ctgcccaaaaagtgggggtggaggaccgagggttcagctccccacgccccggtcccccagagcatttgccccaggtacacctccccctgggccccgcacgantgggggagccagactgtccagggaaacagcctctcttttttttacacactcagccccaaagccccccagctcccaccccgggtcccagctccccttttttgtaagtatgtgaaaaggaaaaaatgccaacgttggagtttgggctggagctcccccccccagctgcgacttttaactatgtaataatggacaaaggaagctgttggggttttaaaactctggggggctgggccatttttggacctttgcaattagaaaaattaaagatttatttagctattttaagcccga

SEQ ID NO: 526796 - DNA, 130 bp, Homo sapiens
ccctccctacccctccccagtttttggggtcaggaagaaaccttattttagggtgtgttttggttttgtataggagccccaggcagggctaggaacagtttttaaattaaaggccacaggtcatgttcca

SEQ ID NO: 526797 - DNA, 110 bp, Homo sapiens
tgcacactcacatgtgtgagcatcatgatgaacgtaattatgtatgtagaagctcagataacggtgaggatcaatgtgaagagagacactcttggaagaagagaccattt

SEQ ID NO: 526798 - DNA, 873 bp, Homo sapiens
  misc_feature (67)..(67): n is a, c, g, or t
  misc_feature (147)..(147): n is a, c, g, or t
ctgcgagcgcgcgcggacgtgcacaggcggggagccggtatgggcccgctgaccctgggcgccggcngacgagcaccagcctagagccaggactgaagcttcaagatggctgaccaggaccctgcgggcatcagccccctccagcanatggtggcctcacggcaccggggtgcgtgtggttaccttctctctttcattgacgccccgttgtgtactgtggttgaagggttcgcctgcaagttctcagcggcccttcccatggccagcgagcttggattgcccttccttccaagaacgtgtggaggcctctccctataccaaaaatggaagtgcctccgtgttattgcacgtggtgtccgtggagcctcttgtactcttgttgccccaaagtggtgccccgttgtgttgccaaccgttggttttcaaggaccccttacgcgcgtttcacgttggcaccaagtgggtatgcccttctgttgaacgcctcggggagggggcaccgaggggcaacccaagtgacccctcctggaggcggcttcccgcgccacccttggttgatgactgtgttgccaagttaagccgggccattctatgttcgaccgtgccttattgaacccaaagtgtgagagggccttcccgtgtggttgggtccgacgcccttggacccttgttgtaccttctaccggcacccctttgtgttgggctggggcggcggcttgggcccggcctttgtggacacctggtggactgtgtggactccaggccccccgttgggagggcttagtgcgtgggacaaatgcttgcaggggctccacgcagatgtggtccgtacccgggacgtctggggttgccttggtggttcggaacttgcgg

SEQ ID NO: 526799 - DNA, 393 bp, Homo sapiens
tgacaataaaatctctggctgctttattgagtgccgctctctcatcctaaggtttttctgctcgcccattcctccgaaccccggggacagagtgggtaatggggagggaggctgaggcagcctggcaggggatacacgcattgacttgggattagttccaaggggccacatggtgtagtttcagaaggacgccagggagaactttaccatagggacaagagagagggagaaaacggtcctagaaaggggttgggcaaagtccagggcttagcagtgtagttttctgtctctagtggcccgaaactgatgaatgatcaccctggcagcggcaggccgggcgctgagagtctctctcatgctttacctgacccctccttagaagtactgtattgg

SEQ ID NO: 526800 - DNA, 686 bp, Homo sapiens
  misc_feature (123)..(123): n is a, c, g, or t
caaaggtccccggcttttcctttaaaggggggggatcagggggagccgcgccccgcccttaattattttttttttgagacagtctggctttggggcaggggggagggagggggagaatttagntcacgcctcccccccccccggggttcaagggttttcctacgcctccaaagtaggggggattcagggtcccccccacgccccagccaatttttggttttttagaggagacgggatttttccatgttggccagggtgatttcaaactcctaccctcaggggtgatccgcctgcctgggcatcccaaaggggtgggattcaaggggggagcccctgggccgggcccctactttattttttaaagagaaaagaaatccaaaaaaaaagaaattgggggcgggtaggggccccttttatagggaactattatatgaattccaccttttattttttgggttttaaattttccccaaaaatttagggttctaaaaagggctaaaatggttttgcagatttatttgaaagggaaaccccgggattttcctggggacccccttaaatttatagaaaaatttgaaaagactggggatttccccctttttggttttcccggggggggacaggggaaatcttttcctttattgatttttttaatggggggaaacccttttttttttatcctttta

SEQ ID NO: 526801 - DNA, 1026 bp, Homo sapiens
  misc_feature (441)..(441): n is a, c, g, or t
  misc_feature (513)..(513): n is a, c, g, or t
agcgggggtacgctgccagaagtaaagcagagagaaaggacgcaggcccgtttgggaagtggtgtgatgacgatcgcccaggtcgaaatggtgagacccaagccatggaggccgtttgccctgggcatctctagtctcgcatcccagtcgagcgcaggaaacatgaggagtcctacgcgtaaccaagaagacggttcctatatgctaaagcaacctccccaagtctctgtgacgtcgttcatgcagtactctgaggaatccagattgcgttgacagctctcatatggtaacatgtgcagtgctggcttgcatcgttcgtttaagcctagcatgaataaccctggtggccctacctgtggagcatgtcgtaccatttctattgagagaccatgcggacgtaacctgcgtgaatggaacggacacgtgaatatctatcttaantatgttttcattagctatgtagttggtaaacatcatgtcatcgggaaatcatctcttcgtcgagtgtacccnaataagcaactagcccctctatatccgaaattgaatgggtgtatacatgacttgcaattactgtaccctgtgtatatatttcagaacgaggtaaaagatggaaaaccatataggcaggaattcgtactgggatcttacattctgtatgagtgagtacaccgccagaaagatttgcattctttttcccttcactagtagtgaaactattgattgttcgcgcccgcttccttggttggttattcattacctcttcgtgcttttctaggcccgtttcttttgtgccccttatcccgttacattcgtttttcgctccgagttaaatgcttaggcaaagggacaccggcccaagtatgatagggatgtgggcgtttgaacgtagcttgtaaaccagagggcaaccattggtggggggatacaaccgttggccttacgttccattccaaccggaacggtgcattctaaccaagacttcgtaggaagaactttcccaggtaaataccggtggtacttccc

SEQ ID NO: 526802 - DNA, 765 bp, Homo sapiens
taaaaaatgtttacagtaatggggtctcactacgtttcccagcctggtcttgaacccctggcctcaagcaatcctctttcctcagcctcccaaagtgatgggattacaggcataagccactgcgcccagctccccgttaattgtatgctgaacaaaccttccattccaggaacaaatcccacttggtcgtggcttataatccttttcatatgctgaatttgatttgctagtattttgttgaggatttttgcatcaatattcatcggagataatggtctgaagttttctttttttgtggtgtctttgtctggctttggaatcagggtaaagctggcctcatggaatgagcttggaaatgttccctcctcttcatttttttggaagagtttcaggaggattggcgataattcttctttaaatgtttggtagcattctccgatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattggtaagtaatgttccctctttcatttctgattgtagttattgaatggtctttttttttcttaatctagctaaggatttgtcaatttgggttgatcttttcaaa

SEQ ID NO: 526803 - DNA, 326 bp, Homo sapiens
ggttttagctctcttcggtcagattccggtctctcccactccccctaaataaaatggacctgggttagaatacccttttctggtcagctcacagcaatttctccagtcatttctgcttgaaataacggtgtagggacattattcaagcaaagctttttttccttcacagttaatatgtgactcaataatggctggagtgtggataaacatgtttgggagattcaatcattggctaatttagtttttataatgtagggggggtttgaagtgagtactgagccatttttctccatttcacaattctttcccccaagagcgacggacag

SEQ ID NO: 526804 - DNA, 687 bp, Homo sapiens
aggaaacaggattatctctctaacgggtactatacactgagtcatactcactttcactgtcatgaccaattcaatttaccttcgtgcaaatcgggaaaggcttctcttcgtcaatgaagattttaattatgatattactgcacatcatgaaagccctgctcaaagaagaggtcaaatgttacagctttaccttcataaagagaagcccacactctcagcttttcactacacccccaccacatgccagggcacgtgtgctgtaagcacgtacatttaattggcccatgcctaggaaaggtgactgtgtcaggtttcaaagtgggtgagagacagggattaggaacctaagagtggcagagaagaagtgacaagagaagccacctttggggacatccaggaggcagatgcaatggtgcagcagacacatgtatgtgtaccataaagtggtgtgtgtatgtgcatagagggtgggctggtggaattcatgaaggaagagttctcttctgcagctccaggattcaactgtgaagcctgaaatctctacaccagccactctcatgttagctcatgtctaggatgtgaatggcactccctttgatgtggtgtcttgtcttccggagggcacaatataagaatctgacatggactcctggagtgtcacactcctgctcactttgttaattcctc

SEQ ID NO: 526805 - DNA, 129 bp, Homo sapiens
catctgcatttcaagaggaatcctaacccagattcttagattcccagtatgtctccagggtttccgtattacgctgcatgcctgcggaggggacttgcagcggggaacacacaggtctttggcgctcag

SEQ ID NO: 526806 - DNA, 1116 bp, Homo sapiens
cagagccacgagggaggccatggatattatggtggttatggaggttctcgatgactatgcgtggctataataattacggctatgcggacatgatggctttgactgacagactgacagcatggaagaggtactggcgacggacactggctactggttgcgagcatggtgactgcacagttcagcgcttcttcatggctgcgtcacttctcgctacactatgcacgcagcggcttcgccctctcttcgctgcaaccctgcaacacatgacacttgcgtcacatattctttctcaccgactaacatccagataccgagcattcactacttgacctacttcgcgcagcctgactgagcacagagccaccacgcgcacgacacgccacgactgctacgcacgcttctgcttgaccaccagtgtatccgcactgcccacgctacgccttgcacaatgctcctacacagcactcgacaacactacacctagctgccacaaccactcagccaataactacttcgacagcctcctataccttgcacactctctagcatcccatgggaaggggccaggctacctgcgcccacttggcgcacgcggattacctagcgacacttgcgcgcacgggacataacggcgtatcacaccgacctggcacacttgagcactaaatccacgcaggcacgcgacctacctgcgaaatccaagcatacttcggaacaggaaaataggcgcgccaacttgagcgccccgcaccaccccactctactaatcccaaggcctcggcgaaccgacgcatctacataggcagccataactttctctgtttgcacacttcggcattatcctagggcgcactggcgattctcatttgtcgagccccagcttgcggcctaggcctcgcagaacgtcgccaccacttgtctcacgcgactttcaccctcaactgtcgacggccccaaccgacccccggctccactcggtcacgcttgccgccccgcctggcgccaattgtgccgcgcttcgcgccaacttgcttcaccctggcgacaccaactcccaacacataaaccacagcgccatccccaatcagcccacaagattacattgcacacccacac

SEQ ID NO: 526807 - DNA, 197 bp, Homo sapiens
cgacggggttctgaggtcaggggtggtacgagcaggggctctgcctctggaggtgcgtactcagcccagagcccgctgagaatcaaggaactcgctctcccagggcggtatgtagcggtacaagtggggaatgagctggtcttcttcagggctcattcctgaacgaaagtgtgtgatacctacatcggtctgttggg

SEQ ID NO: 526808 - DNA, 1098 bp, Homo sapiens
ggctggatggactggagccctaacaggttgaaccccaattgaccttcttcatactgcatgatatcaacgagtgatggtgtcctgtgatgagcaggagctggagggattcttcagcaatggagctggagaaagtgtacgaggcctaatagaatgaggaggatcgacatgtcgggtagatggacggaggagctgagctgcgcatgtcgggagcatgtgatgaagaatgtggactccaatcaggaccgcctcgtgaaccatggaggagttccgtcgctatcctagcgtcagtaggaatggagtttgtgggacagccgcggagagtggctgggagactagtggtaggatgcgaaccctggctactgcacgtagggatagagctagatcgcagctgttggatagtagcgacgcatgcgatggcaccggagggacgtggcagacgtctagtatatgccgagggggcccagcgacactcggtccatggaatatcctaaggcctctacgggtgggtccccgggatctcctggcagggcccgtaagacgaagagctaggatactggagctggtgccgtcacaagtgtgcagtcaagcggataggcatgcatgcaaggcaggcagacatgcaatgggcacccacggggcccaggggtgcactcacaccgtgaagggggcaggctcatcgttgccacgcgccagaccgtcgagacacgagtggttcaacttgggtcactcaagtgtccaagcccgagagaagaccatgaaaggggaatgggtgcgactcctttgggagaaacacttggagagacggttcgcatcggagcgggggtcgcctggatcggatgagagaggtggctcccacgtgcactcttgtggtcatgtgccctcccgggggaaggccgcctggtcgcgttgcacgagagttcactttggcttggcttccctgaggggggagcctgggcttcggcctggctgggtagtgcccctggtcgggtagttgcgcccaaggttgtccccgttgggggggttccccggggtgggtcgagaaggcttggaggcgctttgccctggggggtgacgcaggtggggccaccttgggccctg

SEQ ID NO: 526809 - DNA, 608 bp, Homo sapiens
cagtcaaaaaaaaaaaaaaaaattttaaaaaaaaaaaaaaaaaaaaaaaaaaaaaaaaaaaaaaaaaaaaaaaaaaaaaaaaaaccttgtgggccgcttgggcccggtcgtttttggattggggcaggtttttgcttgcggccgaatttggggttccttgggccatttggccttttggggggtcgttttccatttcatgggccgtggttttccacggtcgggctggggaaacccttggggttccccattttattggctttgcggcaattccccttttcgccggttggggtattaccgaaggggccggcccggatggcctttcccaacggtggcccaccttgatgggcgatgggaatttgtgggcgttaatttttggttaaatttcgggttaatttttggttaattcagttctttttttacccattgggccgaattgggcaaatccctttttaattcggtttggcccgggttgggtttgagggttgtcccggttggcaccaggagcccctttttaaggaccggggcttccaacgtcaagggcggtttttggggttgaggcgcccgaagggtttttcggcccttaggggggcccccgtttttggttggcg

SEQ ID NO: 526810 - DNA, 449 bp, Homo sapiens
  misc_feature (125)..(125): n is a, c, g, or t
cagccccgagagcgcttcccagaaaccctggaccaagaaagcccagcttctgaggggggttgcaagccactggggcccggcctggattcactgcacaagaacagtgtcagccaaatctcggtgcntcagcgggggcaaggccaagtgctcacagttctgcactacaggcatggatggcggcatgagcatctgggacgtgaagagcctggagtcagccttgaaggacctgaaaatcaaatgagctgtgcagactagactgctgccctcatcccagctgctgggagggagggaaagggggtcggggaggctaagggctgctttgctaaatgtttctaggatgcagtacactgctacaaaggaagaggcaggaggggaactgcctatttaacaaaatgtgccttttaaagaaatactctttattgcaaaccaaaaacaaggccaaaaaaaaa

SEQ ID NO: 526811 - DNA, 385 bp, Homo sapiens
tgtgtggtagcatcaatacggataagtggaatctatatagtcagcaacaattatgggttgatgaggtgcattcagatgctgaatttgatgccctggtttctgaactcttagccattaatcagatgcgtaactttttgaatgacgagaagcctgggccataaacaggaagactccaatatcatggtgagattatttggtaataatttgcttgtgctttgtcaaaactatctatggccatttaatccagtaactcatcacaggaggacagtgaatacctaaatatttcaaggactattggacacagaatttgaattaaaattaatatttgttgatatttgtcatcatgacctcttagaataggaacagtgggagctacataataaat

SEQ ID NO: 526812 - DNA, 405 bp, Homo sapiens
cacgagggccccgaagggctcggccagcatgacggcggcggcgatcgtcgcgcgatcgccctgtccgccggaaaggggggccatgatccgggcccagctcattcgtccatccttcatctgccccgcgtctggacccaggggacctgcccctgcattgatctttctcaggtcctgggccagttcacggcctcgactgtggagggaatgcgccggtgaggaaagggctgcgtcgcggcaaggaaccccgggcctggcagcgcatgctgtccggccgccgcctggacctgctcgacccatcccccatggacatcgagatcgaggacatcgcccacggcctggcgcgcgtggcgcgctggaacggccagacggtgggcgagcacgccttctcggtcgcccagcactcgg

SEQ ID NO: 526813 - DNA, 540 bp, Homo sapiens
  misc_feature (45)..(45): n is a, c, g, or t
  misc_feature (124)..(124): n is a, c, g, or t
  misc_feature (149)..(149): n is a, c, g, or t
  misc_feature (163)..(163): n is a, c, g, or t
  misc_feature (165)..(166): n is a, c, g, or t
  misc_feature (168)..(169): n is a, c, g, or t
  misc_feature (172)..(172): n is a, c, g, or t
  misc_feature (174)..(174): n is a, c, g, or t
  misc_feature (187)..(187): n is a, c, g, or t
  misc_feature (214)..(214): n is a, c, g, or t
  misc_feature (220)..(220): n is a, c, g, or t
  misc_feature (224)..(224): n is a, c, g, or t
  misc_feature (233)..(233): n is a, c, g, or t
  misc_feature (247)..(247): n is a, c, g, or t
  misc_feature (266)..(266): n is a, c, g, or t
  misc_feature (295)..(295): n is a, c, g, or t
  misc_feature (399)..(399): n is a, c, g, or t
  misc_feature (418)..(418): n is a, c, g, or t
  misc_feature (535)..(535): n is a, c, g, or t
tagccccttcctctgtgctgtgctgacagggagggagccagtgantggacaatctatgaacccaagtttgtggaacgtggggcttcagctgagggtggggtagtgtgatttcagcagtgtatanacaatcccaagaaaaaaaaaaaagnattgctctgttgtnannannagnanagtgtcgggacantgaccggaagccaaacctgtgcctggnggccanaganaagacacanggatatccgtgaancttgctgctgtgccctcancgaggccagcgccccacctgctggaacancaagccggagcagttctgtctgggccacagctgctcagcctgtggactcaggtgttatcctgaagaagttacaacaaattctcaaagaataaacaatgggcttnaaaaaaaaaaaaagggggnttaacagaaactcacagtagctgtggctcaccatgtgccaggcactgtgccaagcacttcacatttagtgctcattacaaccctatgaggtaggccgtaccactatccccactttanagatg

SEQ ID NO: 526814 - DNA, 280 bp, Homo sapiens
atacgactcgagctcggtacctacattattagcgtgtctctcaagcctacttgcataaatacacaattatatgtatttaatgaattcactcttaaacagctgtagaaaatgtgctttactaataggggggcatccagtcagataaagcagtcataacgcgttgcgcggcgcgcgtgtgtgttcagatatgtcaaagccactttcgtagtctatttggtgtcaactggagttttttacaactcaggtgagtttaagctttattgggaaggagggatgagca

SEQ ID NO: 526815 - DNA, 985 bp, Homo sapiens
  misc_feature (135)..(135): n is a, c, g, or t
  misc_feature (173)..(173): n is a, c, g, or t
  misc_feature (226)..(226): n is a, c, g, or t
  misc_feature (288)..(288): n is a, c, g, or t
  misc_feature (312)..(312): n is a, c, g, or t
  misc_feature (331)..(332): n is a, c, g, or t
  misc_feature (337)..(337): n is a, c, g, or t
  misc_feature (350)..(350): n is a, c, g, or t
  misc_feature (407)..(407): n is a, c, g, or t
  misc_feature (447)..(447): n is a, c, g, or t
  misc_feature (449)..(449): n is a, c, g, or t
  misc_feature (453)..(453): n is a, c, g, or t
aaataggctaggtacgaggctggtgtaatcggcaccgaggctaggccggatgccgagatgtcccgcagctcggggccggtcatgcttcgtggtccgtggctgccagctttgtgctctttttcctgctgctgctcncgggcgcgctgagccccgcggcgcctccaggccgtggnagggaaccgacgagccgggctcggctgggcctggccgggcttccagcgcctgnaggagcagctcagggcggcgggtgccctctccaagcggtactggacgctcttcagctgccanggtgtggcccgatgacctgtgacngaggacgaggaggcagccnncgggncccctgggcttgncgccttcctctgttgggccagcggtacctggacctcctgaccacgtggtactgcagnttcaaagactgctgccctagaggggattgcagaatctccnancaantttaagcagctgatgagccagatccgggagatgcagaagctctgacaccagagcctgttcatcttcgatgaagcggagaagctgcacccaggctgcttggaggtccttgtgccacacgttagaacgccgggcccctgagtggccacaagggctgagtctccatggactatcttactgtatctcaggcaccttacaggacatggagaaggccctggagtccatgcccctaggatggggtgagggagtatcacgtcgtgaggggttacaagaagaccctggagtcctgccattgcagccccatgacaaggtaagtctcaggggggtgatataatcaatgaggttgagtcctaagagttgcctcaacggttggaatggtcccggggaatgaaatttacgactggaaaagcatggagtccccaagctacaaggtgaaagatagtgggagaaccatagacgacatgtgctctggccaaaaccccgacttgtaacagtaaaaaccttgcatggactacttcatacccctatctgactt

SEQ ID NO: 526816 - DNA, 1286 bp, Homo sapiens
  misc_feature (135)..(135): n is a, c, g, or t
  misc_feature (173)..(173): n is a, c, g, or t
  misc_feature (226)..(226): n is a, c, g, or t
  misc_feature (288)..(288): n is a, c, g, or t
  misc_feature (312)..(312): n is a, c, g, or t
  misc_feature (331)..(332): n is a, c, g, or t
  misc_feature (337)..(337): n is a, c, g, or t
  misc_feature (350)..(350): n is a, c, g, or t
  misc_feature (407)..(407): n is a, c, g, or t
  misc_feature (447)..(447): n is a, c, g, or t
  misc_feature (449)..(449): n is a, c, g, or t
  misc_feature (453)..(453): n is a, c, g, or t
aaataggctaggtacgaggctggtgtaatcggcaccgaggctaggccggatgccgagatgtcccgcagctcggggccggtcatgcttcgtggtccgtggctgccagctttgtgctctttttcctgctgctgctcncgggcgcgctgagccccgcggcgcctccaggccgtggnagggaaccgacgagccgggctcggctgggcctggccgggcttccagcgcctgnaggagcagctcagggcggcgggtgccctctccaagcggtactggacgctcttcagctgccanggtgtggcccgatgacctgtgacngaggacgaggaggcagccnncgggncccctgggcttgncgccttcctctgttgggccagcggtacctggacctcctgaccacgtggtactgcagnttcaaagactgctgccctagaggggattgcagaatctccnancaantttaacaggcttagagtgggacctgaatgtgcggctgaaattggcccagaatttgtgtgttccaggcagcttggtcctaagaaacagtgaggggctacttagagacgccccatgccaagaaaaggcccttgctctgtcgtccacggattggtctggcacaggcaaagaacttcgtgggccacggatgctggtggaagaaccttgtattcggggaacggggctgatgagttgaccgtggtgtccagggatgtcaatcgccacgttccactttcctcaccccaaatatgtggaaccttgtacaaggaagcagctgatgagccagatccgggagatgcagaagctctgacaccagagcctgttcatcttcgatgaagcggagaagctgcacccaggctgcttggaggtccttgtgccacacgttagaacgccgggcccctgagtggccacaagggctgagtctccatggactatcttactgtatctcaggcaccttacaggacatggagaaggccctggagtccatgcccctaggatggggtgagggagtatcacgtcgtgaggggttacaagaagaccctggagtcctgccattgcagccccatgacaaggtaagtctcaggggggtgatataatcaatgaggttgagtcctaagagttgcctcaacggttggaatggtcccggggaatgaaatttacgactggaaaagcatggagtccccaagctacaaggtgaaagatagtgggagaaccatagacgacatgtgctctggccaaaaccccgacttgtaacagtaaaaaccttgcatggactacttcatacccctatctgactt

SEQ ID NO: 526817 - DNA, 251 bp, Homo sapiens
gcggagggagaggccagtctagcgtccccggccatgaccgcgggtcatcagccatgacagtgtggacaaggtcccaggggtgaaggctaaagctacccagtgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagctggatca

SEQ ID NO: 526818 - DNA, 218 bp, Homo sapiens
gtcgacacaaattgtgtaagaacatattatgaggaatgattgggcctgtccttatcacagagccgttgttaattttgctgaaatcccacatccagaaagagtcaggcactgcccacatgtcatctgagatgccactgttttgtattccccccaactttgacttaagtttaaggttgttgagaaatgggatatggtcttaatgcggttccttgtttcca

SEQ ID NO: 526819 - DNA, 799 bp, Homo sapiens
  misc_feature (1)..(1): n is a, c, g, or t
  misc_feature (10)..(10): n is a, c, g, or t
  misc_feature (106)..(106): n is a, c, g, or t
  misc_feature (125)..(125): n is a, c, g, or t
  misc_feature (142)..(142): n is a, c, g, or t
  misc_feature (147)..(147): n is a, c, g, or t
  misc_feature (189)..(189): n is a, c, g, or t
  misc_feature (191)..(191): n is a, c, g, or t
  misc_feature (240)..(240): n is a, c, g, or t
  misc_feature (255)..(255): n is a, c, g, or t
  misc_feature (274)..(274): n is a, c, g, or t
  misc_feature (300)..(300): n is a, c, g, or t
  misc_feature (400)..(400): n is a, c, g, or t
  misc_feature (452)..(452): n is a, c, g, or t
  misc_feature (478)..(478): n is a, c, g, or t
  misc_feature (485)..(485): n is a, c, g, or t
  misc_feature (492)..(492): n is a, c, g, or t
  misc_feature (506)..(506): n is a, c, g, or t
  misc_feature (535)..(535): n is a, c, g, or t
  misc_feature (541)..(541): n is a, c, g, or t
  misc_feature (559)..(559): n is a, c, g, or t
  misc_feature (566)..(566): n is a, c, g, or t
  misc_feature (609)..(609): n is a, c, g, or t
  misc_feature (736)..(736): n is a, c, g, or t
  misc_feature (767)..(767): n is a, c, g, or t
nggctgacangcggtggggcggctcggcccctggcggagtcggcggcgggcggggacgcggcgctgggaggacgcggcggcgctgggaacggacgcctgggcgccncgaggcgcgggatgtggancggcccaccccagccanaccanggcctcccgccgccccttgcagctgtcccggtcccctggaanancacggacccctgccaaggccacagggagtccccaagagccctggtgganacctctgcaggggangaggcccaaggccaaaaangccccgcagccgcccaactagacatnttgcgcctgcgcactcttccatggaaatccgaaaaaagggctccgagttcctgaaggaggagctagcacaaagcacaaaaggactgaactaaaggaagangaatgtgacggctgtccaagtgcgggacactaaaaaagagctggaagactgnggccacctgtttgagaactcacaaanggttcgngagccanctgaagcagcggcncaaaaaacactgaaggagctcggggcaantcgacngctgcagcagagtgacancttgaanacgctggtcatcacgtccacaccacctctcccaaccgcgagcntcaccccagctgctgagccccaccaaggccgggcccgaaaggccactctcgccacaagagcaccagcagcacctctgcccgccgtgtgtgccgctgcgggacacacctcaccccagacagagagggnaagaggtggacacatgctgttttgcagagtnccaggctggagggaatgccccaccctggacaa

SEQ ID NO: 526820 - DNA, 269 bp, Homo sapiens
cgttctagaggtccctggggcacgggtgatgggattggtcccacccgccaggccccctagtctatgtgcttgtggtaccccaaatatcatgaatgtctgttgcctcctcgtttccagctggcagcatgcaggatgcatgctcctgaatgcagcatgcagcagcaccatgtggcagcatgcatcaacatgggctctgccccttcctaccccatgtgcccctgtggtcccaccgtctcgttgtacctatgctctaacttcagtaatcattg

SEQ ID NO: 526821 - DNA, 338 bp, Homo sapiens
cctagacccactccaccttactaccagacaaccttagccgaaccatatacccacataatgtataggcgatggacacagaaacctggcgcaatagatatagtaccgcaaggcaaagatgcagaattataatcaagcgtagtataacaaggactaacccctataccttttgcataatgaattaactaggaataactttgcaaggagagccacagctaagacccacgaagaccagacgagctacctaagaacagctgagcacacccggctatgtagcagatgcttgtgcaagatcgaagcttacttcaacttttatgaccacagccctctagttcctttgg

SEQ ID NO: 526822 - DNA, 157 bp, Homo sapiens
gaagtttttttcccccgggggtttttccgctttgaaaccaaatttgtttttttaaaacaaaccaatcttttgggtgggggttttaaaaaatttttgctaaactccccaagtaagtttttcttttttaaatggccccgggtctgaaaagcttttttta

SEQ ID NO: 526823 - DNA, 850 bp, Homo sapiens
ctcaaaaaaaaaaaaagggccacaaaactcaacaataaaaacaaacagtccatttagaaaaggggcaaaagacatgaatagatgttccactgaagaggatctatagatggcaagtaagcatatgaaaaggctggttaaactccataagtcatcagggaatgcaatttggaaaccacagcgaggctatgacttacttatctcaatgggctaaagaaaaaatagtgaaaataccaaatactggatgaggatacaaactgggatattttatacattggctgacagggaattgtaacaatgggtacagccactcggggaaagagtttatgaatttcttatcaagttaaacataattttttaatcaagttaaaccataagacccagcagtggtgctccgggactttcatcccagagaataggaaaacctattatggtactggtactcaaattattctataggagctttaatttggtaatagccccaaaactgggaaacaacccagatgtcctacaacgaggtacttggttaaacaaaccatccataactgggaatacggctcgggaatgaacagggaactaactgttgatacaagaacttggttgtacctcaggggtattcagggtgaccaaaaaaaaaaccagtctcaatgggtcacctatagggtatgatcgcatttatttaacattctagaggtgacaaatttctggaattgaagaaccagataagtgttgccaggcatagggacgtgaagggggtgagggggaatgtctgactataagcgatacgcaaggagtcccttgggcctgatggaccagtctatatgcatatgatgaatcacaatgttggataata

SEQ ID NO: 526824 - DNA, 161 bp, Homo sapiens
taggatcgcaagagcaagaaggggttactgaggcgaatagctgtctgacccaggagaaaaggaactatacagcatagtggagtttgtgtacgaaagattgctatctactggtcctttggaatggaagtagtagaaacctaaaggcttagcggatctctaga

SEQ ID NO: 526825 - DNA, 226 bp, Homo sapiens
gtccctgtggttttggagattgtgtggggaagcaaacgtcatctcaagatgaaacccttccaaatgagcttgacactttcaggaattgaggcctccacttcagacttcccctctcagcttaggcctaaggctggctcctcccatgatgcaaatacggtgcaagctggttgcaaagtgagggtgagaatctctcttgcaaaggatgcattatttcaggaagcatcac

SEQ ID NO: 526826 - DNA, 706 bp, Homo sapiens
agtatagcgtgagcctggtggtcgtgggaacccaggccccgcctatgcggcagagatgcgtggggagcccggacgtgctgcaggatgctgaagatccaccggagcgacccgcagctgatctgtgcagcttgcgattctgcgggcggagccctgtgtgccgtttcctccgcgcctaccggagggggcgcctgcgcgccgcgctgcagaggagcctggcgtgccggctcgcccaggcactcggtgccgctgcatctggatgctgcgcgcctggcggccgatctggctggacgcttttgtggtggacgaggaggcgctgtttgacgtttggaattcttattcccatgctatgcgccggagtcggctccgggatgaagaacttgcgctgagcttgcaggatgcgctgcgaacatcttgaatgtgcggtccgggggcccggcggtgtcagaacgcgctgagtgccgccttcgggcccccctttagtccgccgggtgccccttcctctgtcgggacggtgaatgctgccgcgatcgcctggcatcatgtctcagggactttttctgtgccagggggtcagccttgtagttgcatcggccggtgtccctgagggccctacagtcgttcgtcggcgctctgtggtctcagatgggcaaggtggcgcgctcctgtggagcttctggtgctctcgtccgggttggctttcttggct

SEQ ID NO: 526827 - DNA, 250 bp, Homo sapiens
  misc_feature (39)..(39): n is a, c, g, or t
ggccctgcagcctcagctcaccatgtcttggcggtcagnaccagctgccacactgcttacaccacctctaggtggaaactggggcccagacctgggcctgggtacagctggaatgtcacctgcgcgttctaacagcctgttctgagtcctgccacctgtgcctgtggccaggcttccctgtctccatccccagaggaggcagcccaacaacccactccctcttgccaattcacacctcctcaaaaagttg

SEQ ID NO: 526828 - DNA, 887 bp, Homo sapiens
ggccggccgcttgtcggagcgggttctgaagccatcgttcttcgatccgcctgccgggcagtgtcacccgttggtccggggacttccagggtacccccgcagccttgtccgccctcgaggccctgatggccatcgggaagtttccggatccttcggggatgcgcaggtcccccgagattcgcctgcctttcgaggtgccacacagggttttgatcagcgggatctcgcctccccttatgagagcttttaggaagctcccgccccctgctactctgttggctatcccggagtcgtcttcttaaggctttgggctggcccttattaggcccctgccccactccctggggttttttttacccattggttggaccttggggaggggggagtttaaaaaaggacccaggaagaaattgtccgagaaccccatgaatgggatccccccagtccccgtgtgtgtccccagcggcgcgccagtcgttcccccgcggcgatacctgttctctcgttgttcattcgtctcccccccagcctggttccgtcgaccgttctcgtccccctttccatagccgtcccatgatcgcccccccccatgtgtgtttaaaaaggccagtagcctttgcagggaacactgtctgtccccgaccatgtgttgacaccagtgtgcgtcctccagattctgtgttccagaaggatttgctgccattgagacgttgaacaccctttggatagggggaaaaattatatataaatatatttttttgttctgtttgcattttttaatttggtgcttggaaaggtgttgaagtgcccagcctaatgattccatgcgagaccagattggcgtttgtttttttggaggtttccaaattaagagcccttcttcatta

SEQ ID NO: 526829 - DNA, 473 bp, Homo sapiens
  misc_feature (318)..(318): n is a, c, g, or t
tgctgagcctcagtttccctatgaggcaggcacacttcaccatctcctttcaggctggatattcattctaaggccacacatgaatatgagaatattcaggccttttaggtagaatattctaagaatcttaaacgatggtacctcttagtggaagcagtattctgacaaaccaatggggcagggagggtgggaaatggtgttttatggtcactctgggaccccaggcaaggtaatcctaatggaagctcaggcttttggggcgggcttttttttttcctgtctacgaatggaaacatgaagcagatttcgcagtatctncccagggaactggacagtctactttggggccggcgcagaagagatgacccctgaccacctcccggtgtgctggctgcggctggacccgagggcgcgtcctcccgacctctgcggctactcttctcgccgcccccaggtggtgctgcaggaccaca

SEQ ID NO: 526830 - DNA, 235 bp, Homo sapiens
  misc_feature (27)..(27): n is a, c, g, or t
  misc_feature (82)..(82): n is a, c, g, or t
  misc_feature (122)..(122): n is a, c, g, or t
  misc_feature (148)..(148): n is a, c, g, or t
  misc_feature (154)..(154): n is a, c, g, or t
  misc_feature (177)..(177): n is a, c, g, or t
atttactggtctgaggagatggagganccggctgcaggccctggagaaggacaagccatccctgagggtcatctcctgaggnctcttcctgctgctggctgctgccctggacgaccggcctngagggcaaccctgggggcccaccagncccctnccatggctctcaccctggcatancctaggtttggaagagaaacgcctgcagaatccggcttatttctggccagtatatttt

SEQ ID NO: 526831 - DNA, 227 bp, Homo sapiens
gttttttcccccccccctttttggggggggccttgggttactcccccccccccccccccggccccccgtttttaaatttttgtgggggaaaggggaaagggttggccccccccccccccccccctttaggggggccccctttttggggccccccccttaaaggggggggggggggggggggcccccccctttttttttttttgggctttaaagttttttttccccca

SEQ ID NO: 526832 - DNA, 109 bp, Homo sapiens
gctctacgaggatctccaagaaaatagatgcttctaaatcttgttgatgaagtttagatgaagttgtgcagatatttagacaagagaaggctaacttctacttattacc

SEQ ID NO: 526833 - DNA, 236 bp, Homo sapiens
gcttgggggcggctgaggtgcccctctgtcctccagcagagcatgagtaacctgagaggccactcaggcagaagagacgcaagctgagccgtccaactggtttcaactgccaggttaaccaatgcagcatatctttcacaattaaattaacttacaaaaaaaaaacagattgcatcaccaggtagtttactcgattcaggagccagcctgcccaggatgggcctgtccctggccgg

SEQ ID NO: 526834 - DNA, 1627 bp, Homo sapiens
  misc_feature (712)..(712): n is a, c, g, or t
  misc_feature (992)..(992): n is a, c, g, or t
  misc_feature (1178)..(1178): n is a, c, g, or t
  misc_feature (1410)..(1410): n is a, c, g, or t
ctgtgtcctcctcctcttctgctttcgtatgattatgtggccctcccttcgtggttgatcgcgcgggggttctcttctccggcccatatctttatctcgcaggcggaggctcttcctcttctccgtggtgtgaatttctcctcccccgcgggattcctttctccacgcgcgccgggtggtgttctctgtcttttcgtcgcccgacagacataattggttgcgcgtcccccctcttctcttctaaagaagaggcgcgctcctctcatagggtggtgtgctgtccccctccgccccccgccctgccgctccctcgtgagttaaattaacccgctgcggtgtggtgtttctcactaaaatgagggcgctgcgcccctccctcagaacacgacgccctcgccgtgggtgtggaacacctccgtcgtctctctcctctgtgtttgaagagggaggtgcttcttcccccccctccgccccctcccaccagacagattttggtgtgtaaaacacaccaacaacattgtctgtaaacaccaccagggggttgatacaacaccccccccgcgtcgttttataacaaaaaaatatatatgtgaagatgtccctcctcccccctcgctggtatattatcgagaggaacatgtttttagagaaaccccccgaccacaaattctctcctgtctttttttttggagcctcgtgttttctcgccggnccccccacacgcttttctctcctgtggagattcaaaattgtggggtgagaataaggagaccccaccgctctcacagagatttgtttattgggagcccccccctctcctcccaccacagatgagcccacactggggggtccccaccagcagagacacagcagcttgggcccccttctgggtgctgataagacttctctcctgctgtggtgatgaagaaagacaataatgtataattaatataagacagcctattttttctctcaccaatccacacctctcncctcgagaggagagtttctatcccacacctataaaagagtgtgttattaaggggataaagcgggagagcccttcgacacacatcttattctctgagagccacacctcatcagtcgctggttgggcctctctcgctcacacaacagagtatacgaatattgccacttttatagtttttttcacacanattataccccccctttctccacgagccacacattagagggggccacaccacagcgcttttatacacacaatggggagaatataattttggccggcagaaaaggggctcgccacgcaatggggagaatagtccaccgcaggagtttcacaccttgtgtcttgtggcacactcacataactctcccacaacgttgtcttcacacgccggcccactcgtttctttgttgggaganaacgccaccacacctcgaagatgtgtttttctcttaaaataggttttgaaagcacactatggaaatgtaatgtgtaaaacactggagtgtcttttctggtaatcaggaagcctagaaaaagttttgaactttgttataccaccacttttagaataatgaatatggcccacatttttcttgaactgttcatgaataaatccctcattggtcagagcca

SEQ ID NO: 526835 - DNA, 1331 bp, Homo sapiens
  misc_feature (45)..(45): n is a, c, g, or t
gagaccaaaagccttcatacatctcaagttgggggaggcagccanggcttacctgtacactgacttgagaccagttgaataaaagttcacaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaagagaaacagaaagaacgagagccaagaggaagagtcggggagaacccggacgggcacacaagagggagcgcgacgagaagatagaagcagagacgaacgaaacagggagagacacagacgaaaacaacgacagcccgcggggggacaaaaggaggcgagcagaggagagaaaaacagaggggggaaggagaggcacaagaggagagcggagggagcgccacacaaagaggagaacagaagaaaacgaggagcgaggaagacgaagagaaaggggggggcaaaaacgaaaggaagaaaacaacgagggagaaagaaacgcgacagaaaaaaagacagaagaagcaaaagggaggagggcgagacggggcgagaaggagcgagagggagaagaagcacgagaagaacgaaagaggagaacaaaccaagagaaagaccaggaggcggaaggagaaggaggagcgaaggcgagaggagggggcgggggagggggggagagggcagagaggcggacgggaggcagggggggggagagggggacgaggggggagggaacgaagggaaggagaggcgagggggacgggaggaggcgaacagacagcgcaacgcaaccagaacgcagagagaagcagagagagagagaagagaaaaagcaggaggcaaggagagcgagcaccacagccgacacgacaggaagaagcaacaagagaagagaaggaagaagaaagcggagaagaaggacgacgaagggagcaaagaaaagacacggccgcgaagcagaacaacggcagggcgacgaacgcgaacggaacacacagaaagacaagacacagaggagagaaaggaaggaggaagaagaagggaagaaaggagagggaaagaaaaaaagaaaagagaggagagaggaacgaagcaagacgaagaggggcagacagaaggaggggcggagacggaaagagcaggcaaaagagagagaagagagaggagaagaaagaaaagagaaagggaggagagggaagaaaggaggaggaggagaggggggagaagaagaaaagaggagaacaaggcgccgaggaggagggagaacagagaaggagacaaacgaagagagacgggaagaaaaggagaaaaaagagga

SEQ ID NO: 526836 - DNA, 152 bp, Homo sapiens
atctcctctgataaaacgaggtgttagcagcacccagagcacgccagcatcagccgcgcgcagaccctccccaccagacgtcgtcaccatcacacagcgagtccagtcccggcaagcgggaaaaggacaaagagaatatattctaaaggggg

SEQ ID NO: 526837 - DNA, 268 bp, Homo sapiens
gttagcccttcaacctttagaggatggcttgaggctaggagtttgagaccagcctggtcaacatagcaagactttgtctccacaaaagaaagttaaaaattagccaggtggggtggctcacacctgtagtcctagctgcttggaaggctgcggcagtggaattgtttgggtctatgagttggaggttgcagtgagctatgatcatgccactgcactcccctgagtaatgaaagtaaatggaacaagacaccatctctttaaaaaaaaa

SEQ ID NO: 526838 - DNA, 521 bp, Homo sapiens
acaaatagactcatcgaacgtgcatgttcccagctgaggtcaaaacaggcaacaacgcgccttctcgtttcagcctcgtactgtcaacaaatggtcttttcatggtctatttatatgccatgatatttacactatgtctgtagcttatgtagtaggtgactgtgctagtatagaacaggtccccaacgcaaagtggtgacagtgctatccagtgatgccttgcacaaaaaaatgcatggattagaggaaatttggtccaggcacgagtggcagtgctgttcgtcgtgagtccaatgttaatgactccacgatatatagtgagtaaggtatctttaaacatgaagcacacattagacaaggttacatattaatcagtcgaagacgactgttgcaacttgaggatcacaggaccctaaccctctattcctctgggaacgattggttcaggattcgctaatctggtgtacgcagcaattttataagaacacacctactgagaataatgggaatcagcagtatag

SEQ ID NO: 526839 - DNA, 889 bp, Homo sapiens
tggggggggtgtgggcgcaggtccgtttgcgaggtccgtgttcattgatgggtcggtgtgtttgccgtgtgggtcaagcatggctgccgggtcgttggcccttttgtggttgtgcgggagtggttgtagttgctggagtgttttttttttcgctgttgttctcgttggggccaggtggggcgtgcctgttgctgttgtgggtccggtgggtggtggcaacggctttctgggggggttcgagtggttgccgggggttgtagcgatgtgtgtgtgtgttcggtgagttaattgctggtctagctcttttgggcttgtttctctgtggagatctcggttcgaggggtgccgcgctgattgtctcggatcttctgtattcatgatgttggtatatggatgatgtttggcagcgattgggggttatcagatgtgtttggggggtcagtgtgtgagttgtgggacttctgccgttcagtgttcctcgctgttctcccaggggctcgttcgcctgccgctcagcatcccttagtgtgtaccggcgattgtgtattcctgctgtctcgcatgtgtggccaggcctgtgcatacctcctgcagatgtgctttctgccccgacctgggacctgccctggaggttggagcagtaagggctctccctggggtggtgtttctcctctagggtatttgggatgcatgttctgcatctgccagccgagaggtgtgtgtctgggggccaccacctatgggacctcggggtcgaaggggcctgtaccctctgtcatttcctttctagcccctgcatctcccaccagtccaagctgacagctggtgcctagagggtcgtaggggttaataaatggcttatccttctctcccaaaaaaaaaatataaa

SEQ ID NO: 526840 - DNA, 397 bp, Homo sapiens
ttggcctaacatatcaatagtgttaacagtgagaaaccatgctgtacattgtgagccttccgtactgtttgatgatctaggagagacatctggagacctacagcagtgtttaagctaccaacactagtgagaaaactcaatacaaccacagtgaagaatggggcatataataatctggacacaccccaagatatggccaatctcttggggcactgctttgcacctacatgcctgcaagtaacatccatagtgcagccccgtttaagaaaaagtactgacatcacactatatatgaggtgaaatgagtagaaggataatgtagtaacaagaatgaaactagtggcaagagttcctaggcatatgatctaaaatatattttatcctcatttatatattc

SEQ ID NO: 526841 - DNA, 416 bp, Homo sapiens
ttgtctctactaaaacaacaaaaaaatacaaaattagccaggcatggtgatacacatctacaatcccagctactcgggaggctgaggcatgagactctcttgaacctgagatgtggaggccgcagtgagtcaagactgcaccactgcaccccagcttgggtgatggagggaaggaaggaaggaagaaaggaaggaaggagggagggacgggaaatgaagaacaagaaagaaagagagagcgggaggtgaggcagtgaggaagggaggacaggacaggacaggacacgggacgggacaggacaagaaaggacgggaaaggacacaaaggccacggaaagagacagaaaaagacagaaagaagaaacgagagaaacgaaacggacggccgaaagagaagaaaggaagaaccggaacga

SEQ ID NO: 526842 - DNA, 632 bp, Homo sapiens
agcggagtgggggtcggtgcggtttgctaagtggtcggttcctggagctagcggtcttctagctagcctgatccagcagcttcagcctactcgccgcaacctacagcccctacggcagccagccggcctgcacccgcaggccgaacgaggagccgcaggagcccatagaattggcaggcggagaacaaggcccgaacgagacctaaataggcggagcaaacaaccagatacgtacccagagaggcggaccccgtaagtactttgtctagctgtgagtgcagatttggtcgcctgactgagcacaatatgaaagccgcatagtggaataccctggaccgtcactaggaaagagtatgtgtaacgtaagaaaaacgctgacgtgatcataaataacgatgcaagatgacccatctaaagatctacgcagtgagaaaatacactcaaattagtacctgcgtgaaacataacaaattcatgtgccgagcaaactgtacccgcaacagccaaatatgcttacgtacgcgagatgtgatcagacacacccaccaattggtattatactcacacggaggagcactatgaatggatgcacacataaccaacaaaacgtctatatttcatatacacacatg

SEQ ID NO: 526843 - DNA, 677 bp, Homo sapiens
gcagcagcctgacccaggatggctctactccccagccttcaatccctggacctggcgtttgcgaattagagcagacttccgtcgagggtcaattgtgcgggatccatggccattccatacaacaatctcacgcacctggcaacaatgagatcggggacaccctcgagcagaggtcagatatcacaagggaccctgggcttttatccaacccgaccctcattacccagacgtggggtctcagatgagtgggacaaccctcaaatatggatcagaaatcatgccaagttcggactctgggccttaggagaaaactcttaacggcagatggaatgtcacgagggatccagccaccacccatccactcattgactggatgaagctcttcgccgcatgggaacaatccaggtcaggagttccgagacacgacaatgcaccgaaccggcagcatccaatacaggagtcccgacgaagctaagcagaaaacagtgcgcggctaagaggagaaacaggtacacggaaagaaaccccccacaaagaccagccgaacggcacacatacacgagcacaaaggcacagacacacaccgacgaatattccagcaaccaacggggaacgcgagacgcggcgcaggcacaacacgctaaccacaagagacagcgcaaccacgccgccctgca

SEQ ID NO: 526844 - DNA, 401 bp, Homo sapiens
  misc_feature (50)..(50): n is a, c, g, or t
cttaacagaattgtttgtagtaacctagtttggaaacccaccctcagtancccatcagtgggagacctaattaaaaagatgttacattccatacaatcaagtgctttgcctgctggcccaggcatggtggctcatgcctattaatccccagcactttggaaggatgaagtgggcggatggcttgagcctgaggagtttcgaggccagcctaggcaacatatccagaccctgtctctacaaaaaatacaaaaattagctgggtgtggtgctgtgtgcctgtagtctcagctactagagaggctgaggttggaggatcacctgagcctggggaggtcaaggctgcagtgagctgtgattgtgctattttactccagtttgtgtgcagagtgagaccctgtctc

SEQ ID NO: 526845 - DNA, 687 bp, Homo sapiens
tcagagattttcaatgatgggtataagctcagtggattttacaaaatcaaacctctccagagcccatcagaattttctgtttattgtgacatgtccgatggaggaggatggtactgtacattcagagacgactctgatggcagtgaaaactttaacagaggatggcaaagactatgacaatggcttctggaaattttggtccaaaaactatggtgaatattggctgggcatataaggacatcttcacttcttgaccactcaagatagactacactttgacaaatcgaccttgcagattgttgaacaaatatagccgttatgcacaatgataagacatttcacaacgttggagatgacaaagaagtgtctacgagtctgaatattggggaagtacttctggtaacagctggagattcccttgctggggaacttgtcatcctgaggtgcagtggtgggctagtcaccacagacattgaaattcagcacgtgggacagagcatcatgacaactatgacagggaactgcgcagacgaagatcagtctggctggtggtttaacaggtgtcactctgcaaacctgaatcggtgtatacttacagcggacccttacactggtatacctgacaatgggattgtctggtacacctggcatgggtggtggatactctgaaatctgtggtcatgactc

SEQ ID NO: 526846 - DNA, 142 bp, Homo sapiens
tgctatggttacagtgagttcaccctctaaatcaccacgatcaaaagggacaatgcataatgcacgcagcacatgggctcataactgcttagcctagccacacccccatggacaacagcatgtgattaacctattagcaata

SEQ ID NO: 526847 - DNA, 301 bp, Homo sapiens
  misc_feature (108)..(108): n is a, c, g, or t
  misc_feature (140)..(140): n is a, c, g, or t
tgggctcatcttcttggggaatgaaggcaaatgttaacaagaaggcatcaggagggtggatggtaaaagagttggcaccccagttaggaaggcaggcaggggacaggngtttggcctaatggagtagtagtgaataatgnagggtggtagtggtggtgaggaaggagtttggatgtggactcaatggaagtgtttgcaaatgagagttctcctgctcaaataggatagggaggtagcaggcctaaaacttggggtgggtatctaaaactgcctcctgggtcagtcaactagtagaggggaa

SEQ ID NO: 526848 - DNA, 881 bp, Homo sapiens
aggcttaggagtcttttggaggagtctttgaagtaggtagaaaattatatcatcagtaaagacagataagttgattttctcttttcttatttgagtgctttttctttctttatcttgcctgattgttctggctaaaactttcagaactatgttgaataggagtggtgaaagtgcacattcttttcttctttcaatttcttaggaaggatgcattagtctttcacctgttcagtatgatgttggctgaggatttgtctcatatggctgttattattttgaggtatgttccttcaatgcctagtttctttgacgcaactcttttttcatacaactagatattacattttattacttgctatttccacatctattcgaggctaatgctggtcccgttccctactcattctctcatatgttcgaatcacactttatagcatttcaccatgttccaccccattcctgctttcacagtaataatgtccacatagttgcagtgaaataactttgattcctgaggtcagtttgcaacgcattcatgaataatttcgtgtctgtattcatcaggcatatcgcgcctgcaattctttctgcgtgtctttacctgatccactatactcacgatgacgactggattctttactctgactcgacttacattacggaaggagtcccactttgcatctcctgggactacctctcttgtaaattacaggcactcatttcgctataccgctgctccctcctgcctgggccttgcttctgctttagccctttctattactcgctcgctttttttttccccaattcccttgctctcccttcggctctcctcaccctccttcctctcgatcctttgcccgctgtcctcctcgcattactct

SEQ ID NO: 526849 - DNA, 107 bp, Homo sapiens
gcacgcgtggagcatcaggcacacactctgcatccgacacccactccctctttgtgtacttcagtcttggagttggaactctaccctggtaggaaagcaccgcagca

SEQ ID NO: 526850 - DNA, 309 bp, Homo sapiens
tggtccgacatggcgactccctaggccctcccctcttcaagtgggtctacatgcaactgtgaggaggggagattcagtgtggtgggggactgagtgtggcaggcactccccagcagtgagggtctctctcttcctcttgtgctcttgctggggctggtggtccaggggtctttctccttgtgtggtcatgtgtgccatgaagtccacctgcctgtttctgtagtcgaattcgttgtcattccaggaaattagcttgagaaagtggtctttgagggcaatgccagccccagcgtcaaaggtggaggagtg

SEQ ID NO: 526851 - DNA, 342 bp, Homo sapiens
aatagtcgggctatcgaaataaccgatactggcatcatgtgtcgagaagccgccaatagcgatagtcgcaaagctatggccgatggcatcaaaggcatccattccggcaaaccacgccgtttccgcaattcgcgggcgcattttgttatctttcagcgggccgggcatttctgcgcgatagagctgcatcccacccacgccgaggataggcagtatcgcaaccgccaacacgatgatccccatcccgccaaaccattgcagcatctggcgataaaagaggatggcgtgagggagcgaatccagccccaccagcgtagtggctcccgtagtggtcaggccaga

SEQ ID NO: 526852 - DNA, 187 bp, Homo sapiens
gagattttgtttcctgatgcctaacatatccaacattataacacatgatcgtaacaagggctatgggagttatgagacaggaaccatggacataaaccaatatatgtatcatgacaccacactcctgccattagcatcttttatgactaagagcatgatttgccagggaatttaattgagcgagaac

SEQ ID NO: 526853 - DNA, 495 bp, Homo sapiens
acacactgtcagatcgcctcagggtgccttagtggacgggtctctttgtatcagccaaagttttaggcacaacttacatcaaatgaggaactcttctggtgtttggcttataaattacttcaatttaggtgaagtattttcttttttagaagatcttataagtttggatcaagatcttggttcttatgggtcagtggacatatatatgtgtgacctgagtacttggccttccagcgtcatccgggcatctccatttcaaccacgcagcctgttctgtcagcattcctttgctcctgtctgtgccgctgagcttgggttttcctggtcattttgcatgtggctcttgttctccccatccctgtctccaccattcctctctgcctccgtcctcgtttttgatttttggtatgaattttatggacatttggcaggagccttggttgggatgagaaaacccatggcactagtgttaaataaaactcagaagttgaaaaa

SEQ ID NO: 526854 - DNA, 200 bp, Homo sapiens
tgcacctttttgcacaatactaaattataactttataatacacatcacacatttcacacactctcacacgctactttcttacatcaactgtgcttggggaaactccatttgttgaatgccactgtgaggcatattttgctaatactgctgtctccaggctatttctgctttggaacacactctatcacagttaagtgtct

SEQ ID NO: 526855 - DNA, 241 bp, Homo sapiens
cctggaggaattgtatgtagagaggttattctcaaccagtcctgttttgtctgcagggctgatggaatagacagggatgcccttaggggagaactctggagcactaactgtgtgttccctacagatgctgcccaccacctcccccgccggctaaagccccggatcctggccaccgagatcccctcaccttcacgccagggaagccttgacccccagtgatcctggtgccgatgaatagcga

SEQ ID NO: 526856 - DNA, 460 bp, Homo sapiens
  misc_feature (23)..(23): n is a, c, g, or t
  misc_feature (76)..(76): n is a, c, g, or t
  misc_feature (112)..(112): n is a, c, g, or t
  misc_feature (124)..(124): n is a, c, g, or t
  misc_feature (141)..(141): n is a, c, g, or t
  misc_feature (147)..(147): n is a, c, g, or t
  misc_feature (235)..(235): n is a, c, g, or t
  misc_feature (248)..(248): n is a, c, g, or t
  misc_feature (288)..(288): n is a, c, g, or t
  misc_feature (308)..(308): n is a, c, g, or t
gaaaaaaaaatgcatcggaccgnacacatacagccttttccctgccgctgtgcatgaaacaatacagtgaacagcnattacatattattacatcattaggattacaagtaanctagagatgaancagtgtaagggtgtgcngtgtgncagtatatgatttgatgtatggagtgtccgtcgtcagttatatgcaagactacaccattttatatcagagacttgagcatctgtgganttgggatctgagnagactaaccattcccactgatactgaggggtgactgttgnatgctgcacaaatcccagantcactgtgatttgttgctagctcatctaatcagtattctagattttttctacatttttgcttgtggctcactaaaatatttaactttctccctgtatcttatcttattttgacatttttaatattatgtataatatctcattttgaatttaa

SEQ ID NO: 526857 - DNA, 226 bp, Homo sapiens
gaaaaaaaccaacccccaacttccatctttggaaaaaaaaattcccactttcctttaaccttaaaataaagctggaaggaaataaggccaaagggccattttttttccccaagggggggggaattaaggggggggtttctttttccttaataagttttcggaccttcccccaggtggcggaataaaggaccagcccctttcaataccgaacggttaagaaaaggtt

SEQ ID NO: 526858 - DNA, 101 bp, Homo sapiens
  misc_feature (94)..(94): n is a, c, g, or t
tcctggaccctggggcaaacctgtgacccttttttactggaatagaaatgagttttatcatctttgaaaaataattccctcttgaagtaataancgtttta

SEQ ID NO: 526859 - DNA, 559 bp, Homo sapiens
gctcggtccttcgtgccgtcctccccgctgggaggggcagctccagctccgctcggctcgctccgcccggccacaccggctttttccccatcaggcggtccgagtgcggctcctcgcgagcctgcaaaggagcagcaggcggttccttttcggacgacctggagcgaggcctgcgggactgcgcgccccggcgggcggcgtgcggctcccggcatgcgcggcggctgcgttcccgccgcctccgagctcgcctggggctgccgcccgcctcctgccgggccctcgggctcgcccggcaccgcggggcttgatcagggagatattttagtacaacatcttttcatcacagaaatgatatcttcagggaaaagacttcgaaaaagtgcctgaagtgacacaacacatgttttcttctggtatctggctaaagccttctcttctaagcagcataaactactgctgcctacatgttgcctgttcataaaggctgaggcaggggagtcgcttgaactcgggaggcggaggctgcagtgagccgagatcatgccatttccctcca

SEQ ID NO: 526860 - DNA, 426 bp, Homo sapiens
tttgcccagcccatgtaactctaagggaataattatatactttttaaattaaaaaaaaatttatatcagaattgtaatttatgatattaacaaatatttttgtgtaatgctttctacatgtatttatgtaatgggtatatgagaagataacttgagaagacctttgaatatttcttgggaggcattttgtattttgagggtatttttaaacttgttctttaagtctttgtatgattgttcttaataaagtaataattcctgggacaatgcaatatctaaagccaaagaggataacctaattttctgaagaaacatattaatatggcttcccataacctaagcagaaaaaccacaggtgtgatatacagaggaccaagtccaagttttattgtcttaaataaaatttgtatgaatttggttaaaaaa

SEQ ID NO: 526861 - DNA, 808 bp, Homo sapiens
ctgcgcaggagccgcagggccgtaggcagccatggcgcccagccggaatggcatggtcttgaagccccacttccacaaggactggcagctggcgcgtggccacgtggttcaacacagccggacccgtaagatccgcagacgtaaggcccggcaagccaaggcgcgccgcatcgccccgcgcccgcgtcgggtcccatccggcccatcgtgcgctgccccacggtatcgggtaccaccacgaaggtgcgcgccgagcgcggcttcagcctggagggagcctcagggtggccggcattcaccaatgaatggtgtgcccggacccactggcatatctgtggatcccgaggagggcggaacacgtccacggagtccctgcagggcccaaacgtgccagcggctgaaaggagtacccgtacaacactcatcctactttccccaggaagcccttcggaccccaagactgggcagacagtctgctgaaggaactgaaacttgggcccacacaagcttgacccgggaccggtctcatgccccgtccgggacccgttctattcacgcaaatggagaaccggctcgagttcatcacctgacggacgacgcacgaccttccaaaggccgttacggtacgatctcccgaagtgggcccgtgcagacgcccggacaacttacggattacgggacacaccagcagccacgcaagcccgcaaacagcatgcggcacgacacataaagcccctggggactggaatcgaagcagacaggatgggcaacacagcgaggtcgcgcacaccggagcccgagcaactgg

SEQ ID NO: 526862 - DNA, 233 bp, Homo sapiens
cggtcgacctcttgaggactcccctgtttgtgggcgcgtggttgtgtgggttgtgggctgcggggcgtccttcgttgtgggcgcaccgctcgtgttaggacccgaaagctggtgacctatgcctgggcagggcgaagccagaggaaactctggtgaacggtccgtaacggtcctgatgtgcaaatcggtcgtccgacctgggttgtgggggcagaaagaataatcgaaccatc

SEQ ID NO: 526863 - DNA, 160 bp, Homo sapiens
caccaacagagactgcgactcgctcaagggggctctgcgcatcatgggcaacgtcttctcgggctgcatgctgttcccccacatctaccccctgtgaaggtgcgcgtgctcatgctcctgtactcgtgccagaagaagaagccacaagggcctcaatccc

SEQ ID NO: 526864 - DNA, 153 bp, Homo sapiens
atcgaagtaacgtaatcaatcacccacaaggtaacacataggagtgacacagtcacggtacgagtagtgtgtacagccagtgtaacacacgagtatacgttgtatccgtaacatatcactcagcgtgtctctgtaaataacgtcgcggtaact

SEQ ID NO: 526865 - DNA, 1382 bp, Homo sapiens
gactgtggaagctgccaatgagctactcagcagcttcagcgtgtgatgcactcactggtacaggaagacagagatcaacacgactacaagatgaagcaaggcagagatcatggtagagtccggcgccggagtaagaaagtgggtgactgggcaaagagggcatcggtgccaagcgcaacgtagaaccaccctgtgaatcctatcgaatgccaagtgacggattaatcggcgcaggtcagcgcgagccctcgaggtgagaaggacatcaccgaagagaagacgtcggactgcgtgtggatgccgtatgtcatcaccgtatcgcatggcactcaccacatcggcacgtgctggatctgtgtactgtcctatgtcgctagaccactggtgtactcgtgtatccaaactggggtggtgtacccacatttacttctgccgattttacatcatatgtgcggaaacgaggggcggtagtaaacccatggcgggaagcgatgccatatgcatacaccacgcacgagcatagggtaagctctgggcaacccaatctgtgctgcctcttttatctcagtaatcgactgggttgcaaaatccttcggagtaaaaggtaccaagcatatgggaccgaccttcatgtggggacccatcaatagggcgcgttagccggtgggtggtagcatgggcttgattcctagggggttagacaccattaatatcaatctacaagttaaggtaaccccaccggaagtaagcacaggaggttggcaagaaattacttcaggcaacggttggcggaaacaatggagggttgggggtatgggttgacaaccatggttggctccctccctaggagaagttccgaccgttgaataaagattccttcggcttagaaggcgttaccggaatgactttgctgtccacccaaaaaggacacgttcaggaagtaaaccaaaggggacccaaacacgcggcagccctttgaacacaagggcaataaacccttattgggcccctaacgttagaacaaaagggctaagagcgcatattgaaaaaacaacgttgcggttagaacacaggcgatatgatgccgaaacgggatagttaatcccgtaaggtgaaaccacactctaccaacaacacatcggttccaactttacgtcggccccatttgcgacacagttaacacggataaccaattctactctacctcacgtatgccgagaaaaccttaagaaacgaacctacacgtgacacacaccagagattcacacataaccaagagaaagggccgctctccaaaacacacatgcgaggacgcggaacagcacagacgtggggtatcaaacacacgggcgggaggcgacacaaagctcggcggcgcaccg

SEQ ID NO: 526866 - DNA, 564 bp, Homo sapiens
tacagtttctatacctcaaacaaccgtatgtggaactgatatttctggtgtataattcattacactactatagacttcacaaatgacacaacatttcaattgctttttcaggaactgctatatcatcattatataaattgtcaggtattggtttacggtttttgtgatccttcagttttggcagactgtcaatggcatttcacggttcttttataccatagcaaggacactgaatatggcttcagggaggccatagaatggattcgggtaccgagtctccaacttcgatagctcgtccgtcatggcttctatcctgtgtgaaaaccctggtgaaccaagcgggtctcttatcgtagggaacccccttggccggattgggtacccagattgaattgatttccttgggtccattcccagcaacgtcaacggtggttctgaaacccagcaggcctacgtgctgtcctatctgcgaattccaggctcttagacaagtcccgagggcctcatctccaggaaaggctcctcctcccttcccggccgaccgagtgtgattccagatcactc

SEQ ID NO: 526867 - DNA, 903 bp, Homo sapiens
ggctcgggttagagcctaggagaccagatcctgagtgtggaaaccaaatgtgagagggggcgtgtttgatgctggggtcatccgatgctctcgttagtgtgagagggaactcacgttagcacattcgagcgagacatgttgcggtgatgacagacgtgggctgagctcggacgcaagtggagtggggagcgcagcagtgggtcctctacgctggtgtcgagcggcccgtgtcagcgcatggtgccagagaatgcaggagaactggtagcgcacgtctctggtgctctgctatggacgtgaccacagctggcggcccagcggctcctccgaggtgctcagcggcgccaggaacagtagctgctcgtacttggcgcgaatccacgactcgcgctcctccctgcaaagaccagggatcaacggaaaaggctctagggacccccagccaggacttctgcccctacccacgggaccgtcctcaggttcgcacaccctcagcaacctaccccccgctctgttccctcacgcttaccgcgaagagtcccgcgagggcttggcacggcctcgcgtgtcgcctttcccacacgcggttggcccgtgtacgtatgccaatagcccgtcagcaccagggtcagcctcccgttggccagtcgtccaagtccagcgagcgaacgcgggacaggtgtgtgcccagggtagcgggtggatgccagaacactcgatgccgatgacgggggccaaggttcaagctgggctccaagtggggtctgcgtgaatcgcacgtagaaggtacggctcccagccgggcacagccacagggcaccccggtattcactacactccctagccctcggtgccttctggcatcactgggggccccgcaatccaagctgattgattcccttg

SEQ ID NO: 526868 - DNA, 103 bp, Homo sapiens
agcagtgtgtatgcttcatcttcctgcagtatggactcatgggcaagtagtcttgatgaaggagacacaacttccctttggaaactccagcgatactccgccg

SEQ ID NO: 526869 - DNA, 991 bp, Homo sapiens
tgctgtgcgcggcggacgtcggagtgcagcggtggagctggagcgtgtggccgccgtgggcctctccagggccgcagcgtgcatgcagttgtgtgccccccgccccgtgccggcgtgacctgaagaacgcacgtgactgggggccggtggggacccgccccccggccggccgcagccatgaactccaacgtggagaacctacccccgccacatcatcctgcctgggtgtacaacggacggtgactgacactgaccgcagacccacccagactggcatcaacggctctctccccaaacgacgcgaggacctcaccgaacctccaggtcacccactcgagcggccctgagcgggaacccccaatactgctgcacggtacttgtactcctgcattgaacacctccttgcttggcggaacgtgacttcccttagcctccccactccaactgggctactttccttgaccacccactctatccaccccgacactgtcgcggctgcccactggcccacgatcttgcctcaaccggtgctcaacgaacggacctggaccgtgctgacgcctgggagcatccgcacaacgtacctgcctcgaccatcaacgctgccctgcctgatctcatccctaagcctccgagttctgcactccacctgacggcaagcgccgctgcccggccctgacattcagagggacgcaacctaaccgacggcacgctaatgccaccgctccgcggcccacggcctggctcaccagacaactcccagcgtgagtgccagccgggtcgttggcccagcgcggcatgcggcccgacacgctcggcatcggggccccctgcgcccaacgatgcgcccctgccaccgcattaccctcgcaaaccgagcgcccgtgcgggccccccaagtggagtgcccccggcgaacgccgcctgcaggggcccccagtggcccaacgacagcgatgccaagcgcacagccccccaaacagcaccccct

SEQ ID NO: 526870 - DNA, 129 bp, Homo sapiens
tgctatatctattcacaacgtgacttccaatatgacaactgcttagatatttaggcatgtgctataagttatcttagttgacatatgaaaaatgctttagatggatcacattctgagtatattggatta

SEQ ID NO: 526871 - DNA, 99 bp, Homo sapiens
ctcagaggatccttcattctgtcatgtggtggttggggatacatcacaatgacagaaatgacacaaggcctttaacttgtcttctagtttagagacatc

SEQ ID NO: 526872 - DNA, 184 bp, Homo sapiens
tacgatgcccgaagccaaaaaggttgatgctggtgccaaggtgaaaaagggtaacctcaaagttaaaaagcccactcaggggaagccccattgcatccgcaaccctgtccttgtcataggaattggcaggtattcccgatctgccatgtattccataaaggccatgttcatgaggaagtactca

SEQ ID NO: 526873 - DNA, 859 bp, Homo sapiens
  misc_feature (109)..(109): n is a, c, g, or t
  misc_feature (165)..(165): n is a, c, g, or t
  misc_feature (258)..(258): n is a, c, g, or t
  misc_feature (289)..(290): n is a, c, g, or t
  misc_feature (293)..(293): n is a, c, g, or t
  misc_feature (300)..(300): n is a, c, g, or t
  misc_feature (316)..(316): n is a, c, g, or t
  misc_feature (319)..(320): n is a, c, g, or t
  misc_feature (326)..(327): n is a, c, g, or t
  misc_feature (338)..(338): n is a, c, g, or t
  misc_feature (343)..(343): n is a, c, g, or t
  misc_feature (348)..(349): n is a, c, g, or t
  misc_feature (438)..(438): n is a, c, g, or t
  misc_feature (455)..(455): n is a, c, g, or t
  misc_feature (468)..(468): n is a, c, g, or t
  misc_feature (472)..(472): n is a, c, g, or t
  misc_feature (484)..(485): n is a, c, g, or t
  misc_feature (601)..(601): n is a, c, g, or t
  misc_feature (642)..(643): n is a, c, g, or t
  misc_feature (855)..(855): n is a, c, g, or t
caggtgaggccgggtgttaatcggacgaggctagagtcctctgctgtacgactgcactcccgcaccctcccctaaatcccccctcttcggcctgtttaccttttaactnggcttcgttgcacgtttggtgtgtgtgtttgctcttcgcagcctcttgagcgtctnttgtacttaattcttacactgtggacgctctctcgcgcccgccatcccccgacccctctgatctccgatccttgacgatgtctagcctgcatngattggcccttttccctgggtatggcagatnnatngcttgantgatcctctccccccnaannaattcnnacacaggagcngtccngaggnnctggatacttattcttcaaatggctttaccctcccagtagctccagggaccctccattttccatatccaggaaaatgtgatgcgccacnaggtatcagcgtctggntcgccaattcaantttntatgcacaagtnnactcatgtggaagatccagagtcaacagaggctcgtcaggaagatgtctacagaaaaggtagaccaaaaggaggaagctggggaaacaagaggtgtgcggagaccagatcaaaggnaccggacaaagaggaggaaccaccagctgctgcatcccatnngccaggggtggcgtccaggtggcagagcagctaggaacgcaaggctgaactggggccagaacctgctctcccggcatggtcagacctccaattactgcttactgtgggcccaggaggtgggccaagtcttggcaggccgtgcccgcagctcgctgctgcagtttgggggtgctcttctgcacaatcctccttttgctctgggtgtctgtctnctct

SEQ ID NO: 526874 - DNA, 399 bp, Homo sapiens
  misc_feature (242)..(242): n is a, c, g, or t
  misc_feature (281)..(281): n is a, c, g, or t
  misc_feature (335)..(335): n is a, c, g, or t
  misc_feature (343)..(343): n is a, c, g, or t
  misc_feature (363)..(363): n is a, c, g, or t
  misc_feature (387)..(387): n is a, c, g, or t
gcaagggctcatgacgacccctcctgaacactgttcaagggcgacggctagcattcctcgctgtgagtcctgaacagcagcttctcgaatatgaccgacgtcatgtctggcacccctacgccccgacgatcggggcagacccaatgctcgcagtgacggctgccaacggagtctggctgcagctgcatgatggggaacaccgccacgaggtcatcgatgcgatggcctcgtggtggtggcanattcacggttaccgaaacccggtcctcgacgaggccctnaaccgtcaaagctcccagttcagtcacgtcatgtttggcggacgcacccataangccgcggntgacgccgtcatattcctantgcgcctggccccggggcccctcnaccggatcttac

SEQ ID NO: 526875 - DNA, 1108 bp, Homo sapiens
  misc_feature (109)..(109): n is a, c, g, or t
  misc_feature (165)..(165): n is a, c, g, or t
  misc_feature (258)..(258): n is a, c, g, or t
  misc_feature (289)..(290): n is a, c, g, or t
  misc_feature (293)..(293): n is a, c, g, or t
  misc_feature (300)..(300): n is a, c, g, or t
  misc_feature (316)..(316): n is a, c, g, or t
  misc_feature (319)..(320): n is a, c, g, or t
  misc_feature (326)..(327): n is a, c, g, or t
  misc_feature (338)..(338): n is a, c, g, or t
  misc_feature (343)..(343): n is a, c, g, or t
  misc_feature (348)..(349): n is a, c, g, or t
  misc_feature (438)..(438): n is a, c, g, or t
  misc_feature (455)..(455): n is a, c, g, or t
  misc_feature (468)..(468): n is a, c, g, or t
  misc_feature (472)..(472): n is a, c, g, or t
  misc_feature (484)..(485): n is a, c, g, or t
  misc_feature (601)..(601): n is a, c, g, or t
  misc_feature (642)..(643): n is a, c, g, or t
caggtgaggccgggtgttaatcggacgaggctagagtcctctgctgtacgactgcactcccgcaccctcccctaaatcccccctcttcggcctgtttaccttttaactnggcttcgttgcacgtttggtgtgtgtgtttgctcttcgcagcctcttgagcgtctnttgtacttaattcttacactgtggacgctctctcgcgcccgccatcccccgacccctctgatctccgatccttgacgatgtctagcctgcatngattggcccttttccctgggtatggcagatnnatngcttgantgatcctctccccccnaannaattcnnacacaggagcngtccngaggnnctggatacttattcttcaaatggctttaccctcccagtagctccagggaccctccattttccatatccaggaaaatgtgatgcgccacnaggtatcagcgtctggntcgccaattcaantttntatgcacaagtnnactcatgtggaagatccagagtcaacagaggctcgtcaggaagatgtctacagaaaaggtagaccaaaaggaggaagctggggaaacaagaggtgtgcggagaccagatcaaaggnaccggacaaagaggaggaaccaccagctgctgcatcccatnngccaggggtggcgtccaggtggcagagcagctaggaacgcaaggctgaactggggccagaacctgctctcccggcatggtcagacctccaattactgcttactgtgggcccaggaggtggcagtctggggcgtgccgcggtgtgtggtgggtgctcctgacatcctcctttgctctggtgttgtcttcctctatggtccttctatttcctattgcgcagtcagccacctcagccctgtgcatttctactacaggacgactgtgattcctccacactcatctgctccttccctgtgccaatgtctcgctgactaagggacgtatcgtgcgagttggacgcgatcggtacttaagcttgactgcaagtcctggatcaagattgggctgttctggcacattctgtacacagaggtgcgatatctcattcttcggtcggtgatgtgataacggtcaacctgtcagatgt

SEQ ID NO: 526876 - DNA, 150 bp, Homo sapiens
aatagagtgcttggttaataatacgcaactgataagtcatcgtaaccaattggttcactacattacacacctgtaccgatcttggcatgtaccattcaaagtcaccaccgtaggttaaaatagcctttaaggtaaccagcgcaggcccca

SEQ ID NO: 526877 - DNA, 124 bp, Homo sapiens
tttttggaccggtccccccccccttttttgttttgttttgttttgttttgctacgagcccccattcctgtttgtaacccttggttcgcccggttttttgttttcagtaaagtctcgttccccca

SEQ ID NO: 526878 - DNA, 238 bp, Homo sapiens
tatccccagggaaggaaaggctcccccatttgggaaagtggtttttacgtcactggacaccggttttgagcattagtttgaaaactggttcccgaatgggctttcctccctttcccctgcccccctcaagtttaataaataaggttggactttttttactataaaataaatgtttgtaactgctgtgccctgctgtaaacttgttaaaaaaaaaaataacctgcatgtgggctcctca

SEQ ID NO: 526879 - DNA, 671 bp, Homo sapiens
ttttttttgagactgagcttcactctgtcgcccaggtaggagtgcagtggcatcatgtcagctcactgcaacctccatctcctgggctcaagcaattctcctgcctcagcctcccaagtagctgagattacaggcacccaccatcacacctggctaatttttgtatttttagtagagacagggtttcatcatgctggccaggctggtctcgaactcctgacctcaggtgatctgcccacctcggcctcccaaagtgctgggattataggcatgagccactgcgcctggcccattcttatgttaataaatatttgagttatttctactttttctgatatcataagcaatgctgttgtgacttctgatatacattatagctagcctctctgcttatacacccaggaactgctggctcatatggtatatgttctttcacttcagtaaataatgtcaaagtattttcaaaagtggttgtccctcatttacacccctcaccaacagtgtatgagatctgttgttcttatgtaccatggaacttaattttatcaatctggtgagagtgtaaataacatctaatagtaattttaatttgcactccccaattactaataaagttgaacagcttccacgtttattggctatttcaattagtaaagtgtctctggaagttg

SEQ ID NO: 526880 - DNA, 204 bp, Homo sapiens
gcggtctccacaggagttaaagttcctcgtaattttcgcttgttggaagagctcgaagaaggacacaaaggagtaggcgacggtacatttagctggggccttgaggatgatgaagatatgacacttacacggtggacaggcatgattattgggccaccaggacaattatgaaacagatatatagctgacagtagatgtggacct

SEQ ID NO: 526881 - DNA, 163 bp, Homo sapiens
gagtaacgcgacgtacatctaggactagtcagtagaacattagacatgtagaagataataagtgtacgagcggaaggtaatggttgatattgctaggttggcgcttccaattaggtgcattagtagtttacctgggttacggtctacctgggtttaggttcta

SEQ ID NO: 526882 - DNA, 514 bp, Homo sapiens
  misc_feature (102)..(102): n is a, c, g, or t
  misc_feature (156)..(156): n is a, c, g, or t
tatataaaaaaagtaggagtgggctttcccccagaaaaatggctggcatggcaaacctaccatgatcaccagtgtgaatggggatgtggtcccattataatntgaaaggccctttaaaaataatgagatttccttcatactgggccaggaatttgncgaagtccctgcagatgacaggaaagtcaagagccccataaccttagatgggggtgtcctggtacatgtgcaaaaatgggatggaaaatccccccccataaagagaaaacgagaggatgataaactggtggtggaatgcgtcatgaaaggcgtcccttccccgagagtttatgagagagcataagccaagggacgttgccctggactgaagttcgcattgaactctccaccattctgtgggatatattgttcaaaaaaaaattgttgttttccatgatttagcaagcaactaattttctccccagctgattttattcaaaatgggtacgttggttaaataaactttttttagatttca

SEQ ID NO: 526883 - DNA, 156 bp, Homo sapiens
tctagcaggatcccatggtaagcttattctgagagctgtagacgcctattggattccctgtcatgcacgagaacaatccgtgcattacataattcttacctgtccgttgcctcaccccacttttgggagcagatggcatagcatcagaacaatgat

SEQ ID NO: 526884 - DNA, 647 bp, Homo sapiens
  misc_feature (178)..(178): n is a, c, g, or t
atcgcaatggcattcctaaggcttgaccgaacgaacaaattctaggctatatacaactacgcaataggccccaacgtcgtaggcgccctacggggctactagcaaccgcttcgctgtacgccacgaagagactacttcagccaatggatgccccataaaacctcggcacagtctaccnatcaccgctctatcatcactcgtcccagaccgtctagctctcagctcatacgctcgttctacgtactgaagcgcccccgtccgcgcagtacgcgcacaccgcactcctgggtgcgacagctcgtcacagacctaggggccgtccctgattgaagtgtcatatagcacgagcgctgcctaggcccctagagcgccgctctgacgtgcaagtgcctctggagtcgagggtcgacgcactcagaatctcaaatctaatgactcctgcatacgcgcggacaacgtggccgaggccacgtcacgccccatatagcaaattctacaatggctcgataccgtccacgcccttacggccaagtgcagttgcataccgaagttcacatcacttaacgtacactaccgtgggcctcacttttagacctgctgccaccgtagagtgcacaaacacaagaacctgctctggcttacggccg

SEQ ID NO: 526885 - DNA, 202 bp, Homo sapiens
  misc_feature (9)..(9): n is a, c, g, or t
ccccttttnttttttcccttttccccccccccacaaaaaaaggaagccccccggggttttttcccccccctttttttttcccggggttttcctttttcttttgggacaaaaaaggcccccttaatgggggcccggttgggggggggttttttttcccccccccccccaaataaaaaaaaaggtttttttttgggggccccca

SEQ ID NO: 526886 - DNA, 127 bp, Homo sapiens
ttactaggccttctcgcatgttgagcctgggagtccgtgagggtcccagagctcctgactcccccttctctcccttcgggccttctgcacactgaatgcggggcatccggtggagattcagaacaca

SEQ ID NO: 526887 - DNA, 164 bp, Homo sapiens
  misc_feature (88)..(88): n is a, c, g, or t
  misc_feature (164)..(164): n is a, c, g, or t
aaaaaaaaaggattagcaggcatggtggtgtgtgcctgtagtcccatctacttgggaggctgaggtgggaggattgcttgagcccagnaggtcgaggctgcagtgaactgtggtcttgtcattgcacctcatcctggacaagagagtgaggccctataactttn

SEQ ID NO: 526888 - DNA, 374 bp, Homo sapiens
  misc_feature (35)..(35): n is a, c, g, or t
cccggtctgatgtttccctttgtgggcgtcccttntaggggtttttctcccctgttttatttggtccaaggggttaaattaacccgttggaaaaaaaaaaattgggtttgggggggggggggggggggggggggggtatttagggtatcaccataatttttgggggaattttccaaatgttttccccccattttttttccccccccccctttttttccccccccttgaatttgttggggcccgaaaaaatttttccgcttaacccccgttttccctgtgaaagtgtgaaaacccgttcccaatgcccccggggtgtggggggggttcgattgttgtttttgtttgaaatccccccggtttttaaattgccccca

SEQ ID NO: 526889 - DNA, 264 bp, Homo sapiens
gccccccccccccccttttttttttccaggatgtttttttttgggggcccccccggtgtttttttcccccgccccccccccccccttcccccccccgtttttttttttcccggccccggggggtttttttttttttttttttttttccccgggttggggttttttcccccccccccccccaccccccccttcccctggggggggggcccctttggggggggggggcttttttttggtttttaggggtgccttggggccccctta

SEQ ID NO: 526890 - DNA, 462 bp, Homo sapiens
tttggcgaggcagtctctctgttgccacaccttaacacctattttttagcccaaacattccaatagaattataagttgctattatatgctatgttctttacccctgcacattcatacaaacagttccttcttgctgaaaacaggtgcttacctctaccaccctagaatgaacaatcatgttcacttctttccctgctggataactccttctaatagttaagtttcatttcaaatgtctcctcctctggtcagatttctctaaccacttggtttgtatcagctatatcacttcactctcctttaggaccacctatctcttacagtatactgagagttcactggggataaacattattaatgtgtgtattttcatcatcaagatagcaacttttatttaaaaagttgcttacatatttgatgaataaatgagtaaaaatcattttactacatcttcctgtcaat

SEQ ID NO: 526891 - DNA, 420 bp, Homo sapiens
  misc_feature (10)..(10): n is a, c, g, or t
  misc_feature (24)..(24): n is a, c, g, or t
  misc_feature (48)..(48): n is a, c, g, or t
  misc_feature (136)..(136): n is a, c, g, or t
  misc_feature (343)..(343): n is a, c, g, or t
ggcgggcaancaggggatcacttnagcccccggagtttggaggcctanagtaaaccttcagttgtgttattgcattcccaaccctgggcaacagagcaaggcccctgtttcctaaaaaaaataataggccgggcanagtgtctcacacctgtaatcccagcacttcggaaggccaaggcgggcggatcgtgaggtcaggagattgagaccatccctggcgaacatggtaaaaccccgtctctactaaaaatacaaaacaaaaaattagctgggcgtggtggcgtggtggtgtgtgcctgtagtcccacctacttgggaggctgaggcgggagaatagcttgancctgggaggtggaggtttcagtaagctgagattgcgccactgcactccagcttggtgatagagctagactctgtctc

SEQ ID NO: 526892 - DNA, 120 bp, Homo sapiens
cgtgtgcttatcgcgtgtgctaccgtcgtctaagacaccggctcctccaacctgtgagtgccctcagtctactgctccagtcttgcctgcaccaaccacaacctctttccatacaaccag

SEQ ID NO: 526893 - DNA, 146 bp, Homo sapiens
gaatatgctgtctcattctacatccttgacctactactatgctgtctagtattctctatactggatagctcctactaatagcacttggatttgtcacgtgatacccctaatacatctgtttcaactcagctatagaaactgctaga

SEQ ID NO: 526894 - DNA, 1589 bp, Homo sapiens
  misc_feature (1122)..(1122): n is a, c, g, or t
  misc_feature (1588)..(1588): n is a, c, g, or t
taatgtgtggtcgtgcaggtaaaggcttactaaaagggtgaaaacgtaggctgggattaaggcgacagggattccaaggatagtcagtaaaattaaaattcgtggaaaatggataatgtggtaaaggagaaggttaatgggttggatattggctagggtgggcggcttccaattcaggtggcatagagtaggtgggcctgcagtaaatgttagcggttaggctgtacggccagggctaatgggttggaatggatgtaggctggatgggttctcgataatatacactaagttatgggggatcaaggggtggtaagagtggtggcctggtgggtcaaaaatgtgggcgctaagggctatttttaaatcttaaaagcgcgaaagcccataataatccagcggggccccggcctcaaataaggggaagtggcccagtgggcatagggttcaaatagaaataggtggggagtggctgcgcggcggcaacagtgagcgtgaggccagagaagtctcgcgaggaaagggctaacgatgtgtggtggcaattacaacacagtgcactctacagggcaatacctaggctattacaagaagaatcagggtctcgctcctatatagagggctgggcgatagtgcggtcaaatccacttgcgctaatggaaggataaagattgcgaataaagacacactgggtggaggaggggagcacaaaagccctgagctcagtgggcagagatagaaagactactctcgggacagcccgcgccgccaccccaactcacacacggcgcgcgacaaccttcacgccacgcggatcccaggcaccacaggccgagccgagagatcacagcgccccctacggagacttctggtggcggcgaggcgccacaacgcgacatatgacaaccgcgcacacaccacgacatccagccgcgacaccaaacttagtagggaggcaccaccagaggcggcctgcgagaacacccacacagtcctactaaatcctcacccaacgggggagcacgtctgcggaacacaacggaacagcgactagcggctcgggccaacagtcgggcggcgcttcacacacacaactctcaacacacacgtcgcaacgaataacgnaacagccacccaagctgacacacagcagacgaccaatagggggaacaaccaacaatctcgcggcgacccaccaccagacgagcaactaagctagacacactagcccctcatcacaaagatagacagaaacacccccagccagcaaggagcccccaaacaagagcggggccacccacaagccacccccaaaaaggagaccacgcggcaacaaccaggagtagatcacatcaacctaccaagagaggcccctaaaaatagagcagaaacaaccgagaaacaccacaccaaggcgggggaacagcagagacagaccactagcgccaaacccacctgcagtagtagcgagcgagacagcgaacctaaacaaggatcagtcagcagcctacacaccagcaacacagactaagacagcagcacacaacatcaccagtcctcgccagccaccacgctcgcccccctccccggnt

SEQ ID NO: 526895 - DNA, 515 bp, Homo sapiens
  misc_feature (104)..(105): n is a, c, g, or t
  misc_feature (121)..(121): n is a, c, g, or t
  misc_feature (232)..(232): n is a, c, g, or t
  misc_feature (250)..(250): n is a, c, g, or t
  misc_feature (412)..(412): n is a, c, g, or t
  misc_feature (443)..(443): n is a, c, g, or t
  misc_feature (510)..(510): n is a, c, g, or t
tttagtatagcaccttcagggagaaaaaagtttagaccaaaggacattcgtgggggagctgatgggccagcagagactcagttggcaagcttccgggtgacttnnggaatgtctccccccncgaggcagccaaagaagaaacagatggacggtatgtgatgggtcacacaaacctgtcgcttgttgggagcaagagcagctttctgtctggaacattaataatgatctaaancggcctatttaatatgtnacaaggcacttgagtatggttgcatgtccaaatataaatgtttttaaattaacgggggcatttgtttataaaagtttaaccataataatagaatttttaaaacacgcttgtcctcctccaatattagcatatttttccaaaaaaaataaagctcgagtattnggtctgtgttcacagagagagactgaggcanacttgtaaatatgtgtctgtgacagcccgtgctagaaagctctttcaggaaatagtagtgtagtagnagctt

SEQ ID NO: 526896 - DNA, 325 bp, Homo sapiens
ctggacaaggttttggatcggttcacccctggcaccatcttaagtggatgcactgaagaagatgttgtgggatcaggggggctttgcccggggccctctaggctgctttctcccactggtaggggcacttaatggactgtcagcccaggacaactgggccaaactacagcgggattatcctggagcccttatcaccaactactatctatggcctgctgtcagttagccaacttttacctggtccccttgtattacaggttgtccgttgtccaatgttgtgctgttatctggaactcctacctggcctggaaagcacatgggtttt

SEQ ID NO: 526897 - DNA, 574 bp, Homo sapiens
  misc_feature (439)..(439): n is a, c, g, or t
  misc_feature (566)..(566): n is a, c, g, or t
  misc_feature (570)..(570): n is a, c, g, or t
aaaatgcacgcccaaagcaatttacagatcagtgctattcctgtgaaatcaacagtgtcactctacaccgaattataaaaagctatttcaaaatttatatggaaccaaaaaagagcctgaacagccaaagcaatcgtaagcaaaatgagcaaagctgcaggtatcacactaccttacttaaaactatactataaacccatacaaacaaaaatcgtttgattctggcacaaaaacagatgcacagaccaattagaatagaatagaaaaatcagaaataaagctccacacctacaaccatctaatctgtgacaaagtcaataagaataaacaatgaggaaagaactcccaattcaataaatggtgctggaataactagctgtcatatgcagaagattgaagctggacacctactttttaacataggcaaaaattaactcanaatggattaaaaatttaaatgtaagacctcaaactctaaaagtactggaaatcaacctaggaaatactcttctcaacatcagcctttgcaagaaatttgtgctaagtcccccgcaattacaacaganacanaata

SEQ ID NO: 526898 - DNA, 122 bp, Homo sapiens
gatgttcaggcattgtagtttcgtgcactcatcatttgtgagctacttctcagatgtatggttttgcagggattcagaaagctgtagtggctgggacggtggctcatggctgaatcccagca

SEQ ID NO: 526899 - DNA, 422 bp, Homo sapiens
  misc_feature (7)..(7): n is a, c, g, or t
  misc_feature (46)..(46): n is a, c, g, or t
accgccntttacaactatcttatttcctatcttaaaagtagcaatntaactttcacttcatgatacagggacatcatcatgattaattatcttgcacgaagcatacagagataaaagacacagtccatgcacttacgggtatggtctaagagagacagaacagtaaacaggattggggactatggaagctcaaatgataaatccttatataagtgacatctgagcttagccaggaaaggacacagcatacacaaagatgtgtacaggtatgggagtagaagagggttgtgtctgtgcacaactgcctcctgtgtgtgtgtgtgtgtgtgtgacagagagagagagagaagcatatttaaataactgaacagtttagtatgactagagcaacaagagatagttgtaaatggcggggcaccgag

SEQ ID NO: 526900 - DNA, 1120 bp, Homo sapiens
agccggatgccccgctggtggaagtgggctgacgcgaggtggtgctgcagtggacatgccccgcacctgtgtgagtgcccgagtgggtgctgcccgtgtgagtggatgtgtgtgcttgcaacactggctgtgctgatgctgcgctgctggcaacctggcagaactgccctgccatttgtatgcccctgtgaccccctgctgtcccttacccttgccctgactggctgcatctgtgctcctgtgccctgctggctgtactgtgacccaggatgccggatggacctggggttgggctcgctgctcttctgtacaccagtgatgaaaagttcctgggggtgccccctttggactggttagtggttgccctgggcgaatggtgaatgccgggacggtggaccgggtataggcgaacagcgcgctgacgtggttgccttgagcagatgtagagacgccctgggaacctggtaagagaagggtacgagatagggcaggcatggagttaccacaccggggccccgggtaccagcgcacgggttcgcaccaactttgggttggaggccggaagccccaaaaggcatacaacctccctctaccagacgctcgagatcccattcttggcatcacagcggacacccggaagacggggtattcatttcccaagggtggaaaacccttcccgtgtgtgccaactccttcggacggaggaacttccatgccgggcagatcggcccacgcgtcccgcaccagccagaggacatgtactggcgcaagcacgcgcactgggtgcaagcagcccatgagctagccggcccagtcgagatgcaccgttcgagccactgagcgaaaccccggagccgatgggacaggaccgtaccccggaagtgcccttcccaccggggcgcctcgccgtggaccctgggcggaccagaaagacggccaggacgaggagcgaccgcggcaacaccgaacgacccgaccctccgcgccgcgagaaacccagtcaacagaatggcaccccaaaaggcgaccgacgccgaccccgcgcgagcacgccagggagaacgaaccgcacggcccgcgcacgaaagcggtccggacgagccgtgcacgacgcacaccg

SEQ ID NO: 526901 - DNA, 1828 bp, Homo sapiens
agaacgtgtatcccttggtctggacccaggtagtttcttaatatgtcgatttatgtaagatggagcaaccgacatgaatgcgacaagagagcatatggagaattgtagcaagtagggatatctcaagagactgatgcttgagcaaggacattaaatcgtgaagcctgattgttcggaacgagacaatgccagagtgcatctcttcactcacaactctttatcctcaaagtgtatgtctagggctgctggagatagccatgaacgtacgaagtacttactggatagacaggttgtaactacgaatttctgaagaggaggctcttagctccttatcgataatgagcttggagcgaatcgatgaggtattggagaggtagttgtgctattgaagagcaagatggaagtagaatcgtaacaatctattgcgcttgcgctttggacacatcgataagaattcggtaatatgggaagtcttattccaatcaatcatacttctacataccaacgtcattcgtcgattagaaaccctagtaaagacacgaacgagacctcgcacgtacacaacttgagaatggctccaagtcatgggattttccctcatatggcatctgggttaaaaataaggcgtctcgaagtccagggccgaaaatgacacggtaatttggcattagggcaaaattagggagcacatttctcgatggaaactaagctagtgtgatgaataatatgtatacaaggcagagtcacactgagggaatgattataacattaacttaattattatatacttagagttaactcgtgagaatacgggccaaaactaagaggttatggaattcgtggcacgttttaacatggtgaaggtttccaattcttccaaaaaaaatttaaaagagctttttaggaaaattaaagtgggcggccaaaatttttccattggtttaagttggcgccttttaaaaggttccccaaagacaaaaggggttacacaacctctttggagacacgaacttgcggcaggggggcaatcctcttataggtgtttaaagcaaaaacaacccccagaaacgcaagtagaaccgacgaaaagaaaaactttccccccccaagaaaaagttaatttactttgcgacacacatggggacatctgcgggcgcaaacaggcgccagacccaacggcgtgccatcgagcgctcacagagaggggcgcgctgtgcccacagacatggtgttccgcacaaggtgattgttggacgacagagctgcggtgcgcaacccccacaccaagcaagcgggggccggtacacatatggcgcacactacggcggggtacaacgagaaaacacgggggagagcgactaggcgtataacaaaaccgcttggtgctcggtgcaccaccagcagtgaggagaacaccatgtaaataaaacaccccgaggagcgggggtacaccccactaacccactcagaagccggggcgcagtagtgacacgccagtggttcataggagcagaaaacaaaacaccgcgcggcggaacagaagacagtgtcaaacggactcgacagcgccaacacgagtcgacaagcgaaagaccgaccacgcagaggacgcaagcacaacgagagagagcggcgcggaggagacaagaagagcagaggagaggagcacaagcactgaaagacagaagacggagatggagagagagcggagcgaggagagaaggatgaggaacagagagcgaacgacgagaggaccaacaaaactgacagagaccgaaggcactcaagcagcatgacagccaaggccacggacagagacggagaagag

SEQ ID NO: 526902 - DNA, 416 bp, Homo sapiens
  misc_feature (339)..(339): n is a, c, g, or t
cacgaggggagcgcgaccccgcgctggtcgagctggaggtgcgtcgcggactggtcaccgtcgacggcgcccgccggtacggggtcgtgatcggcgacgagtcggccaccgcggcgctgcgcaccgagatgcgcgccgcccggcccgccgagctgccggtcttcgacatgggcccgcccatggagacgatcctcgccaactgcgaggccgagacgggcctgcccgccccgaagcgaccggtgtggacctgaccggcgagccgccccgcgagtcggggcctcgtcgcgtgcgagtcggggcgaccgtgagcaggggtgcgcggtgaccgggccgcacggngcctcgttctccgggcgggtcggatggggcgatcgggcggggctgctcgtcgtcgacctcgtccgggcctacaccga

SEQ ID NO: 526903 - DNA, 952 bp, Homo sapiens
  misc_feature (442)..(442): n is a, c, g, or t
ggtagagagatgcgtgtatgtagctggcatgattacagattgggcaaattgggggcagaaatagatgatagaaagcctagactcactcgaattgttagcagatttgtacttgcgttgtcaaaaggaagcccttgcagagaaggagcataaagttggcaaggagtacataagcgcaagctagcctatggagtttccctggtgcgctaatagaagctcaggtcccggatccagagcctgccagagttatctcgatttgcccaatgtcactggtcagccacgtgcacctggcctttgcgggagacatctacagtgaaggattgatggatcagacctctttccaggtcccaggactttgcgagagatggacgacaggttaggtggattagtcctgataggtgtatatttagggtcatatggtcgagaaccgaagatcgattaacanaaagggacaacgaggtaatttagtaagaatgtgtgtagacagtgtttggtcgggggaacgtattcttattggggtagagttaagcatggactttaactttgtgaaccaaaatgttgcatgacttgtggtggtggtagttacatagaggctccaccaaaggtaagtggatttagttgttcaaacaagactctggttgcggtcaactgtttactttggggattccaaagggcctttggtgaagaaaatcctcggtggaacgggagatcctcctcacaagagggtattttatcaacctgggtggtgcgtgctttaaatttcatctgtgcaggccattttaaaatacaccggggtttacaccatgtgtccaattcacccgaaagggcggagagacacccataattaggcgagctgcggttggaagaaccttgtcttacgggggacaacgttgaggaacatctgatcatgtgtctcacggggaaatcacatgtggcacgcacgttgatagtttta

SEQ ID NO: 526904 - DNA, 271 bp, Homo sapiens
ttgagagacggagggggggatctactccccttgatactgaggcaggaacttggtcacgtctctcagcatcccgaccagcccaaggtcttccgctgagcctactgagatccagacagatgggaacgtggtcatcgcctgcctggtccaagggcttcttcccccatgagccactcagtgtgacctggagcgaaagcggacagggcgtgaccgccagaaacttaccacacagccagttatgcctccggggacctgtacaccacgagcagccagc

SEQ ID NO: 526905 - DNA, 274 bp, Homo sapiens
cgcgcgcatgcctcacgcttataatcccagcactttgggaggccaagggaggtggatcacctgaggtcagcgagtcaagaccagcctggacaacatggcaaaaccccgtctctactaaaaatacaaaaattaaccaggtgcgtagtgtgggcgctacttgggagggtgcaggcaggcgcatccagcccgggaggcagtgtgtggcaagtgcagcctgagcaccgtgcctaatgtactcccaccttggcgcaacaagagcgcaaactgctgtagt

SEQ ID NO: 526906 - DNA, 248 bp, Homo sapiens
aggctgagcaataccgtgcggacatgatcatcctacccgagaatggtgggcagcatggttgggcgtctacaacggcaagaccttcaaccaggttggacgatcaagccccgagaatgatcgcgctactaccggtggcgagttctccatcacactacaagcccgataaagcatggccgggcccggcattcggggccacccacttcctcccggtttcatcccttctcaagttatggctcagcggcgggtac

SEQ ID NO: 526907 - DNA, 465 bp, Homo sapiens
  misc_feature (66)..(66): n is a, c, g, or t
ccacccaacactggcagagatcctatgtttggagaagccagtgtggttcaacaaatgtaagttctncattctggctcctgtaattgctgagctatgtgatcctggatatgacacttaatcttgctatacttcgaatttcttacctataaaatgggaaatagctacttaatatggcttcagtgagatcatgtaaaatgattaagataatgtctgtcatatagtgcttaataaatgttggccatgattatcatcttttcatgatccctgtgaagtcagcattgtttaccccatttttagaagagcaaatggacgttatgagagtttttctttcctatgaccattactctgttcccaggaatgttttcaaattgcctgatctaatctgttgtactttaaaaccaactggctcctctcatgttataaatgtttattagtctgattaaataaatttacatttaaaaacga

SEQ ID NO: 526908 - DNA, 892 bp, Homo sapiens
gtgttagtctgtatattcaagataaagaaggcttgtcagctttggatcttgtaatgaaggatagaccaactcatgtaatattcaagaatactgatcctacagatgtctatacttgcgggcgatgaatacaaagttttaccctgggtcatgggaagccagaatagcaacacatcatgccatagtaggtggatctgtatctccaggagtgtggatttgatagtcaaagacaggtgagtgctttgctaaatttacacatccggtgttgctgtctcagtaaagggcaggtttactaccgtgtggtcatggttcctggaagggcgataaggacatggtagatgaaccagacatgcttggtccctcggcttgtgccaaggactgaatggtcataatggttcccaagtggcagctgcgtgatggatcatactgtgtatgaactggaagatggatgtgtttatacgatgtggtgctacacatttttcatacaagttaggaattattaccgaccggcttgccagattgtaatgtacccagacagagtacaggctaaaatatctgaagggaaggaaatcataggggtagcagaaggcagggtttcataagtactatggagtagagaagtgcttaccctatgggactaaactggtggacaactgggttgtttggcgagaatcccaaggccggcagcagtgtgtactggcccctcgatcaggtctctggcgtaccagtaaaaaacttgggctgactgttggttgcccaaggatgggtcagctggttcccaagggggattcctacctggcaaagtggaaagaagccctaacgtgtctcaaatttggctcggcctaacgagaaccattttaaacagggcacagccgccaccagacatcacacctac

SEQ ID NO: 526909 - DNA, 246 bp, Homo sapiens
ggcccgcttattaccaggtgcagtcagtggtggtaagtcattcatactcttgtacagccatcaccaccatctgtctccagaacccttcatctgtaaaactgaaactctatacccattaaacactgcctccccatctcccctccctgaagcccctggcaaccaccattctactttctgtctccaaatttccccttctaataaggacatcagtcatattagattagagcacactgggttaagtaagca

SEQ ID NO: 526910 - DNA, 104 bp, Homo sapiens
cacgtctatatctgatcactgctttatcagttgcccatctttcttcttgggcagtcatcgtagcctttcttttataaaacacatgatccctagtactcatcttt

SEQ ID NO: 526911 - DNA, 121 bp, Homo sapiens
cattgcaaccgggccataagccatatcgttaagcacgccaaagctttttcccttcgctgtgtgtttcctcgcaactttaactccggccactcactaagccaaggcgtgaggagagagacta

SEQ ID NO: 526912 - DNA, 135 bp, Homo sapiens
  misc_feature (3)..(3): n is a, c, g, or t
  misc_feature (24)..(24): n is a, c, g, or t
  misc_feature (40)..(40): n is a, c, g, or t
  misc_feature (100)..(100): n is a, c, g, or t
ttnctactcccgatgaatcctgangaggcacggaatgatntcctgaagagacaaaagacggggaagattcggcaaacttgcaggaaggaaattaggcaangcttcttgcggtgtttttgggttcctgatgattct

SEQ ID NO: 526913 - DNA, 136 bp, Homo sapiens
  misc_feature (97)..(97): n is a, c, g, or t
  misc_feature (133)..(133): n is a, c, g, or t
tcagcaggaccagtagctggatacgtgtcagctggagcagctgttgtcggattctgggcagagaccagaaagatggaaactcccaagagtaccaggnctgctaagaacttcatggtggtgacctgaagatcanggg

SEQ ID NO: 526914 - DNA, 2185 bp, Homo sapiens
  misc_feature (1629)..(1629): n is a, c, g, or t
tcagaactcattcgccaccagattacacatactggagagaaaccttatgaatgcatgaatgtgggaaggcatttcgccgtttctcacaccttactcgacatcagagcatccatacaaccaaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaggatgagatcttgttaaacatcacagaattcatacaggtgagaaaccctatgaatgtgatgactgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacatgggagaaaacattaattcagtttttgtaatgaaaggttaactcagagctcagacattactaaaattaagaaaaattctccagcctgaccaacatggtgaaaccctgtctctaccaaaaaataaaaaataattagctgggcatggnggcaggcgcctgtagtcccagctattcgggaggctgaggcatgagaatcacttgaacctgggaggtgggggttgcagggagccgagatctgccactgcattccagcctgggcaacagagtgagactctctcaaaaaaaaaaaaaaaaaaggaaaaagaaaaactctggagggaagagtcctggcggatgttggtggggaaacactttcaaggtggaaaaactttttactggattggtcaggtttaccacattagaaacaattttctatcttttctataagggtgggaaaagctctagtcttatgcaggacataacctacgggaagagagtggtatatatggtcaagagatctaagggcagaactttaatcaggatttggtaacacactcaggggggggaggtatttacagtcaaaaagttcggaaggaacaggtattactcgataataaattgcaaccctttaaaaaaagccttaatttaacccaattggcttattcaaatttgttggacacaatgtagcggaacaatttatttccccctcaataatcttaattgg

SEQ ID NO: 526915 - DNA, 423 bp, Homo sapiens
caacccagactgtggttcttactcttcccagggttctgcatgtatgcccagtgaacccagggctgcgtgcaaaggaggctcaggatgtgtcaccagaaaaactcgcgtatgagagcctggagtatccttccatttctcagccaaatactcatcttttgagactgaaatcacactggcgggaatagaagatagtgccagacttctcttatgggcacctagccgccttcaccttcttacctctacccctaagcaggaatagggtgtcctccctatctttcaaagcactatgctatgcatttaataatattcatttaagagtccttcatagagctcagtcaggaaggggatggggcatcaagccaagcccccagcattgagagcggccaggccacagctgctgctcccgtagtcctcaggctgtaa

SEQ ID NO: 526916 - DNA, 2403 bp, Homo sapiens
  misc_feature (260)..(260): n is a, c, g, or t
  misc_feature (1847)..(1847): n is a, c, g, or t
aggagaaaaaccctatcaatgccgtcattgtagtaaaagttttagccagcgctcagatctggttaaacatcagagaatccatactggagagaagccttatacttgtaaccagtgtaacaaacattttagagttctgatgtgataaaacatcaaagaatccacactggggagaaaccatataaatgtgatgtgtgtgggaaagccttcagtcagagctcagatcttattctgcatcagagaatccatactggggagaaacnatatccatgtaatcagtgtagcaaaagtttcagtcagaattcagaccttattaaacatcgaagatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaggatgagatcttgttaaacatcacagaattcatacaggtgagaaaccctatgaatgtgatgactgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacatgggagaaaacattaattcagtttttgtaatgaaaggttaactcagagctcagacattactaaaattaagaaaaattctccagcctgaccaacatggtgaaaccctgtctctaccaaaaaataaaaaataattagctgggcatggnggcaggcgcctgtagtcccagctattcgggaggctgaggcatgagaatcacttgaacctgggaggtgggggttgcagggagccgagatctgccactgcattccagcctgggcaacagagtgagactctctcaaaaaaaaaaaaaaaaaaggaaaaagaaaaactctggagggaagagtcctggcggatgttggtggggaaacactttcaaggtggaaaaactttttactggattggtcaggtttaccacattagaaacaattttctatcttttctataagggtgggaaaagctctagtcttatgcaggacataacctacgggaagagagtggtatatatggtcaagagatctaagggcagaactttaatcaggatttggtaacacactcaggggggggaggtatttacagtcaaaaagttcggaaggaacaggtattactcgataataaattgcaaccctttaaaaaaagccttaatttaacccaattggcttattcaaatttgttggacacaatgtagcggaacaatttatttccccctcaataatcttaattgg

SEQ ID NO: 526917 - DNA, 403 bp, Homo sapiens
acggagagcatctacagataggagaggtaagatagtacagagcaacatactaaggccaaatacctgatcggaactaacataagtacggactatagacatgatgcacttacctccttctcaaattgcagaaggagctttatgcttagcactgcaaattctggatactggtgaatggacaccaactctacaacattacctgtcatatactgacgaatctcttctaccagttatgcagcaactggctaagcatgtagtcatggtaacatcaaggacttaccacgcacatgactgtcaagaacaagtatgccacatcgaagcctgctaagatcagcactctaccacagctgaatactgcactagttcacgatttagccaaggctgtggcaaaggtgtaacttgtaaa

SEQ ID NO: 526918 - DNA, 678 bp, Homo sapiens
  misc_feature (56)..(56): n is a, c, g, or t
  misc_feature (77)..(77): n is a, c, g, or t
  misc_feature (82)..(82): n is a, c, g, or t
  misc_feature (87)..(87): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (103)..(103): n is a, c, g, or t
  misc_feature (105)..(105): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (153)..(153): n is a, c, g, or t
  misc_feature (159)..(159): n is a, c, g, or t
  misc_feature (165)..(165): n is a, c, g, or t
  misc_feature (181)..(181): n is a, c, g, or t
  misc_feature (195)..(195): n is a, c, g, or t
  misc_feature (197)..(197): n is a, c, g, or t
  misc_feature (202)..(202): n is a, c, g, or t
  misc_feature (204)..(204): n is a, c, g, or t
  misc_feature (207)..(207): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (223)..(223): n is a, c, g, or t
  misc_feature (231)..(231): n is a, c, g, or t
  misc_feature (234)..(235): n is a, c, g, or t
  misc_feature (266)..(266): n is a, c, g, or t
  misc_feature (280)..(284): n is a, c, g, or t
  misc_feature (321)..(321): n is a, c, g, or t
  misc_feature (328)..(328): n is a, c, g, or t
  misc_feature (334)..(334): n is a, c, g, or t
  misc_feature (344)..(344): n is a, c, g, or t
  misc_feature (358)..(358): n is a, c, g, or t
  misc_feature (394)..(394): n is a, c, g, or t
  misc_feature (448)..(448): n is a, c, g, or t
  misc_feature (519)..(519): n is a, c, g, or t
  misc_feature (583)..(584): n is a, c, g, or t
  misc_feature (587)..(587): n is a, c, g, or t
  misc_feature (593)..(593): n is a, c, g, or t
  misc_feature (647)..(647): n is a, c, g, or t
acgacagacaaagggagactctcggcctcaggcccccaggctcggccctccccggntcctcctagagcccgcccggncctgnccggnccgngngntcactggngnacttcttgacgnggntgnccttcttgaggggggggggggtcagcttgnagtggnagttgncctcccagaactcggnaaaccagatgttgngncgggngntgnccagngngngggtggngaagtagnggnngaagcctggcagggaaccaggacgtcagggnctcactggccttcnnnnncaccagccccagccctccccgcctcccccaggataanatatggnccaggnggagggaganagaccaggaggagnacatcctctgatccaggagaaaacaaaatgtggagnatttcgtttctttcaaaatgaaaagagctgtattaggtcccagggggatcgtgngtaatctacaactgctgcctttatggaagagaagcacaccgatgaggatgtttccacggcctttaaccgcnggaatgctaacagcgggctttgagaaggagccgcctgggagtcctgagattacagcacagaggnnggngggggngcccaacccggggagcacctgaagaggagaccaggccagacaaggagggagggnaccacccagatcacacagcaagaccaggacc

SEQ ID NO: 526919 - DNA, 241 bp, Homo sapiens
tgcccagtatactaagtggaaatagatggggtataggaataaacaacaaaggcacaggctagaaggaatggctatcgggataaaaagaatccagactctaggacagcttataccctgatgtacacctgcatacatttctttcccttcaccccacgaggtggtacgtccagaaaggtctgcatatcacagatgagctcaccgggctcactacacgattacgcgctgagatgcagcaacaaga

SEQ ID NO: 526920 - DNA, 320 bp, Homo sapiens
  misc_feature (58)..(58): n is a, c, g, or t
tggggaaacatagctttattttttttgcccctctgccccacaactttctgtaggattncacatgggggtgttggacatggagacaaagctaagcactgggaaccataggttctaaaaatcccaacctttccattgaccactaaggcattatttattgtctggtgccttgcagttggcaagccgactcctctttccttcagtctgagctttctcctggaggtttctaagttcttcatgcaaataggcttctggcagatgtcctctcagacatatctgttcaaaactcagagtgttcaagctgggaccttgtttcacgtcat

SEQ ID NO: 526921 - DNA, 108 bp, Homo sapiens
ctagcgatcccttacccggttctgggtagctgggactatacatacctgcacaccatgaccagctaatttattttatttattttatttttgagacaggtctcgcttttt

SEQ ID NO: 526922 - DNA, 82 bp, Homo sapiens
gatcagttgttttcacctggaagcatttgtgtctactttgatatgactgtttttcggacagtttatttgttgaggagtgtga

SEQ ID NO: 526923 - DNA, 853 bp, Homo sapiens
aggctcattgaggcatagcagcatactattggagggggagcaggcagtgctgtgtctgctggctcccatgccctgttctgacctcagccttggaactcctcaagaacctgaagattccagtggtcagtgtcggtggggggtgggaggagagagcggcagagaagctctgagagccccttcccccacgaacaaagtctagctctagatcgtgtatagtttaggcaaaactttgtacgtcttctttcccttttatgatggattttgagtaaaaggtacaaaacagggtttttcttgttttatcacctttgaattgtggaaagtttagtgagcacccaatgctcttctagtacctagtttaaacgtccaccaaggggacctgcagcgtcctagagacatgacgcatcaaggcctcgtgaatttgtaacactgcggaaatgtggcactctagcttcctccggtcctacctgcccaaggcacgacgaggcattgctccagggctgctgggtagttatacacgtacccttctataggcatggagtaggcaactgacatcacaggcttcataacacccaccagcggcaagcttcccctgactactacatgcagtctgcgactagtacatcagtgagaatacctgtgttaccaagaatcagcgaccacctgaaactagaaagatagcagaaacgacaaacaaaacaagacatacacacagcagcgaagggggacccaccaacaggggaggaactagacaatacaccggacataccgcacgacacaagcacgcccaacacaacgaaccgaaaagccaagacacacacaagcaaacgaaaaacaagaaacaaccacaaccaaa

SEQ ID NO: 526924 - DNA, 238 bp, Homo sapiens
gaaaacagagcctcctagatgtaacattcctgatcaaggtacacttctttaaattcactaatgattgaggtccatatttagtggtactctgacattggtcactttctattacacgagtgctaaacctaaaaagcattttgaacatacagatgtctattgcatagggaattttcttctcacccagtgaggtagaagagtatatctggtagcaatacttcaaccctttcctactgtatgg

SEQ ID NO: 526925 - DNA, 463 bp, Homo sapiens
tgtactttagaaatgtcagtcgctgcattcctaaactgtttatttgcactatgagcctatagactatcagttcccttggggcggattgttgtttaacttgtaaatgaaaaaattctcttaaaccacagcactgtggagtgaaacattgaactcatatctgtaagaaataaagagaagatatattagttttttaaggggtattttaatttttatataggcgggaaagaagagaggtgatggaatattgttaattacacccccggggtgtagaaaaagtgggaagcagtcaatttccacatcaaaggacgccatctaggaagttttggtccggcccggaaatattttaggaggggttcaggaaaggtgaccggattttcccaactgttcaaaattttaccagggaatttttggccggcggtcccttttaaaaggcaaatccattaattccccaaaattttaaaaa

SEQ ID NO: 526926 - DNA, 1194 bp, Homo sapiens
gcctttccaagggagtggttgtgtgatcgccatcttagggaatgttctcgtccgtggcgcacctggcgcggggcgaaccccttacaatcacggccatatctgcagctggtgcacgatggtctcggggaccgtccagcagcagcgtccccagggcccacggcgccatgcccgaccgacctcgcaatctgagcagccgctcgtcggtggaacgagtacatgattgtgaattttggctccgcgaagtattatgcactgtgtggctttggtgaggtcttaagtcgtggatcttgactacaaactgctgtggttcccctgcgatatgacgctgaaatgccagtatgctaggtggagcccctatgagagtacacagggcatatgtaaccggtattctcagttcatacttaccatgacggatggtgtaccgtggtctatgggtatctggactggggctcacgagctgtcgccttgggctaactctccatgcacgaggactctgcaaagttttcggctttgctatggagagtcttttacaacgggctgtgctcataggcaattattcgccgtgtgccaccacggagaagtcactgtaatctgtggcctgcggcatgaactagtatgtcggcctagtccttctggtcaggtggatcgaaatgtctcatgggtagagcatgtgttgcccgtggggtacctaattgggaaggctagcataacggtttcggaattatcagaacccctaaagcagggtaattgcccaaccatttttagaagcgcgagtagcaggcctcctcaatagtttgtggtcataaacgggatagcaaagggtctgtggcaaggcgatttctaactaagtggggggtcatggattctcggtctccgtgcgattgatgaacgacgatatccaataacaccgcaatgatagacacgttgtcggcgtgactcttggatcatccgttacttggtcttagaaagggcagactgggtgccaaacgtatatgctgctttcccttaccagggcgccgcgagaggcaattggattcgagtatggcaaggaaggcaacactgagctgtggatcgcattttgcgcaaggcagctgttaccatatggcctgggaggccctttggggttgccaacacgtcttgtccaccccatggctgagactcaaggggcatcttcagctggggactcatggagac

SEQ ID NO: 526927 - DNA, 167 bp, Homo sapiens
ataattttatatttttatgggcttgggtgagggaggtaggtggtagtttgtgtataatatttaaagatccttttcaaagttgtagtattaaaacaaaaattacagagacaattcgggtaaaatccagtgctttctctagtacgaaacctataagacaaagggaaaca

SEQ ID NO: 526928 - DNA, 137 bp, Homo sapiens
agcgcgacatctagaggatccctagcttttggcacttcctgggactacgcccctttgacagatggagattgggcagcagggccttgttgaattgttatctgctgttccgacttggttttcattagtccaaaggcagg

SEQ ID NO: 526929 - DNA, 168 bp, Homo sapiens
cattggctcatgcctggaatcgcagcactttgggaggctgacatgggagggtcacgagctcagatgttcgagacccgcctgggcaacatagtgagaccctgtctcaaaataaataaataaataaaaataaagaagcaactcttttagcattataagatagggcagagg

SEQ ID NO: 526930 - DNA, 137 bp, Homo sapiens
tcagtgatctcggagcaagcggaggatcatagagctcaggatccagacagctgtgcacacagcagagacctgtctaaacaaaaatagtatagttggtgtggcagcatgccttggtctagccactcagagactgggcg

SEQ ID NO: 526931 - DNA, 329 bp, Homo sapiens
  misc_feature (194)..(194): n is a, c, g, or t
  misc_feature (214)..(214): n is a, c, g, or t
  misc_feature (261)..(261): n is a, c, g, or t
  misc_feature (270)..(270): n is a, c, g, or t
  misc_feature (292)..(292): n is a, c, g, or t
  misc_feature (321)..(321): n is a, c, g, or t
aggtagagtgtagagattagacaatagtaaaagatattatataagtgtcgctattagagatggtttggggataatgttggagaggagtgtagggaggcccctccccccattccaggccccctccacatccgggttggcctccctccaggactccacccgggctcccggacgccagttgggggtcagaccccacnggggcaaccttgcagaggangacccggggtactgccttgggagtttcaagtcggtatgtaaatcagntttcccctntcacccctcccacccattaatntcctcccaaaaaaacaagtaaagttattntcaatcca

SEQ ID NO: 526932 - DNA, 172 bp, Homo sapiens
ggaaagctagcagggcaacgtcagaagccgaatacctggtctaggggcaccaacgtacaagggggccacatcgatgatgggcaggcgggaggtcttggtggtttatgtatatcaatacactagtcttgccccaaggctaccaggagtgactacgtgcagccatctgacagtg

SEQ ID NO: 526933 - DNA, 200 bp, Homo sapiens
tacatatgaagagagctatcttcaccaacaggactatatggtcgagcccgagctcttgcgcggcccgtccaggtctgatctggcagtcagtgacttgcattcccagatgctgacagtgtccacataaccaggtgcatgatgaggatctccagtcttcttctgaagatggagggcaaggatagggaaagctcagatggtac

SEQ ID NO: 526934 - DNA, 126 bp, Homo sapiens
atagaggatccttatgtagtcgctcttggcccacttctacctaatgctgttgcagcaacctgcttctggaaggagcaagtctggaacccagctcctcttcctctcctcccacctcacgttcctatt

SEQ ID NO: 526935 - DNA, 194 bp, Homo sapiens
ccggttgcagtgagccgagattgcgccactacactccagtctgggtgacagagtgagactccatctcaaaaaaaaaaaaaaaaaaatcagctcatgttactcccctgctcaaaaatttccagcagtttttactacaattaaaataaaaaaagtcagatgcagctgagtgcagtggctcacaccggggggtgggg

SEQ ID NO: 526936 - DNA, 1333 bp, Homo sapiens
caggggccctcccacagctctgacctccttgcccggagaccattgctggagcaaggtggactgtagcctgtcccagaacaagagcgccctggactgcacctcatcagacactctagacgtaccgcacggtgaaggaggagcagatctgctgacctcgagggcctgacagccggtgggacagagctcttctttcccaaaattagggagctctttgtaccatgaaaagccatgtttctgatgcttacagtctgggaatctgatgcgcatcctcgtgactccacgtcaaagcagcggtgacgggccggttcttaccgatacagcactggctggatgtgatttgcttgccacgagacagtctgcgtcatgatgccaacatgggtctgccttccaagcgcacaacctgggacgctcctacgagtcgacgaacgtgtcgtttggacacgggccgactctcggccgcccgccctttttggcctacggcccttccaattccctacagtcgtcgtctatggggcccaaaagtcccatccgtgcgcctagggctaccccaccaagggcatgctccgggtgaccccctccttagccccagcactacgtacagggtactgaccgaacaggctgcccttgcccactatagagccacggagaaggctgccactcttcaccagtgggacacagcccatccacactgctgcgtgctacaccaacagggcgcaacgcacggggacctacaccggcggcgcaaacacacgcgccctggccgaacgagacgaccccccctgggcgcaccccttcgcacactgatcccctggcccaagcgccagagacacgccctatcgcgacatcacctccccacacgccccccacaccaaactgacctgcggatcccagcaaacacaccaaccccccatggcacatgaaaaagtcacccatgcggccatacgccatatcaaacacaaaccaccccaaacgaatcagcgggccacatcggaccacgccatggaccggcgccaccaggaccccgaggcgcaaccacacacacccggccactaccccccaacgccgcccagcagccctggccatccaacctaacgggcaaacacaccctacgagcccaagtgacacctagcgactcatccccaacgcacacgcaccacgcacagcgcaccccacacgaccaggcgacagcgtcacacagaacacaccttccgtggcacgcaccaccccgtctacccacgacccccagcactcaccaggcgcaccgccacacacacagagcaccgccaccacctcagcacaaccgccgcccacacgacgaaccacccacgagcct

SEQ ID NO: 526937 - DNA, 348 bp, Homo sapiens
  misc_feature (186)..(186): n is a, c, g, or t
  misc_feature (226)..(226): n is a, c, g, or t
  misc_feature (304)..(304): n is a, c, g, or t
  misc_feature (335)..(335): n is a, c, g, or t
atttcctgtatcttctcaataatgcttagaaagccttttatgtaaagatgaaccacgaatatagaagattgaagaaatatagtaacaaatagagcaaataacctggacatagaagttcctcattggccaatggctctcttctcaactgttatcatcacgtaatcactacaattcgcaatctgcatntcacacactacactcgacacatgtgcactctcaagaggtntcctcacatgcgactcttggcgcttcttctggtgtttagactttcttacatatttaaagttatattctctactgagantctcttcgcaaaattgcaaatttgactcatnttttggtgcgtaa

SEQ ID NO: 526938 - DNA, 190 bp, Homo sapiens
ccaaggggacaatcacccgggtcaccacgtcgtctcccggtgggtcgagagtgttcacacatagacacgacaggtcatcagtggtgcgttcattgggcaagtacttgtgcattcacctcacccatagggatgtccctgtggtcataggatcccagaccattgccctggatactcgaccttacctgtctta

SEQ ID NO: 526939 - DNA, 205 bp, Homo sapiens
  misc_feature (33)..(33): n is a, c, g, or t
  misc_feature (159)..(159): n is a, c, g, or t
ggtgacagaagactccgtctaaaaaaaaaaaangttggaagatttcatttcagaggcaggattacttccagacagagtattaaagggagactttttagacgggttttggaggggggggggaaaggcttatttctggtctcttagacggaggaatttaantccggtcgtatggtgggggggaaatcagaacttttggagcagggcg

SEQ ID NO: 526940 - DNA, 804 bp, Homo sapiens
ggccgggcgcgtggctcacgcctgtaatcccagctctcagggaggctaagaggcgggaggatggttgagcccaggagttcgagacctgcctgggcaatatagcgagaccccgttctccagaaaaaggaagaaaaaaaaaccaaaaggacagacaaaaaattaggcggtaatttcccttaaagggaaaaacccctcttcccctcctttgtgggtatactttcacttaaacgaaatgggtcgggcgaaaaaaaaaaatgaaatagaacagagaagaccaaagcaccaacaatagaaaaaacaaatatgaaataaatcaaatacattaaaacaataaaatcatcgaaaaaaataagactatatacgcatcagaaagcaaaaacaaacatcggaacaacgtggtgggggggcgccccgacaaagaatatttaatcatccagaatattgcgaggggggcccgcgcgcaccgaatatcttggtaataatgccattctcatagttgccatagagaaaacacgagctgaaaacggggagcgggggtcataacgcgaaaaaaagaggggggggggcagcaggcgtgtgataataacacccctagacgagaggtgtgatgcgatcaagccgggagccctatcatcgagagagcacaagcggcgcacatataaaaaaaccgcgcggcggggcgcgagtagaacaccgacaacgcaggacatagagtcacagaaaccaagacggacacaaagaatcgacagagaggagaaggcaaaggctgagatccataacccagacaacagcgtgcaagtgcga

SEQ ID NO: 526941 - DNA, 209 bp, Homo sapiens
tctccaagtcgcaggagctgttgctcttcaggaagaaggatactagtatggtggtgtaccatttaatggccatggcacatatgtatgtgtctatcgtgctactcatgcgctcaactcctgtatctcaatattgatcacatgtcattccacggaaatggtggaggaagtgaatccagactccgctccaaccagataacagctataccttt

SEQ ID NO: 526942 - DNA, 549 bp, Homo sapiens
tactttccacaggtttactggccacggtccttggagtgtcaggctctgaatctctcaaaaggtgccgtcttgggttcctcatggctggttatctggtctataatgatttcatggataagacaaggtgggaattacataaccaggcatggcactaaaaagtgatgtgatttatgcatttatggcttgtgaactaaatagattttaagattcctacttaaacgaaaactttccatgacagtagcatacggatgagacaacacacacacacacaaaacaacagcaacaacaacagaacaacaacaaagcatgctcagtatggagacactgtcaagataaagttataccagcaaaagtgcagtagtgtcacttttttccggtcaatatatagagacttctaaatcataatcatccttttttaaaaaaaagattttcaaaaaagatggattggacacactcaccatttaatcatttccagcaaaatatatgttgggctgaaattatgtcaaagggttgtcatatagggtatgtaggcggctatagatggctatg

SEQ ID NO: 526943 - DNA, 266 bp, Homo sapiens
gctcgacaaaatttaacacccatagtaggcctatatgcagccaccaattaagaaagcgttcaagctcaacacccactacctaaaaattcccaaccttttatctgacttcttcacacccatttggaccattctatcaccctttagaggacctattgttagtataggtaccatgaaaccatcttcttcggcttaaccctggttcaatttaaacccctgactgaccatttaccagcccattatctacattcacccaccaaaaaaaaaaa

SEQ ID NO: 526944 - DNA, 701 bp, Homo sapiens
  misc_feature (195)..(195): n is a, c, g, or t
  misc_feature (200)..(200): n is a, c, g, or t
  misc_feature (204)..(204): n is a, c, g, or t
  misc_feature (210)..(210): n is a, c, g, or t
  misc_feature (220)..(220): n is a, c, g, or t
  misc_feature (225)..(225): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (245)..(245): n is a, c, g, or t
  misc_feature (247)..(247): n is a, c, g, or t
  misc_feature (249)..(250): n is a, c, g, or t
  misc_feature (258)..(259): n is a, c, g, or t
aagaagagaggcccaagatggagcggcggcggctgtagcggcgtgacaggagccccatggcacctgcccagccctcacctcagcccatcttgacaaaatctaaggctccatggagccaccacggggcccccctgccaatggggccgagccatcccgggcagtgggcaccgtcaaagtatacctgcccaacgagcnacgcncggntggtgnctgtccgggntggcntgngtgtctncgnctctctngncnnggccctgnnggtgcggggctctgaaagtcacggtactgctgtgtggtctacgcgaacgtctatcaaggcgaacgcaagagacggtcactgcctgggtactacaggccaatagcttcccctggatggacgatggagctgcactatgtcgatggatcctatgaaagatgtcccgtctgacgcatggcagcaatctctcagtagcggacagaccttgttcttgcagctctgtgccgttgctgtgacgtgtcatgcctataaaagattatctcgttctcatggctttccggttgcgcaatacctgtggcgtactagaggttccacacagctattgttcctcacaaggtccgccacaagtgctggtgttgacatgagtacgcaagcgacaactagttctaccagagtgtccgaggatttgtcctggaggctccaagaccagcatgaggctcgcttc

SEQ ID NO: 526945 - DNA, 443 bp, Homo sapiens
cttcaggaaacgagtacttctgcttttgaggggtgaaacccctttcacactgtctttgctcacgctacagcttgctacgtcatacatgcaaccagctagctctgtcgtcaccatcacaggcttggagagcttggctatttggaccccagtattttgtgttctactaaattgtattttgctagcttcaccctaccattctgactgtcgagatatatttagatcctaagcttgtctacgaagcactctcacggggtccttccagctccctgtcatcctcggatttaataactctgccacctgcgccccatccgagacatcagcagccacaaggaacagggagaaggtgctgatagagccctatggcacatctctagagacctccctctatgtttcttctacttgttaatcagctttcatttgttattcaaccaattacgaatgat

SEQ ID NO: 526946 - DNA, 851 bp, Homo sapiens
tccgaatcagaaagtgcccaggcttaatttacaatgccgacactgcagtgaaatgaacagcctccatctgggcctctcgggtacaaaaccatctttttggagtcagggcgcccagccccaggcctcccaggtcatcagtcctactgccccgaatccccgaaaagctagatgggagctggaagcagcgccatggtttgcgcaggtatcacaatggcaggcaggttctagcgtgacactgaatgtcaagaggacagtcaccaacaagcactagtctgggtacctcagagacctcgggatgagatttagggaacgccacaatcgctgggtgagtgtgtgttgcgcccacaaaaatagtaaagacattgcaggggcacatctgaggagacagagattgacacggcgatgtcaagtttacggtacaagaagggggtgtaaacaacgcataagatgtagtacaagggcgcatagaaaggaggctagaattgtagaagtggagaccctgaagaggggtatccacacattcaagatggatctccaagaagtagaatccatcacagtggccgtgaatagaaatcagagaaaaatgtccacctcaacgggtttacttggtccttgaattgtacccccaaaaaatattactgactccccaatcaacaaggggtgggactcgtgatatgaggtgttggtgttagcaccaagtgtgaaaatcgttgaaaattaagagaaagttgggcccaagggagaaaacattgaaaggtgtgtaaaggagataaataggtggggagacaatacaaatggtatgcccttcatggaaagtttagtcaaaaaaatagggcacaatcactgatagt

SEQ ID NO: 526947 - DNA, 713 bp, Homo sapiens
  misc_feature (195)..(195): n is a, c, g, or t
  misc_feature (200)..(200): n is a, c, g, or t
  misc_feature (204)..(204): n is a, c, g, or t
  misc_feature (210)..(210): n is a, c, g, or t
  misc_feature (220)..(220): n is a, c, g, or t
  misc_feature (225)..(225): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (245)..(245): n is a, c, g, or t
  misc_feature (247)..(247): n is a, c, g, or t
  misc_feature (249)..(250): n is a, c, g, or t
  misc_feature (258)..(259): n is a, c, g, or t
  misc_feature (271)..(272): n is a, c, g, or t
  misc_feature (277)..(277): n is a, c, g, or t
  misc_feature (295)..(295): n is a, c, g, or t
  misc_feature (303)..(303): n is a, c, g, or t
  misc_feature (314)..(314): n is a, c, g, or t
  misc_feature (316)..(316): n is a, c, g, or t
  misc_feature (334)..(334): n is a, c, g, or t
  misc_feature (336)..(336): n is a, c, g, or t
  misc_feature (342)..(342): n is a, c, g, or t
  misc_feature (347)..(347): n is a, c, g, or t
  misc_feature (361)..(361): n is a, c, g, or t
  misc_feature (385)..(386): n is a, c, g, or t
  misc_feature (388)..(388): n is a, c, g, or t
  misc_feature (399)..(399): n is a, c, g, or t
  misc_feature (402)..(402): n is a, c, g, or t
  misc_feature (409)..(409): n is a, c, g, or t
  misc_feature (423)..(423): n is a, c, g, or t
  misc_feature (432)..(432): n is a, c, g, or t
  misc_feature (448)..(448): n is a, c, g, or t
  misc_feature (469)..(469): n is a, c, g, or t
  misc_feature (489)..(489): n is a, c, g, or t
  misc_feature (499)..(499): n is a, c, g, or t
  misc_feature (502)..(502): n is a, c, g, or t
  misc_feature (508)..(508): n is a, c, g, or t
  misc_feature (534)..(534): n is a, c, g, or t
  misc_feature (547)..(547): n is a, c, g, or t
  misc_feature (549)..(549): n is a, c, g, or t
  misc_feature (558)..(558): n is a, c, g, or t
  misc_feature (565)..(566): n is a, c, g, or t
  misc_feature (577)..(577): n is a, c, g, or t
  misc_feature (579)..(579): n is a, c, g, or t
  misc_feature (586)..(586): n is a, c, g, or t
  misc_feature (589)..(589): n is a, c, g, or t
  misc_feature (605)..(605): n is a, c, g, or t
  misc_feature (609)..(609): n is a, c, g, or t
  misc_feature (615)..(615): n is a, c, g, or t
  misc_feature (627)..(627): n is a, c, g, or t
  misc_feature (651)..(652): n is a, c, g, or t
  misc_feature (704)..(704): n is a, c, g, or t
aagaagagaggcccaagatggagcggcggcggctgtagcggcgtgacaggagccccatggcacctgcccagccctcacctcagcccatcttgacaaaatctaaggctccatggagccaccacggggcccccctgccaatggggccgagccatcccgggcagtgggcaccgtcaaagtatacctgcccaacgagcnacgcncggntggtgnctgtccgggntggcntgngtgtctncgnctctctngncnnggccctgnnggtgcggggtcnncctcnggcctgctgtgtggtctnccgcctcntcccgggccgncngccggtccctgcctgggncnccgccnttgcncccctggctggcgnggcgctccttgtcgcggtccttgnngntgtcccgctgnccntgccccnttttgtccggccgnccttcttcngcctggcgttctgtgncttctgccttccgtttctgtnccctggcttccgttgccccncctgtggctnccngttccncccgccttgttcctccccggtccccnccgtctgtgttgncntgcgtcccncccgccnnccgttctcccncngtgtccnggntttgtccggcgctccngacngcctgnggctccctcganccgccccctgaatgagttgctagnnccccagggtcccagcccccgcacccagcactgtgacccggagcacttccccntccctgccc

SEQ ID NO: 526948 - DNA, 213 bp, Homo sapiens
  misc_feature (100)..(100): n is a, c, g, or t
  misc_feature (126)..(126): n is a, c, g, or t
gaactttcttcgtgtccttgagcagtgcccatttccctcagtattgactgtctggattttgaccttctgtatcctgccatcaagggtgacaccattcagntctacctgggggccaagttgttggantcacagggaaaggtgaccaagtggttcaattaactctgcagcttacctaacaatgcccaccctggacaacatcccgttcagcctcat

SEQ ID NO: 526949 - DNA, 288 bp, Homo sapiens
tactgacagcgcacgatggcgcgtcatctctctgggacccactgaaaatcggacgttcaactcacctggcagcactcccagagcccctggaactctggcccaaggctctctgagtgactccttcccagatcttctcggcttagcggctgaagactgacactgcccgatcgcctcggaagccccctagaccatcacagacgccgagcttccggtaactctcacagtgcaagatttaccggaacattccaggatttttacgtacacttattgacgcgccatcgtgcgctt

SEQ ID NO: 526950 - DNA, 462 bp, Homo sapiens
  misc_feature (135)..(135): n is a, c, g, or t
  misc_feature (328)..(328): n is a, c, g, or t
  misc_feature (354)..(354): n is a, c, g, or t
tccatggggagggggctcacagggcaccaagtttgggatcctaggactggcaggacctgctggagccttaaatgggccccaggggcctgaggttgcctcctcctgtccaaaaccagccttggcacctcccaaaantgccaagggccctaccatggccccacagcccccaggggtggcagttccatttaggagggtgcctttaggccccactttcaggctaggatggaaaggcagatttgggcctggcgaggtgacctgcttttggaggggcagggccgcaccccaaaacagggacaggtgcccgaacacagggtttccaggacgtagngcccccccgcaaacttgaatgtatgngggtatttattgctcacgtttgtgccatgttgtcaatgggtcctttccaacccaaaagggacatttgtttttttgtttttcctgaaaaataaagtcggccaagtgaga

SEQ ID NO: 526951 - DNA, 237 bp, Homo sapiens
  misc_feature (162)..(162): n is a, c, g, or t
  misc_feature (176)..(176): n is a, c, g, or t
atttactcagaaagacaggtttatcccatttgagtaaatgattcaatgatgtatcaaggatgaagacggtggttgaagaccagaggtcttcacatcgttttgatgattactgatgtcttgattcggtggtacacccaacgacgaggtaataacgtggtgatncgtccacgatgtgncttggacgatcgaccggatacggcgacggggggatccctctagacgtcgaccctgcacggc

SEQ ID NO: 526952 - DNA, 119 bp, Homo sapiens
cgggcatggtggtgatctggttactctgggagtgtagatactcactgaggctcgcgtagtgcgactgccgcggaacagctgtcgtttcatctagctccgactgatgcgtgagggtgtag

SEQ ID NO: 526953 - DNA, 251 bp, Homo sapiens
tacgaagtgggctagggcattttgaatcttagagcgaaagcgtataatcactgcgccgttcataaggggatggccatggttggtttatagatagtggggtggttggtgtaaatgagtgaggcaggagtccgaggaggttagttgtggcaataaaaatgattaaggatactagtataaagcaatccaggtcgtccttttactgttggtgtatggtgtaccattggtcttcgcaggttcagctttgcattcag

SEQ ID NO: 526954 - DNA, 487 bp, Homo sapiens
ctggcttcggaccggcttgtctacgtcacatttttgtttcttgttcggacggctgcggctgattgcttaatggaaaggcaacacgggcagagatctgtgaactgttaaaggattcccgtttttttgaaccagatgtcaccagaactcaggtaaatacagtagtgagtggtgcactgattcgcttacttacgaaaaaagatccctttgtgaaatacggcattggacgaaagctgtggatcttcctgcatcgtgaccggagtgaagaagagtttgggcggattcaccaagcacaagccgctgcagttaagccaggaaagcttttcagcaaaaacccaagcccccattcaaggtgaagttcagttgcaaggggggctccataaaggtcctttgcagtggcccttttgagcagagccagatgagccttagtgaattcagtatgccacccaccccagtcacacctgtaacccccaccacaccagcattgccc

SEQ ID NO: 526955 - DNA, 906 bp, Homo sapiens
  misc_feature (212)..(212): n is a, c, g, or t
gggacctccttgcgagttccgagttgcgatgctgtacttctctttgttttggtgcgagctcggcctctgcatgagatgtgggcagctggtcaggatggccattgcggtgctcagcacaggcaacgcatgcccagactcatgactgagggaacgcaaacacgcgggctcggagcatggccatggatgagccttgtcagtgactagtgatcctngaagattgttggcgatgtttgctgctcgaagcggagaacgtgacattgcaggtgctcgtggccgtggacgctcaattggcttcatagatgaacttcgtgcatgccgagctgcgcatggaggccctgggcgtcctgtctgaagcaacaatgtactcggagggtgatccgtggcaatgagagtgctaatgggggggaagcaagaaggattggttgcgatgagggctgtgaagtcatagctggtgttgcaggaagcgctggatgcataggggaagacgcgaatgtttgagaacgtgtgggatgcgctgggaacattgttgagcgtaagatcgtactagttccctacgatgacctaaagtaccgtggttgtactgagagtgccagaacacgtggggtccggattcagtactgcagagacgtcatgtcgtggcggaatcatctagtggaagccggccacatccagttgtgacgcaatgcgtaggcacctagaaagcatcgaaagattgcagagagtcgtgcgcaggcggttaaccgaggcacagtgggttgtaaccaattggtactcggaaaagcgatttcgaaattgcgggagatcattacattggacccaacgagttacaaattcttttcactaatgcggtaaggttcttaattggcccgcgttagtaaaagggctccaacaagcgcgcgccaaata

SEQ ID NO: 526956 - DNA, 539 bp, Homo sapiens
  misc_feature (354)..(354): n is a, c, g, or t
  misc_feature (388)..(389): n is a, c, g, or t
  misc_feature (416)..(416): n is a, c, g, or t
  misc_feature (470)..(470): n is a, c, g, or t
  misc_feature (512)..(512): n is a, c, g, or t
  misc_feature (516)..(516): n is a, c, g, or t
  misc_feature (518)..(518): n is a, c, g, or t
  misc_feature (526)..(526): n is a, c, g, or t
ggattgcggcgctactctcaatactcttaactaccagcgccaattctgaatgctggattgtcacaaacctgcacgggtacggggcaatgaatggcgatcgttacgagtttacaaaagacagcacggaagattccgttttcaacgtaacaataaatggcgataaatcatcagtttatgaatcagtttctggcgtctatccagagatgaaatacactgctttgtcatcgaacactatggtaggagaataccagtctggaggaggcataaccgttgaaacttggtcaatcactacagacaaaaaagctctttactccaaagtaatgaacatcccaggtatgcaacaacttacatcanccaaatcctttgttggtgatgtagtcggaacctnnaatcagtaatccccacctcaatctcgntaacaaaaaaacaaactattttccgtttaaaacaatggagtttgtttttcacgnccctttttcaatattattgttcaacatcaacttcttgaattnagcntngaggcggnctgccacattgag

SEQ ID NO: 526957 - DNA, 973 bp, Homo sapiens
aactatggctaggtcgaggctggtggtgaatcggccgaggctcgccgccatgaagcagcgccgcgtaccgacttcttcgcgcgccgccgccccgggactccccgatcgcgccgccagctggcctgccgcacccccagccccgccaggcctgatccgcgcccggctccgtaccagtggcagcgaggcgcacacgcaggccacgacagccccagggacgcgaacaggacaggcacaccgccactagaaggagacctgcagagctgtacaggtggaacaaggttatccagaacacagttaccacatagatgacacacaagaacattcgagaagacaatgcacacatacatccaagagcaagtaatactaaacgaacaatacaacaaactaggataagacagctaccagagcagaacactagacataagaacaattcagacaacaagaaatccaagagaacaacaattcatctaaaaacataagacgttcaattgccatgaaacacgagcacacgagtaatatatgcaagacaaaagagtcagagagacacatgagaggactaagtgccacaggcattgaagcaagaacatcaatgaacccaaaaaacgcaagaagacgacagaacttgaagataaccccatgatagcagaaaaaaagagcagccagaactaaacaaaagtcaaccaaaatgcacaaggaacacaacaaccgagaactgacgagagtgaaacacgatacagtgacccataacaagataacaagatgactgacacacgaacatatttcacacagcaataatacacccaatgaatgaagaaaatactcacaaaacccacaaccagagaaacaccaacctatagaccaaaacaacaacagtagacaaccaaaaaaataaaacaaaacaataacaaaaacaccaagaaacccaaataaaacagaaatcagaaaaaaccaaaaaacaaaagaaaaccccaaa

SEQ ID NO: 526958 - DNA, 326 bp, Homo sapiens
tggaccgttactagacaagtgggcgtagtgctgccaacctgtggaactaggataggctcccatgccctgaaacggggctctcatgctgtatcagcgcgtcgtgcgtccgagtgtacctcaggcaccacggtaccgtagacagaatcatgaacgaactcaacgggcgagccctggacgcggtggccggatctaaccaggaacgtcctgccaagactagaccccgcagccgaaggacaagtgaagcaggcccctgagcctcacaaggacctcctggctggtgaggagggggccgcgccagtgctcccaggcctccacagccagttcag

SEQ ID NO: 526959 - DNA, 741 bp, Homo sapiens
ggtgactcgcgtttttcggacggaagccattggagcaattttagcggtttgacatccgactgcccgggacacccagtaagcagtgaacagcactatcacactagaatcgacatggaccgcaaatacattggcaactgtctcgacgactacagttgccaccgctatcacgggctaaccccctactgcgtaccacgcgcctatcgacatcaggtcggttatacgccgatcagcggactaaacacattcgcccgctcaattcacgtaggcttgtcacgggcccaatctccgcgttcggccatcgacaggcgcccaacttagcgcaattctccgaaatcctacttctatcagtttgaggattcgtcggcgtgctccggccgattacgcatgtatccaagagagcgcgctttgccgtagtaggccatttagcaaacggcctcttactggtggcctgatgcatgggggcttcatcaagctagattttactaacaggaggctggaaagccgctcattcctgtacaaacaagcgcttatctcgcgacgttgcctaattattaagacgtcactttatcccaacctcggtgaatagcgcgaccaggtatatgtcgaaccaatcccaatgcctcctagtgtaagctcgtcgttttcgacaggcgctcctttgtatcaagcgcgatactaacaacttctgctgattttcggtggtactcgttcctgtctcctagattcatctggccctctccg

SEQ ID NO: 526960 - DNA, 778 bp, Homo sapiens
gccggtagccgtagccaccgtcgccagcccgtgcgccctacggcgcgtacccgccggcgtctcccataccccgccgccggccaggtgcgcgctacggtcgcccggacagtgtaccgctgcggctaccgggcgatggccaccaagatacgacaaagaggctagccgggcggcgtacaacctggtgcgcgacgacggctcggccgtacatactgggtagcactattgaacatatagcacggtccaccatacgtccccggcgagcagggagcggagtaccagcattcataccagcagtgcacagatagacgtaccggttgtatgccttatcggccgctaacacccacggggaatgccatgagccaaggagggtccaatgttggccctcatacacgtgcatacggttgaaaccggtcaggcgggtttgcaagtcgcgcaaaaaccggggacgggcacaagacccctggtgacaggcaggtcgtacacgaattgcgcatacggcagtgtgtgactcagtgcatcggcacaggagctgggcaggaagattcatcacagagcgagctgaacacggcgggggggacgccaattaacgacgctcagaccggagaaacgcccaggccccgtaaaacaaccctttgccaaagtaattgcctgctctccgggggaacaagacagtcgggtctttaagttaaagctccacaggtcacccgggcgaaaagacacctgaaaggccggcccgtacactgtgggtaacgcccccacagtaccgatcttaaacctg

SEQ ID NO: 526961 - DNA, 269 bp, Homo sapiens
attaccggtcggtcgctatatactcagagtacactgattttctcatcaaacgagttacccaccgtatatcgatatgttcgtaagcacgcatattcttcataccatcaccttgtgtatatgtaaacgattagtatttaattctcactgttcactttgaactgacaaagaaaaacaagtggaaactacagaaactgtggtagaacatttaacttgctaggtctggtcttggttgtacccatctttggccagtcacataactactctggaaa

SEQ ID NO: 526962 - DNA, 376 bp, Homo sapiens
accttcttcatacacgagcatgcaagttctttccttccctgccagccgagatagatacacagatggtaaagacaggcgcggctttcgttgtcagtagtactttgatgtgaagcggtcagcacggtcatttaagcttgatccaccctctttgcatcttacaaagttaaacggctcaaagaagtaaaataagaagccactgcttgtggaacctgttcactcgtttctttgaaagccagtggatttttctcaagcgtctctgtcttcttcagtttcgacttatcgaatctctcgatcacagccatctcgggtttgtcacacatggctgcggaggaaaagcgaagcgaggcgcgcgagtaagagcgaagtgtggtgtgcg

SEQ ID NO: 526963 - DNA, 415 bp, Homo sapiens
  misc_feature (39)..(39): n is a, c, g, or t
agaaacattttgtaatgatgtaagaaaaaaaagacacanaattgatttttaaaaaaacatgcatatggataatgcctggaagataaatgggaaaaagtgaaaataatcagtgtgttgaagtatttggcttaaaggcaaactttaaaaattttttatgttattactgttacaaaaagaaggaaagaggatattatacagcaaaagactaagaaagaaagtggcaaactaatgaccaaaactaaaagccagttatttaattcttccatcaaaaatagccaggtatagcccaggcgcagtggctcatgcctctaatcccagcactttgccacgctgaggtgggaggatctcttgagctcaggagttcaagaccagcctggccaacatagcgacctcacctcgtgtctaccaaaaaaaa

SEQ ID NO: 526964 - DNA, 536 bp, Homo sapiens
cggccccaagcaggaaggcgcccccagcacaccagcccctctcagcgcccccagcgggcccgggcctggagggttaaggcgggcgcgtccgcgggtgggcggggggggggtgggaccggtgccgggagctccgctgccctggcgtcccctgggtccaggcccagtcgctccttgggcctctctcgcggggccgcctccgcctccttccttgccgagacgggcgtggggcacggggtcgccgcccggcggggagctcatccggcggcgcagacgccccgcggctccggggagggacttggcctgggccccggccccgggctcctctggggaggagccgagaggctgcagctggcggcggcggccccgggcgggagggggtcccaggaagcggccaggccggagccccacactcggccgcagctgctggcctggccagaaccgagcgcgccctcccggtctccgccgcttccctctgcaaaccgcgggcaggaggagccctctccttagcgggcccggagctcagaggcgtcgcgggg

SEQ ID NO: 526965 - DNA, 123 bp, Homo sapiens
ttcagctcggctccccttcgatgtgagagatagaggagaggagaggattaggaggaggagggagaagggaacaaccgtaccaatcttaacactactaaatatctaaaaaatgtgcgagtagtg

SEQ ID NO: 526966 - DNA, 379 bp, Homo sapiens
gatcactgaggctggcagttcgagaccagcgtgacaacacggagacaccccctctctacaaacaaaattagccatgggtggtggtgcacacctgtagtcctagctactcaggaggctgaggcaggcggattgcttcagcccaggaggtcaaggattcagcaaactatgatagtgccactgcgctccagcctaggtggcagagggagatcctgactcaaacaaaaattatatcatgggctagtgtgtcaagcatagaaaacatcatttcatcctgaagaaatactacctatggggagcaagaaaaatacaaaatatatttcataagcccatgattttcatggcctgtatgaatgaccctgtactggcataatctacacga

SEQ ID NO: 526967 - DNA, 1626 bp, Homo sapiens
ccaggtcccggtggtggcccacatccccctcatactccctcccaccacaggcacccgaatcactcgaagacgcagcccaaaccacagcgaccgtgcaggccacgcgcaggccgctctcacagacaaacacactgataagataacgagcagagagaaagccgggaggagcaagcaggaggatagcatgacagacatggacattcctggccagcaaacacaatcccaaggagggccccaggagagacaagactagacctatccagcagaataggcagaggcggtagaacaagacactaaaaggcacaacagaaagtaacagatgggcgagaggtggagacgcaagaagatacacagtcaaaatacaaagccacatagactccgtcaaatagcacaccacgtcactagagacccacgcaagaaagaaaaaccaaggacaaaccggaggaagagtcaaggaaccccgacatgacacaagagacaacagaggagccagccaggagagacagagtgggcgccagacaaaccaagggacctaggacgcacggccacgatgcgacatacaccgaccagaaggataactacacaccaagacaaacctcatcgggggcaaaagacacacgacgagcataggggacacgagcactcaaccccgtggacggcatccgaacacaaggaacaccacagcacccgacggccacaggaagcaccaaacaccaatagagcaacgaaaaaacacagcacccacaacagcaacacacgcgccacgaccacaagtcaccacgaaaactaaagagaccaacaaggcagatggagatgcgacacaaacttgccacgcgacaacacacaacacaagagacaaacctacaccgcgcacaaagcccagaagcgcaaacgcaaaaaacacacgaccaggaggcaaaaaacaccgacgagagaggaagcagagcacacagaataagaagagagcctgcacgaaccaggaaacaaaccggccaaccacacgtaggggcacatacacaaagacccacgagacgacaaaatgcacaaacagcaccgaacagagccatgaccacatcacaaacacaaaacaacaccaacaccaaggcaaatctaacaaaccacaaacagacaaaagaagacaacacagggagacaacgaacacaacaacacaacacgagcaacccacgcgacacgccagacggaaaacacacagaagaaacaaacacacacacaagaagacaagagacacacaacaacaaccaccgagacatcacaacatcggaacagcagccacaaagcagaagaaagcaaaaacaagagaccaacacacacatcacaaacatagaagacgcgcacgacaaccacacaacacgacgcaacaccaacaaaagcgacgaccaacaaccacacacaacacaacaccaagcatacacaacaaccacgagacaccaacaaaaaacaagagacaacaacacacacacaagcaacacgcagcgacaaacaacgaccgaccacagacaaacaagacacaaacagaaaagagaaaacagaccacgaatgacggcgaaaacaaagaggagcaaccacacagaaacagaaacacggcgaactagaacaacgcacaag

SEQ ID NO: 526968 - DNA, 483 bp, Homo sapiens
tcactgtttcgtggcctccttctggacccccttcttccagacagaaatcactctgtgctgatctggtggtggtccatgatagcgccattacattgcattatcaaggctgaaaacattttcatttaggaaatatttcaaaccttcagaagagtacaataaataatatgacacccggtgtatgtacccttatagaagttaatagatgttagcattttgtctacgctttgcttcagatctctcttttacagaatggtaatatagatgttacagatacactgaggcggaaactgtttattacgaatgtagcttatctctggttccgatgatgaattctggtgccaggctctatgtgggatactaaggatatgagtgatgttctctggcttctgtgagctcatcctccagccgggaaggcagactcatgaacggacgattgtcctacaatgtgacaactgctgtactggtgaaatatactagagcaat

SEQ ID NO: 526969 - DNA, 961 bp, Homo sapiens
tgcagcgggggggccgggggccctggttggccctgggatggggaaaccgcggtggcttccgcggaggtttcggcagtggcatccggtggccggggtcgcggccgtggacgggtccgggccgaggcggtgtagctcgcgtagggaggccgggataggagtggatgcccgtcaacaatttgggcgattgtacgaggacatgaagtatcaagtccctggaggagatctatctcttctccctgccataaggaatcagagatcattgatttcttcctgggggcctctctcaagggatgcaggttgagaagattattgccagttgcagaaggaagaactgtgccggcaagcgcaccaggtacaacggcaattgttagcatatcgggaactacaaaatggccacggtcgggcactggggtgtaagggtgcctaccaaaggattgtggccacgcgcccaataccgttgggggccatcattccttggccaaagcctctccaatcgtcccccgtggcgcaagaaggtcatacttggggggaaaccaaagatcggggcgaagccccaaactgtccctttggaaaaggaatgaacaaggcccgctgccggaatcctgagtagaataaacgccttaaatccctgcacccaggggcattggtgatagatcttcggaaaccttgtggcctaaaagaagctgctccatgatggggtggaatcgaatgagtggtacactcaagcacggcgctgcacttgccccctgaggcaaactacgcaaaggccaccttgatgcattcaaaaacctaaagtaacgaaccccgactcttgaacgagaatgtatcacaagttccctataggagtatgacactcttagacccaccaatttcgtgacgaaccaagacgcgtggtaaccaacgctttaccaacaaaagggtaggggaaaaaaaaaaaggggtcaaaaaagaggcataaacc

SEQ ID NO: 526970 - DNA, 765 bp, Homo sapiens
gaagcctcctaaggaatctgctttacggagctcctggagcaggaaagaccctgatgctcgagctgtagaacaaatgacactggagccttcttcttcttgatcaatggtcctgagatcatgagcaaatggctggtgagtctgagagcaatcctgtcgtaaggccttggaggaggctgagaagaatgcttccttgtccgatcatcattcattgattgagctagatgccattctgctctccatacaattgagagaaagactcatggcgacggtgagaagcggagcatatgtatcacgagttgttgacgcctctatggatggtctaagatgcagtagggcgacatgtgagttgttatggcagcaaccaacagatccaacagcattgacccagtgtctacggcgatttggtcgctttgacagggaggtagatcttggagaattccatgatgctacaggacgcgttagagattctttcagatccataccaagaacatgaagctgggagatgatgtggatctggaacaggtaggcaattgagactcacaggcatgtgggtgctgacttaagcgagacctgtgctcagaggctgttctgtaagaccatccgtaagaagatggatctcattgacctagaggatgatgagcattgatgccgaggtcatgaagtctctagcagttactatggatgacttccggtgggccttgagccagagttacccatcagactgcgggaaaccgcggtaaaggtgcacaggtagccggggaagaa

SEQ ID NO: 526971 - DNA, 188 bp, Homo sapiens
  misc_feature (4)..(4): n is a, c, g, or t
  misc_feature (91)..(91): n is a, c, g, or t
aagntgatgaggaggatcgctgagctacaggaattgaaggtgtagtgagacatgatcatccatgcatcaagcctaggcaacagagcgaaancccgtctataaagatggcaacgccaggtgtggtggtgctgcctgtaatctcagctactcaggaggctgaggaaggagaattttctgaacctgcaagg

SEQ ID NO: 526972 - DNA, 114 bp, Homo sapiens
gcggccgcctactactactaaattcgcggccggtcgacccgggagcccccagccgaggacgtgggatgtcatcgtccttgctgctttgccaccccattcccgtcaataaagtgg

SEQ ID NO: 526973 - DNA, 792 bp, Homo sapiens
  misc_feature (171)..(172): n is a, c, g, or t
  misc_feature (178)..(178): n is a, c, g, or t
  misc_feature (196)..(196): n is a, c, g, or t
  misc_feature (209)..(209): n is a, c, g, or t
agagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgnncagctnccaccacacaatcaaagnggaaaggccactnctctaggtgccccaagcaatacaagcattactgcatcaaagggagatgccgcttcgtggtggccgagcagacgccctcctgtgtctgtgatgaaggctacattggagcaaggtgtgagagagttgacttgttttacctaagaggagacagaggacagattctggtgatttgtttgatagcagttatggtagtttttattattttggtcatcggtgtctgcacatgctgtcagtaagtatttttaaacttaattttaagtaaatctgagaaacagtatttgctcatagtttttcttcttttcttcctccttacattctcttttgctttttctttgattcaaataaatctactttttgagctttgccattgttgatatagaagtattcataataaaacacataatacatgatttttatcatttactgaataaaattgttgtaatttaaaataaaatttgtatagtaggctacataagacttctattttctaaaactgtaccataacacagtaacattgaaagataaaaacaaaaatttgtttttgctttgccacattaaaataataaactttatgtgtaaaccaa

SEQ ID NO: 526974 - DNA, 689 bp, Homo sapiens
  misc_feature (171)..(172): n is a, c, g, or t
  misc_feature (178)..(178): n is a, c, g, or t
  misc_feature (196)..(196): n is a, c, g, or t
  misc_feature (209)..(209): n is a, c, g, or t
agagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgnncagctnccaccacacaatcaaagnggaaaggccactnctctaggtgccccaagcaatacaagcattactgcatcaaagggagatgccgcttcgtggtggccgagcagacgccctcctgtgtccctctccggaaacgtcgtaaaagaaagaagaaagaagaagaaatggaaactctgggtaaagatatgactcctatcaatgaagatattgaagagacaaatattgcttataaggctatgaagttacctccaggttggtggcaagctgcaaagtgccttgctcatttgaaaatggacagaatgcgtctcaggaaaacagctagtagacatgaattttaaataatgtatttactttttatttgcaacttcagtttgtgttattattttttaataagaacattaattatatgtatattgtctagtaattgggaaaaaagcaactggttaggtagcaacaacagaagggaaatttcaataacctttcacttaagtattgtcaccaggattactagtcaaac

SEQ ID NO: 526975 - DNA, 460 bp, Homo sapiens
gtcatcgcttaagtctaggagttgaggcagccgggaaaatatgcaagacctcatctctacaaaataataacagagaaaattactttaaaaaatgcatcagaggctgggccggtggctcacgcctgtaatcccagcattttgggaggccgaggtgggaggatcatttgaggtcaggagtttgagaccagcctgagcaacatggtgaaagcccatctctactaaaaatacaaaaaaattagccaggcgtggtggcctgcacctgtaatcccagctccttgggaggctgaggcaggagaatcacttgaaccccggaagcagagtttgcagtgagtccagatcacgctactgccctccagcctgggtgacagagcgagactccatctcaaaaaaagaaacaaaacgcatcaggctgggcatgggtggctcacgcctgtaattctaggaatcggggaggcagaga

SEQ ID NO: 526976 - DNA, 545 bp, Homo sapiens
tcacgccaaatcaacacctgtacgttcttttctctatatctttgaaatattcttttcggaacaccaaattttgcctttgatcaatcctcacgacgctccgcggtattaccccctaaatctaattcttaattaataatgttctttaaattgtttgcaaacttctcatcaccgtggtgtagatggtaggctcacacatttatcaagaaaggcggtagttagtctgaataatatgtattcgctcaactttaaaacatccttaatatgaatgctctctcatcttaccacccatagtttttcccccagtgtctgttcaacgcagtctctttttgcagacatgtatttctcttagttctaataacaatgatcacctaagagttcttttatgattaaccaacaccatggatctttattgtagcttttcttctttcaccatttattcggctttatcaaacatattattttcacaacattactgtttactgacaacttgttaacgatcatcctttcttataaaaaaagtttttttaaccaaccatcatatacaa

SEQ ID NO: 526977 - DNA, 92 bp, Homo sapiens
  misc_feature (23)..(23): n is a, c, g, or t
  misc_feature (88)..(88): n is a, c, g, or t
gcggcggcggcggcgacagaacnagcgcggcgcggggccaccatgggggcccagctcagcacgttgggccatatggtgctcttcccantctg

SEQ ID NO: 526978 - DNA, 200 bp, Homo sapiens
tgacgcgtaacctttgagaaggtctcgcttctgtctcatgggtggagtgatggacgatcttggctcacattcaacctctgcatcctgggctcaaaaaattctcctgcctcagcctcccaagtagctgggactacaggcatgcaccaccctgcctggctaatttttgtattttttgtagagacaggatgtgtccccaaggt

SEQ ID NO: 526979 - DNA, 561 bp, Homo sapiens
gcatcctggcgcaagtattatgcttattagactactgaaggttaactattgacagtcattctaaaaatatcttaagctgtattacatgtgctatatattctccttgtgtaaggaaaaaagtaatagatcgctgtccttagcgcgttggatagtgaaaaaaaatacctccatattacctaatggtctgccgattggtcccctgaattatgaaactccaacaaaacattattttggcaaaaagtcctttagcccaaagtcaggtgtctctgtatgggtctcttggtaaaagaactctctgttcatccattctctttccctgggaccgtaaaataatggctgaaaaagtcttcatctggtactgtcggaccctttgtggtagcaggtggtggagcacatctttgatcatctaatctggatccttgacattttacaaggatgtcaaagaaatcttcatcagcctctttgttgtcattagtcatcaggtggctaagtaccgactggctgttttgtgttagacgaagccctggcaaattactgaaactagccctctggtcatccaga

SEQ ID NO: 526980 - DNA, 420 bp, Homo sapiens
  misc_feature (371)..(371): n is a, c, g, or t
  misc_feature (373)..(373): n is a, c, g, or t
atgtaaaagagcaagcttttaggtatccatttttaatgcaatataatgttgtaaacatccctattgcaatgacagcttgtctttctccccaattttatcctgcactattaggtattaagaatatttaatgtggccgggcatgaaaggctcctgcctgtaatcccagcactttgggaggccgaggtgggtggaacacttgaggtcaggagttcgagaccagcttgggcaacatggtgaaaccgcatctccactcaaaatacaaaaattagctgggtgtggtgatgcatgcctctaatcccagctactcggaaggctaaggctggaaaatcatttgaacccaggaggtggaggttgcagtgagtcgagatcantnactgcacttcagcctgggtaacagagccaaacactagctaaaaaaaa

SEQ ID NO: 526981 - DNA, 117 bp, Homo sapiens
tagagggtcagtataagaaacaatgatcactggatcaagagatactctgatagttggagtagggccaaaacaaagttggtgagctaaaaggcttgtaagtgatgtggatgttcctac

SEQ ID NO: 526982 - DNA, 135 bp, Homo sapiens
gtagggtgctggtcacgacatctctccaggacgcttccccgaggccctggacgagctgcgctgccccccattcctgcagccgttggacctcactggcaaaggctaggcccggaggcacctatgcgctggattttg

SEQ ID NO: 526983 - DNA, 383 bp, Homo sapiens
tgggttctatactgacaggcaatcgtaggctcctactatgatagcacacggttacttcagcgtctatagcatgtgtgatggacacactgttcctctgacttctaggaggacctggagaggaatgacagctacggccgagaggccttacttcatgtcttccaccctcaagaaactcttgaacaagaccaacaagaaggcagcggagtcctgaaggccccgtgctccccagctctcacggagtctcatgccgcagggtgctcagtagctgggtctgttcccccagccccttgggctcacctgaagtcctatcactgccgctctgcccctccccatgagccagatcccaccagtttctggacgtggagagtctggggcatctcctt

SEQ ID NO: 526984 - DNA, 895 bp, Homo sapiens
ttgtgtcacgccccacagtggatatccgccccgttcctcccggttaaatgaggctctcgcggatctccgcggggggtccctcccaaacgagaagggtccccaccacaagggggtgtcgccccccagaaggggctgctgcccccccccaagcggtcctctcccgcgcctacgggcccccccaccgcccaggaccttcgccccgccggagcgttctccccccgctccagcgtggccccccccaagcaaggggttggcaacaccccccgacaggaagggctcccatccccaacccaggggccaaaaatcgtccacagtcccaaaaggcacaccctggtgtaacagagacggtacttttccaccctcgaggagcatttcttgaaggacttttcgagtaacacgcggactaggtggttgaaaaaactgatagctgtgccccccccccgcgcttgattgcacgccacgttcctgcccccgtccccacgagggattcaaggcaaccacattacgtgggccttctcaatagtgatgtgaatagggatggacgcgtcgtgtccactctggcggaaagaagtcatccttcgttcactaggtacagacctattggcggtcactccccccccctcctcatgggtgaataccaccccgcccaaggaggtcccatggggtaaacgccaatcaccctggattgggaccaacattcacagagaggcaccatgagtgccggcggagctgtcgcaccgcacaaatggcagcaagatgagttacaagaaggaaacccaatcagagaaggcaggagtacaaaacagcaggagtggcataaagcactccccggaacacggcccccccggaaggcccaacgagggtccggcccccccgacccctcccgaccccatac

SEQ ID NO: 526985 - DNA, 622 bp, Homo sapiens
aaaaaaccctgtaagtgatcttttgaacattttcatgtctcaatttctttcaattcagctctgattttagttaattcttgtcttctataagctttgtggtagagttctccttgcttctctaattctttcagttatgatgttaggttgttaatttgggatatttctaattttttgatatgggcattacttcttatgccctactctaaattttgttcttctagaaaactcagaactatgctttctaaaccaattcaaactttctcagtgaatcaacctggactccctgaggccaagttaacaattttccattacaattggttctctttctctgtaagaatatctaatgcaacaattcaagtgtttctttccctcctggtaatgcggggaactccttttggctgagaccaagacttaaaaccttgttctttcaacattattgaagatctatttagaaagcctccatttttgcacaaaagatatataaaccccaatgaaaatcattattaaattatttgacatacaattatattgtggaaagactgattaatagtgaataagccctaaaaaaaagatatgattaaatggattaaattaaactggctgtttgatattaagttcataa

SEQ ID NO: 526986 - DNA, 218 bp, Homo sapiens
gccttctacagagtgcgagagagagaaaactcgtgaaagctgaaaatcatgaagatagggttaaaaaaataatagaactgaaaaggaaagtctgtggctgcattcagctaaagtgattgtgtttgttattacatcaacaagggaattgacccgcttttccttatgatgctctttcaaaagcaaggcatagtcgcgtctgctgcagacgctaaaaggag

SEQ ID NO: 526987 - DNA, 225 bp, Homo sapiens
  misc_feature (121)..(121): n is a, c, g, or t
  misc_feature (200)..(200): n is a, c, g, or t
aagaccagcctgggcaatgtaggaagacttcatgtctacaaaaaaaaaaaaaaaaaatttcattagccaggcatggtgatgcatgcctatagttccagctacttgagaggctgaggtgggngaaccccctgagcctgggaggtcgaggctacaagaagctgtgttcgtgcaactgtactccagcctgggcaacagagcangaccctgtctcaaaaatttatatag

SEQ ID NO: 526988 - DNA, 287 bp, Homo sapiens
tgtctatgataaacagatgttttggctctgacagcagaacttcgctttgattgttctcatgcgtttactttggtgggttcaggaatgggaagtcaagccacacttcattatttctattaagcaatttgacaggactgtggtagcctgcagtgtagtaaaccttctcatcgaaaacttgtccatcttcccttaaaatgcttgctaatgtcaaaagttgttcttgattcttttgggcactagaaaatccatcgaaagaccgtacaaacacagtcatttcggctctatct

SEQ ID NO: 526989 - DNA, 214 bp, Homo sapiens
gctatacagcataaattgacagaacactgtaaatcaactacactctaatcaaagtaaaataaaataaaatgtctccagaatttgccaaatgtccctgggggtaaaaaccatacctggtaagagccattggatgagagcaacatcccccacttggcctccaggattttatgaaggcatctctcatgactcaacagcttccatgagaaacctgttg

SEQ ID NO: 526990 - DNA, 335 bp, Homo sapiens
tccatgtattagtttaagaagtaatatatacgtgtgttgcattctattttctagaagaaaaaagtgctcaccaatgcctgtgtgggtgggccacagatgaaagcgacacttgaaggtcttaacggtggctggctatgaaaaaacgaactgtgagtgtttaaattcttctttgtttttggctgtgttctgtagttctacttgttttataatgaggaaaaacatatttaaatttaaaaagattagaaaactctatctatactatgacctcaaccatatttatttatttatttaagagatatggtctcactatgttgcctaggctggtccccaactct

SEQ ID NO: 526991 - DNA, 739 bp, Homo sapiens
gatagaacagggcgcagattccatctctccccaagcccctttttagtgactaagtcatggccccaatctcccctcccccagcctacgctgagctatattgcgagttcattctgtagctaagtaagtctccgtccatgcaggcttcactcattgttgctggttttaggaccaccccgagcatcgatgacaatgtattcacttatcccgtctgcaatgtcaagtctctagtatttaaagaatgctcacattcgcttcaggtctgatagtgcagcagtaatgtagtattatgagatgggggaatagatccttcatagtattgctgcgtcggattctctggtagcgtagggtaattacctggaagaagtgaagactgcgcgcagctagcgtgaagagctgagatatctgctctataccgttttccccgggagcgtctcgtagtaccatttggtacctacactcggttgacaagggctaccaacgtacgagacgcggagacgcttatagaggaacgggaatttgttgaaagctatctgtacataacagcgcgtgaacacattgtgtgctttgtatatttaaacatgccatcgtttagatggcatcgctactcaattatttactgatcatataggcttgggggtacaaccccccatataagactttcactacacacatcttacccaaccagaggacttattgaggaaacgtttcaggcctggactaggctgggtgtggcttcccc

SEQ ID NO: 526992 - DNA, 232 bp, Homo sapiens
tttgggacccaggcaactgcccccttgtccccattaaaaaatttggggagggcttgcatgctaaccaacaggctcctgtttgggggccccggggccagcattttggagggagcttccttccttcctttctggacaggttgtcataatggatgccctgactgaccgtttggggctcaggctggtgtgggattcaaccggcccattaaaaaataaagccctattgaatggtcca

SEQ ID NO: 526993 - DNA, 263 bp, Homo sapiens
gcgactagctatatgacatatgaaagagaataacaagtaaaccaatctccgaattgtgcaaatgcttgagatatagtcttacactttattgcttggactgatttctatatgcgtgtcttggttagaggttgctgtgcctgcttgttgctttatttctgggaatgagggaggataacatttttaggaatcttactgtcacattaaagagagtcacataagaaagcaaaaatgttatctccctcacctagaataataagaagaca

SEQ ID NO: 526994 - DNA, 999 bp, Homo sapiens
  misc_feature (761)..(761): n is a, c, g, or t
ccagacatgacggcatgtcatccacaaagctctcctttggggacacgcgtacagggtccagaacatccatggagctttcaatgctctcggggtgagcagacagactcacctccaaccccctggcctcccacgattacatcctgaagattgtgcccaccggtttatgaggacaagagtggcaagcagcggtactcctaccagtgacacggtggccaacaaggaatacgtcgcctatagctatacgggccgcattcatccctgcaagtcgtggttccgctacgacctcagccccatcacggtcaagtacacatgagagacgggagccgctgtacagattcatcaccatcgagtctgtgccatcattggcgggaccttcgccgtcgccggcatcctggactcaatgcatcttcacagcactctgaggcctggaagaagatccagcatgggcagagaatgcattgatgcgcaccatccgcagcctaattgtgcgagggaccctgggcatcgccagtcttgcctccagtgccctgtctcctttggccctcaatctgtgtcccagatctggctgttgtcccccaggtgtgtgtgggcgtgggtggggcacagttaaggatggtcgatgtgttgcaggctacctcttttcccgtgttcttttcgacaaattacctgctgaagttgcgttccccttttctggtgagcccccagaaccggttccggcacggtgcgagtcccgatacttggcgaccctcctaagaccgagnatcttcctcaggaatccgaatgcgatagtaagtcagcaggttgaaagttccacccctagggtgacataagattgttgttccggggaccagcccaagcacaccgggttattgacagcgcccagactaaaacagccaaaagattccgaccaatgtcaaatatattgacctcaacaaagacaatctattacacacaaacaaggttcctcccttctccgccgcggattcaccatcgaccaac

SEQ ID NO: 526995 - DNA, 794 bp, Homo sapiens
tcctcttttaactttttaaatggggtctcaaaattctgtgacaagtttgttgggccaatttgttccctttaaaaagtcactgtttttaaaacctatataccttaaaatctgccccccccaaaaaagaaacccaaatgttggctcccacaaaacatttcctcctttctcccttctgaaggttttaacagactgctttgcttattcattatagcgccagctcttttacttacataacctttaaatgcgccaatttgaaacaaacagttctctgagaccgttctctcccaccacgtgatttaacgagtgtggggtgtgggccgcgttatttaggggtataatattattcctattataacgccttcctggagcctttcctggggcagatcttcgtgtggcccttggccagctcccaggcagccttccttgtcccacctggctttgtgataagacccccaccgcaactggtctggtctctattatacacgaacagcacaagctgcccccaaaggtttggatagctctgagaaagctctcaacacactgtgggctgtgccaggacccattttcaccacagtggcagccatccccagactctcaaacgattttggcggccatcttcccagtttttatccccagaccggcgaatcaacttttttccttcagtctccagcaacacttgcttgcattgtgccgccgggtggcacccattcacgggcctagccgggccttatttggccgggaggccggattatcccctagcgggaacccgcgctcccttggggcctttgggtccg

SEQ ID NO: 526996 - DNA, 720 bp, Homo sapiens
  misc_feature (347)..(347): n is a, c, g, or t
  misc_feature (583)..(583): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgngaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagcttggaagcaaaggttgcagtgagctgagattgtgccagtgcccttcttgggcaacaagagtgaaactctgtctcaancataattataaattaagtggcctttataagtttggtggaaggattaatattggtcaggcccccaaatatatttaatggattatgggaagcggtttatacattattaggataactcttactgggcgccgtcttggtct

SEQ ID NO: 526997 - DNA, 150 bp, Homo sapiens
ggcaagcctatgaccaaatttgatctaacgaccagtaaatagctctaatcagcattgactgtctgtagatctttgaaagtgggatcaggtgcataggtagcctgagtaaagacagtagtaggtgactcttcacccttctgtcgtcttctc

SEQ ID NO: 526998 - DNA, 277 bp, Homo sapiens
cgatccgctgctcctctcacgctcctgcctgggtctgctggggaagaggagctgggtcacaccacccgtccaggggctgagcgccagctcaacagataagatgcagtttcatgccaccaagcttctgccgtctcccctggcccctcctgaggtccgctgctgtgcccgactgggtgtgctcagcggcacaacacacacccgctccaccagtcccaacgtgacaatcaagatgtggccctgaggccgggcgccgtggctcacgcctgtaatcccagca

SEQ ID NO: 526999 - DNA, 716 bp, Homo sapiens
  misc_feature (48)..(48): n is a, c, g, or t
  misc_feature (142)..(142): n is a, c, g, or t
  misc_feature (146)..(146): n is a, c, g, or t
  misc_feature (566)..(566): n is a, c, g, or t
tgcccctgggtgtctgttcccctcaatctgaaaaagcgtgaaggcccnacagccgtcaactgcaacacagctgccgtcaactgcaacacagctgccctcccactgtcgggaagcctccctcctgccccacctgccccagganaaantgcgctagcgtgcccctgggcaagcgccctgctggccacctgcctgcacctgggttgggggtggggggaccagctgagcacccaaatcctggcctctgcccccagcgccagagcagatttcagaacaatttgtaatgacgaaaccccacgtttccctttatctctgggcaaggctttcttcgtcctaggcaattaatccaaaagcaacaccagccgagtgggctggactccttgaagatcaaaactgcccagcgcaggcattaattaagtcattatctcaggcccccagcgactagggatcaggcctttccagttcacactctccagaaagggagataactgccccgccagcagggtgggaaggctctctctccatgttgttttaactccctattaaatcattttattttaaatacacanacagaaatgaagttgaaaatagcacaggagcccactatcactgtgtgaacattttgtgaatgaagacatgtatgaaaggatgtttggaggcttcaagaaacgaaagccgagagtctagctagaccagagccatccagcccaggagcgatc

SEQ ID NO: 527000 - DNA, 214 bp, Homo sapiens
gcccccctttttttcccgggggggcccccctggggggccgggggttaaaccccaaaccttttttggggggaattttttcccaggggttttttttttttgacttttcccggggggggccttccccttttttgtgaaaagtttttcccccccccccggcccccccctttcccggggtttttcccccttaaccccccctttaccctttgccggggga

SEQ ID NO: 527001 - DNA, 360 bp, Homo sapiens
  misc_feature (113)..(113): n is a, c, g, or t
  misc_feature (341)..(341): n is a, c, g, or t
tcagtgatctcctgctcactacgagtagtgggataagggctgcacatgccagtaatttgtatgtagagatggggttcatgtgtggcaggtggtctcgaatcctgactcatgantccgccgctcagcctcccaaaatgctgggattatttttacttttttttgtagagatggggtctctttatgttgcccaggctggtcgcaaaagtcctggccttgagtgatcctcctacttcaggctcccaaagtgctgggactacaggagtgagctgctgtgcccagcccacttcattattttaaacactcaagaaacaggctgcctgacttggcctgagttaccaaancctaacacagtaaggaaca

SEQ ID NO: 527002 - DNA, 406 bp, Homo sapiens
tgaggtgattagaggatccactaacctaatcgctgtataaagaatatttttaggctgggcacagtggctcaggcctgtaatcccagcactttgagaggtcaaggcaggtggattacgtgaggccaggagttaagaccagcttagccaacatggtgaaaccccatctctactaaaaatacaaaaattagccaggcgtggtggtgggtgcctgtaatcccagctacttggaaggctgaggcatgagaatcactggaacttgggaggtggaggctgcagtgagccaagattgtgccattgcactccagcctgggagacacatcaagactctggtctcaaaaaaaaaaattatggttttcaagtttacatttcttactatggtgtacattgaatgcgattagggttagtg

SEQ ID NO: 527003 - DNA, 131 bp, Homo sapiens
agcggactcgggaattgtaggaggacgaggctcagctcttgccaggccaaattgagacatgtctgacacaagcgagagtggtgcaggtctaactcgcttccaggctgaagcttcagaaaaggacagtagct

SEQ ID NO: 527004 - DNA, 120 bp, Homo sapiens
cgactgtggctgccgagagatggctctatggaagagctacttttctggcaggcgtgcgacggcaataggaaaatgtgagagtgtcactgtggatgtggttcgtggttgcccgcaaggatc

SEQ ID NO: 527005 - DNA, 1006 bp, Homo sapiens
  misc_feature (961)..(961): n is a, c, g, or t
tgaatatcagtactattaacttatctagctccagacttgtacatataagtgtaccagtgctcagaagctcctcaagactattgactacattattagcaagtaaagtcagtctgcaggctaatattctatggaccatctgatttatatacaatttcattcatctatttatagtatgtatgtataattctatattacactgtcaaatataaaatatgttatatgagtagaaatcacttaaatttttttgtgttgtgaatttgaaacagtgtaagaaatcacttttaagaaaacatttttagaattcctttgtttttttttttttctttttggaaacaggggtctcactctgttggcccaggctgggagtggactgggcgtgatctcggctcactggcaccttctggcctaccgagttcaagcgattctggtggcttcagcctcctgagtagctggggactataggcctgtaccgtcatgcctgggctaattttggtattttggtagagacagggtttcaccatgttgcccagtctgttctcaaactcgtgagctaaagctactcgcccactgggatgtcccaaagtgctagatcccaggggtgagtcaccagtgctgggccacatttttagtattctaataaaccagtgggtcatcagaactttagaatggtagcctacagaaacttacaatttggaatttcatcagagtttcagtaaatatttccagaattaatgaagcatgtagcttaaatttttccacatgtgagagaagtcactttataacactcaagaggtcaccgaggttatagttataggggaaaaaacttctgttatcgataaatcctaaaaatatcagtaccacgctggaatttatagcaccacctgtgtggttaacatgccagttattttacctttgtgttaaaaccaagtgattcccatcaaaacaggataatatttttccncttttggaacaatccattttaaaacgaacttttcgaagttctaag

SEQ ID NO: 527006 - DNA, 424 bp, Homo sapiens
atggaactgctcttcctctagaacatccagataggtcgctactatcagctagttcaggtgtcgcagtcatctcagtcaggaattccttgttgtatataaaattacaacactttgtccccacatcccttacatagagttgtacatataccgttagtcttctccgaatccgagacttatcctagttctaacttcttacataatattgatgtactatcatacacactgcagaatgtcccacagttggggtttgtcagatgttctctcattaggcactgaagttatgcattctgaaagccacatcaacacagagctgatgtagtcttctcaagtgcatcatatgtgctgcctatcttccaatatatgagtgcctattatgtgaatatgtcttattaccggtgaaagtggtgcatcctggaagtttgtc

SEQ ID NO: 527007 - DNA, 478 bp, Homo sapiens
  misc_feature (10)..(10): n is a, c, g, or t
ctggaaaggngacaattatggtgtgactgcattagcaagatttattataccactaacattggtgcctttaaactgttcaccaacgtcctcattcatctctagtactacacagtcaatgtcatcttcaacttcacactcttctacaactgttggccaaccaacctctattatacctgagttgtgaacatcagagccagtttcatactccaaagtatatgtccttacaacagagttgctcccatttaaaagtgacgcatctgattggagaatgttgttcctcgtggaacattcagcaccattggaccctacagattggatatatgtgatacacttagaagattgcccaccctctgactgaagcatctcatcctcttggctcttctccttaccacaaaccgccaacaaatccacactttcaccatcaaccaagtaaggtagagctttaagctatagcatcaaagtatatatgaggctcact

SEQ ID NO: 527008 - DNA, 111 bp, Homo sapiens
aggtgggcccagtgaacttttccagtaaatgaagcaagccctgaataaaaacctcctgaactgggaacaaagatttacaggcaagcaagatgcccccccaacaggcttatt

SEQ ID NO: 527009 - DNA, 806 bp, Homo sapiens
agcgggcgtggccgttctgagccgagccggaaccctagcccgagacggagccggggcccggggcgtcccccgtgaccaagagaccacactgggcagcaggggtctgctgcagaacgcactgtcggtctctggctgcgcgagatagctgtgcaccatggctggcctctcgagtgacctcctcgggatggtctctcatggtgtgacacggacggggccagcggggcagacgttgtgctgccgtgtgccttcgtagcccgttacttgtcgttgtaagttccgtgtagtcgctcttcgatccaacacgcacgacggacgcgggtcacattgtgggaccggtcgtctccgtttagcgcagttcctgccgacagccacggcggagcccgcttcggggatatcgttcgccttagctcgttgggccgacgtgagcggcctcgctctcgcgcgtgcgagtatcgtgcttctttcatgctacgtgccctgccgtcggggtgacttcacgcgtgcgcctcaataatggagggcgtcgtcgctatgatctctccgtcttctcgctcgagtggcgtgggtggtccccccggtgatccccggtgcggtctttgtggttcccgcccgtgtcggcggtgtgcgcggtggctttatactgtcgcccgagcgtcctcttggccgcgtgtacgctcccaggtgggcgtcccatacgcgcgctgtggtcccccccgtgcgtgggtacaacacccggtgatgcagccccggaggtgctcacccatcatgggtcgccccgcggcggacgacatatgccgagcaccacc

SEQ ID NO: 527010 - DNA, 343 bp, Homo sapiens
cgtcatcctcgcgtcgactctagtagtgatccccaattatgacatgaggagttgcggacaaggaatgtcacgagttccctgaatccaatacaaatctctatgcacttcaaggctgccttatagagccagctccaggactctgccaccagctttcagtctctgctgaatcctaatccattcccaggcctgcgatactacttggttagcctgtcgcgttttgcacgagacttcttttattaactcttggtctttggccatccataaggcctctttctgctccgggctttctgcagtgtctttagttgacattgtcctcacgcagtggctggaatgttatcatggg

SEQ ID NO: 527011 - DNA, 274 bp, Homo sapiens
tcacgcctgtaatcccagcactttaggaggctgaggagggaggatcgcttgagctcaggagtttgagaacagcctgggcaacagagcccaagccgtctcaaacatctctacaagaattaaaaaaaaggaaaattagctgggcatgttggtgtatgactgtagtcccagctacttagaaggctgaggctagagaatcacttgagcccacgagtttgaggctgcagtgaatcactgcactccagcctgagggacacagcaagaccctgcgtccaaa

SEQ ID NO: 527012 - DNA, 545 bp, Homo sapiens
  misc_feature (101)..(101): n is a, c, g, or t
  misc_feature (112)..(112): n is a, c, g, or t
  misc_feature (122)..(122): n is a, c, g, or t
  misc_feature (125)..(125): n is a, c, g, or t
  misc_feature (131)..(131): n is a, c, g, or t
  misc_feature (403)..(403): n is a, c, g, or t
aaaagaaaaagatggttccggtgcccaggcaacagtcccctgtcccggatgttgaggattccgcaacccaggagcctggggagagcttttgtacaaggtcntagatggttcnggccatgctncancggctncaaacctggtggcacggggttttggcctgggttaaggaaaaggtggtggccctggtccatccagtgcaggccctctggaaacagttccagagtttttgctgctttctgtcagagcttttcatgtcctctttccagtcctacggagccccccgggggggcaaggaggagcttcccccccaaaagtgctttgaaccccaatcctcaaaatgaagatactgaccccccctttgccctccccgtccccgggcaccccccctgacccctccctcagntgtcctgtgccccgccctttcccgcccactcagtccccctgcctggggttcctgccccagctttgacctggggctgtcgccctggcattttaataaaacctgcttatacttccctggcaggggagataccatgaaaaaaaaa

SEQ ID NO: 527013 - DNA, 390 bp, Homo sapiens
cagggaatgttccaagtacaaagaagtgacgacttgtttgcaggtggtatctaaactcaccatgatatgttacactacacatcgtgtgcaggcatcataatgtcatatgtcccttaggaatatgtaccaccataatgtttcgatataaaaatgaattgtaaaaattcgctgactatcagcaagaactggtaggagtctgtcgacattattaaccgtggagcgatccgatccccgttctagccactaccccagcttccatggccagaacagttctactaggtcattcacatcgctgtcctgtgagctttgcccccagaaataactaactatatggagcagagcatgggaaattccattaacagaaacaataatggttagttggcaatcacg

SEQ ID NO: 527014 - DNA, 125 bp, Homo sapiens
tctgtggggctaacacggcaggtagggttggttagattcttccctctggggctggactggaggggctggaggctgagtggcaatggtgcagctgccagcacccagtgagagaagtgcatggctac

SEQ ID NO: 527015 - DNA, 694 bp, Homo sapiens
ctacctaatagggttgttgaaaggataaaatggattagtaagtgtaaaatatatagaataatgcctggcatgtagtacatgtccattagacttcagcggttattgtcagtaatgcagatggagaggtggatagaatcagtagctatttagatcaagttgaccggatttgatgatagcttacatatgtaaggtcggaaggtaagtgcaacaagagcgaaactccgtctccaaaaaaacaacaactgtggctttaatagcaccttgatcagagttgtgaggcacagtgaaatagggtgtggttaatcattcttactttctcctgaagtagtaattccaattggccttggattatactaagcttcatagaatggttctcactcactgaaatgattaacagtttcgggaacaaagagagatgacctggagaacacggtaacacttactaaagtcatactggtatttcagacagtctgccaaatcccttacaaatcaacaaccttgagacagggtaaggaccaccatcatcatcatcatcaatcatcatcatcatcatctcctactttaccaattgaggcaaacggaggcttcgaaaaagttcactgggctgaagtcaacagccaatacgtgggcacacggcaagacttcagaagccatgcctgtcctgaattgtcaaaaggtccagtgcatcttccag

SEQ ID NO: 527016 - DNA, 157 bp, Homo sapiens
cgagatcatcagacacgggcactgacacgataggccaaggcctccttgtaccacctatagtggggcaggtgcccagacctagagccaggatagggccgctcctacctcgactgtcaatagagcacatatggtgctctagactccacgtagttaggta

SEQ ID NO: 527017 - DNA, 205 bp, Homo sapiens
gtccatgcttggctcagggcctggggcggggttctgggtaaagtcctaaccccaaagccccagcccctcatgttttgccgcccttcctccatgtgtttgtaaaaactctggcatcctttggccctgaaaaggtttttaaatgtgttatttacttctctaaacatggcgattgctataaaaataaaccaaagtttagaaaaatgta

SEQ ID NO: 527018 - DNA, 452 bp, Homo sapiens
ccatatggagaaaaagcagatgatgctgtgcggatcctcaggtcgagaagaaatgtgggaacgtcgcaaaaaagcagaaagtccagaatgtccatatgtatactcagatccaaatagcaaccgatgtgaactatgactgaatttcttgggcttccggctcccctgtgtgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtattctgtacaatcaagcacggatgctaagaaactgatgagtgatgaggacttgtgagaattcagtctactggatttaagggaatggcttatggagttgttatttcataggcattgaaaatggttttctaaactcc

SEQ ID NO: 527019 - DNA, 357 bp, Homo sapiens
aagcattattttgtatggttctgggatgggagaggagggaatctacagattcgcgtttagttgaaaaatcaaaactccagcataggaaattaggccgttcaacatagccggtcaacatgtgaggtatcatcagtgtgagacaaggtcccggtctgtacctattggcctagctgacgctaacaaaatgggaggcttatggctctgcacagcaaattccagcaggacaagatgactttaagcccgtattcagagccctagaagcagggcactactgagtatgtaatatttagaggtgaaaatagtgcaagagcccctgatggtgcccctctacctgcttggtccagtcagccttgctct

SEQ ID NO: 527020 - DNA, 537 bp, Homo sapiens
  misc_feature (5)..(5): n is a, c, g, or t
  misc_feature (29)..(29): n is a, c, g, or t
  misc_feature (46)..(46): n is a, c, g, or t
  misc_feature (56)..(56): n is a, c, g, or t
  misc_feature (107)..(107): n is a, c, g, or t
aattntttgaaaaccttatggaatcctgntccaaaaaagctttttnaatcttcttncaaaccccaaaactttcaaagttcttaccctgtcagcggtttgtggagaantacacagagctttcagaatcttggagaaaccagatgaagagaagttatttgtagaaacggggaaggctctgttggcagaaggcatcattttaagaagagttcgagaagcaaggactgtcagcgtgagactccaagcttcatcagaaggacatgagcctcaggaagacgatgacctggcgcagcgggggcaggtgaagcaggagccagaaacagccccgtcccctccctgaggcccttcagcgcatgagcacgcccatcaccgctggcccaagctgatggactctgatggcctccatctctcagcacgtgtgccttctcttagtccctgttttcgggatgttatgaatctcagtactgtggtttgaaagcaccagctttgtgaacttttatttcaagacatggttaaataaagggttctccaatgcttaaa

SEQ ID NO: 527021 - DNA, 177 bp, Homo sapiens
aggctagaacctacaaagccatgaaagcggtacaagacgagagtactacaattagacttctgctataagaaaagtcagtcttttacctgagcagtataatatagtacaatgcttgtcatcgaaaacaaaaaacaggcccaatgaaataaaatactttgcaaggcgcaaaccaacccc

SEQ ID NO: 527022 - DNA, 834 bp, Homo sapiens
  misc_feature (656)..(656): n is a, c, g, or t
ttttttaacagcacaggaagataatatttattatatttataccctaaaaacagagcagatagcaagtccaccaggtaaaaatttttttccttaaattatgcttaaccaccaataataaaaacacaagtctcgtgcctgggtatattgtgggctccactataatggatctctccgaggggccacaaaagccagccagcataagagaaacacagttgaaataagtgcacgtgcaaaattttggagtggtgccaaaacacaaagaatcacgtgcatataacacctccttaaattgtggttcaatatatatctctataaacatgtgacacaattaattataattatattgtgggttaattgtgcgggcaaaaacttactcaaaaacatgtgcacacattaagtataatctccccataaccaaagaagattatgtgtgccctataaatagtgggggtccaatctattataacgcgccataaagcctatattctccctccctccaaaaaaatcatcaaagtgagttaaagtggttccccggcctccctccataataagtggttaataaagggtggtatacgcgtggggataaatatagtgcacaagacgtggaattttgtggtttcacaggggggtgtataagtatacgcaaggattgggancctctccgcattttgtgggtgggcccacgccgtggtgtttcccccataattttcttccagtccataaatttctttataaaataaaaattttaaatttaccattttcccaataaaggccctggggaagaataaccggtgcataaagggcaatggataatacctttaaaatcaatatacg

SEQ ID NO: 527023 - DNA, 193 bp, Homo sapiens
tgattttgtttggttcctttgccaacatttgggcacaccctttgcccaaacacgagggggaaagcagttttttttcctcagtttccaaagtaaatggggaatcccagcttttttttttactagcaaatgaccccaccatttatttttgccttttttttccgttcattgtgaggaaaaataaaactggttgaga

SEQ ID NO: 527024 - DNA, 319 bp, Homo sapiens
ctatgtgtgacgcgccgcggcagatccacgttacagccgctgctggcaacgcccgcgacggctactggccggccggcgcgctgatggagaccgacgcctcgacgggcaagtggcaggagctgacgccaacgctctcgaacagttgcgaggtcttcccgcacagccgcacccgcgtgcaggcccagcaaggcgactacgcctgggccttgtggcggccgtactcctgctgccggcgtcgtggccaggtcttcctcggcagcgtcgatttcatgtgaggaacccacgatgaacgcctcccttcctgacttcctgcgccgtg

SEQ ID NO: 527025 - DNA, 522 bp, Homo sapiens
  misc_feature (366)..(366): n is a, c, g, or t
  misc_feature (375)..(375): n is a, c, g, or t
cgcgtgcatctgtgcctctgcccgggtctcctggtccttctgccctcaatgccgagatgttcatcgtagaacccccacgtgccccgcgcctccgtgccggacgggttcctctccgagctcaccccagcagctggccccaggcccacccggcaagccccccccagtacatcccggtgcacgtggtcccggacccagctcatggccttcggcggctcccagcgagccgtgcgcgctctgccagcctgcacagcatcggccagatcggcggcgcgcagaaccgctcctacagccagctgctgtgcggcctgctggccgagcgcctgcgcatcagcccggacagggtctacatcaactattacgacatgnacgcggccnatgtgggctggaacaactccaccttcgcctaagagcccccgggaccccccctgtctgcgctggctccccccgggaacccccccccccctgtgttttaggcccccccccccccaccttctggtggggagaaataaaccggtttagaga

SEQ ID NO: 527026 - DNA, 471 bp, Homo sapiens
agaataccaacacaaacaaaactcagctatccttcaggaagaatgtgaaaagtgtataagtagtaagtcagctttagaataaaactttctccttactattcaagttatttgtgtctgaatcccaaatgactacagattagagttataggtctgcagtgccacacaggtgcaaagaataaaagcgctctgcttaccctctccaccaggactgaagcaaaaacaacagcgagctatctgtgaaagcaaaagcaacagtcaggcggcttgtgttctatttctagtccacctcagcaaggcaacagtaacccttatttgaaccacctcccaggcccttcaaaagatgtggactgttctttcccaggtgtgctgggtgttggtgacaggaaaccccatggagggagatgtgccacagagatcctcatccgtggacttggtgctcgctcctgctaccatgaatgctgagagcagagc

SEQ ID NO: 527027 - DNA, 788 bp, Homo sapiens
  misc_feature (195)..(195): n is a, c, g, or t
  misc_feature (235)..(235): n is a, c, g, or t
  misc_feature (240)..(240): n is a, c, g, or t
  misc_feature (259)..(259): n is a, c, g, or t
  misc_feature (280)..(280): n is a, c, g, or t
  misc_feature (283)..(283): n is a, c, g, or t
  misc_feature (288)..(288): n is a, c, g, or t
  misc_feature (294)..(294): n is a, c, g, or t
  misc_feature (296)..(296): n is a, c, g, or t
  misc_feature (306)..(307): n is a, c, g, or t
  misc_feature (309)..(309): n is a, c, g, or t
  misc_feature (314)..(314): n is a, c, g, or t
  misc_feature (316)..(316): n is a, c, g, or t
  misc_feature (320)..(320): n is a, c, g, or t
  misc_feature (351)..(351): n is a, c, g, or t
  misc_feature (361)..(362): n is a, c, g, or t
  misc_feature (373)..(374): n is a, c, g, or t
  misc_feature (380)..(380): n is a, c, g, or t
  misc_feature (386)..(386): n is a, c, g, or t
  misc_feature (390)..(390): n is a, c, g, or t
  misc_feature (412)..(412): n is a, c, g, or t
  misc_feature (414)..(414): n is a, c, g, or t
  misc_feature (442)..(442): n is a, c, g, or t
  misc_feature (475)..(475): n is a, c, g, or t
  misc_feature (559)..(559): n is a, c, g, or t
  misc_feature (566)..(566): n is a, c, g, or t
  misc_feature (571)..(571): n is a, c, g, or t
  misc_feature (579)..(580): n is a, c, g, or t
agcggagtctgtcggagtctgtcctcggagcaggcggagtaaagggacttgagcgagccagttgccggattattctatttcccctccctctctcccgccccgtatctcttttacacccttcttcccaccctcgcttcgcgtagccatggcggagccgtcgggcggccacttcagtcccattccatctcctcgtcngtccttcggaggcccgagccgtccgcgcccggcgtgcggngggangcccaggagcctgacccgncctggggacgaagagctgcantcntcccntgatgncnggtgcacganncntgatntnttcnggagagatgtgaagaagactgggttagtctntgggcaccannctgaatcatgnntgcttnccctgngcangctttcagatgtcatcagtgtngntttcttacctcatcctggctcttctctntgtcaccatcagcttcaggatctacaagtccgncatccaagctgtacagaagtcagaagaaggccatccattcaaagcctacctggacgtagacattactctgtcctcagaagcttnccataanttacntgaatgcnngcatggtgcacatcaaacagggccctgaatagctcattgattcgtctctttctggtagaagaatctggttgacgtccttgaagctggctgtccttcatgtggctgatgacctatgttggtgctgggtttttaacgggatcccccttctaattcttgcaggaactggtcattttcagggtgccgattgtctatgaaacgtaccagaccc

SEQ ID NO: 527028 - DNA, 731 bp, Homo sapiens
agcggagtctgtcggagtctgtcctcggagcaggcggagtaaagggacttgagcgagccagttgccggattattctatttcccctccctctctcccgccccgtatctctttgcatcgcttctctccggcgcatcgacttcttcgttggcccatgcgtcggtggctctgtcgggaggctcgacctcgagatcccgcatatccgatcgtcctcgtccgttccttgcggaagcccagagcctgtacgcgtgccacgagtgcgggcgaagggtagctcccggaccgcacttgtcacacggccgtgcgggcacacaagcacgtgtgctcagactcctgtctcctcgtggcaggggtgcatccgatatcatgagtatccctctgcatcatgacgtcgttcaatagatagacgcatgcggctgagttcattgttggcatcctagcggaagtgctctagatgctgacttcctcccctggcgaagacctttttgtggccccgggtggttcaagatagaggcgtgcttagaagggtgccatatactgagcccggtcgaatttctcccttgtggaatcccaatcgctcctaccatgggtactcagccggaattgcgaggcgattaggacggcgaactcactaaatcacaaggttggcacgaatttcattcccgcaaaaaggccctggttctgccggggaaaaattccaagaaagaggcgagctgggcacgacctccccaaag

SEQ ID NO: 527029 - DNA, 90 bp, Homo sapiens
agttgtgcttgctgtgcaagtttcattgactagtagaactcattctgtcttagtgtatatttcactataaatgtaaacattttgctcaag

SEQ ID NO: 527030 - DNA, 172 bp, Homo sapiens
ctgcggcccgttgctgggggtccttcatgccttctccagggccggtcgcatgggccgtctcgtcccacggcagcactgcccccatgtcgccttccacaccaggtgccctcggccagcacacacgggctttggctcacagtgcatggccgcgtcgcgccatgggtcccgcagc

SEQ ID NO: 527031 - DNA, 114 bp, Homo sapiens
catcttgaggatccccgaaacctaattacgcagtgttagggtatgctatcatctgtataaaatacagagaacaaaaaaggaaaaaaatgcagatacagtagcttagacgtaata

SEQ ID NO: 527032 - DNA, 545 bp, Homo sapiens
agtggacaaactggaagacagaagtacgggaaggcgaagaaaacgaatagagaacgatagggaaattagaagataaaaacatacttttagaacgaaaaaaagataagatttaaactctgaaaagtaggaagcagaagaaaaaagacaagcctaggcaacacaacaaagctaagggcaaaatgtacaacacttagaacgaaacattggacagatagaaaccaagaatagacaaactgaaacatatcggtcaagaagctttcaggactagcacaccagtggaacacacacccaacggccctaaagacacaacgcctcactcgcgccgcaacgctccctccgcacacgcaccacccaccaccatacctaaatgcccaccaaaacccgggcactcacacctaaaccaccggacaacacccctgcacgcaacctccacccgcgccaaccccaaccccagcccccacccacagcccccagtcacaaccccaacctccgccccggcgcagggaaggccagcaccgcctccacccaaagcgtcacacaggcct

SEQ ID NO: 527033 - DNA, 989 bp, Homo sapiens
  misc_feature (409)..(409): n is a, c, g, or t
gcggattttctccccgcggatattttccgtgcggaacactcccgggggtcccgcctctctggtaatggtagaaaagagttaggccccgttttattatcccgggaccgacaatgtgcccctggtcccccagaaagaagataaattgtgagaaaaaataattgtggaatttatgcccacttgtgtcagcgcacgcctctttattttggagggttaacttctccggtttttctcacaaagggaagcgtttgagggagatttttagtgcccctcttctcgccacgtttttttcttcccccaaggctcgtggtcccccgtggagagattgttccaccccctcctgggaggcctccatcaaagaaaacccctcatgggaaagagttgaatgttaaaattgtgggctcgtccactngtgcctcaaattttcccggattctcatgcactcccacactgggaaccctcgggaaaaaaaccccgctggagctctttataaggttgaaaaagagagttttcccaaagcacttttcccacactataagttatcaccaatagtgttcccaaaactctcttttatattatgtaaaccccccctctcctcaattagaggaacaccccaagttactcatattggaacaccacttggtgtaaaacaccccccacttccctctcggaatttttttttaaggcccacatttatggaataaatagcgtctatattgtccacccgctccaggattagccttttaaaatatatggttggaatattgataaccaccacccgggaagattttccttggaaggcacccatccctttctgccttttctcttttttctttgagagatctataagagagaacctgtagagttgttttccctgaccacgcccaaagactaaatgtgcacccaaatgaaggccacttgtataagaagccgatgccaaccttgtccaatatttaataaagaattatggaagcctgggaccttttttacca

SEQ ID NO: 527034 - DNA, 130 bp, Homo sapiens
  misc_feature (47)..(47): n is a, c, g, or t
ccttggctgctctctgctgacttggtcccctccaaccctgcttgggncggcccctcaaattgacagggaaaatgttgccaggccccattttccaaagtctgccacagagcctgaggtcaaaaaaaaaaaa

SEQ ID NO: 527035 - DNA, 276 bp, Homo sapiens
cttttttttttttgggggggggcggcgccccctgcccccaccccctttttttttcccccaagggggggggtgccccttttggggcccccctttacccccaggggaaagggttaaaaattttttcccctttggaaagggcgccccttttttaccacccctttaaaaacaaaaaccccctgggttttgggggggcctttactaattttcctttttttccccccctttggggttttaggacccctctttaaaagccaaaaaaaccttggtttcctttta

SEQ ID NO: 527036 - DNA, 300 bp, Homo sapiens
gcagacagcggtgggagccactgctcttgtcatggggtcagaaccacatgctttcctgcggatgacagcgaaagagactgaaggtttgatggagggagacctgtgtagtataagaccttctgctatgaagtgttctaccaggttttcccaccccactcatgagcccttttctcacaacaggtacttgccggcaacgatggactaggtgggttgggccaatcttcctgatgaagacaattagaaaagcaagataaccatcactcttcacagaactagaaaaaacaatcctaaaattcatat

SEQ ID NO: 527037 - DNA, 251 bp, Homo sapiens
tagctgggattacaggcgtgcgccaccacgcgcagttaattttgcagttttagtagagacgaagtttctccatgttggccaggcatggcttgaactctcgacctcaggtgattcgcccacctcagcctccctaagtgctgtgcttacaggtgcgagccaccatgcctggccactccattcctttttatggctgtgcaatatttcattgtatgtttattcaataatttgtttatctattcatccacacgcgg

SEQ ID NO: 527038 - DNA, 89 bp, Homo sapiens
gatttgctggtgcagtacaactaggcttaatagggacatgcctgtgagagaggagataaaaaaaaaacgttagaagcttgaattcgagc

SEQ ID NO: 527039 - DNA, 179 bp, Homo sapiens
taatgttctggaagctatgtgtttaaatatttttctggtgacttggtaataaggtctggattggtttaatgtgtgggcttaagctaaaggttccctaaaagctatcttctaagtaagctggctcactgtggttggctaaaattaaaatttggggcgtgtcaaaatgtgcaaaaaaaaaa

SEQ ID NO: 527040 - DNA, 1023 bp, Homo sapiens
  misc_feature (1)..(1): n is a, c, g, or t
  misc_feature (3)..(3): n is a, c, g, or t
  misc_feature (9)..(9): n is a, c, g, or t
  misc_feature (136)..(136): n is a, c, g, or t
  misc_feature (178)..(178): n is a, c, g, or t
  misc_feature (188)..(188): n is a, c, g, or t
  misc_feature (200)..(200): n is a, c, g, or t
  misc_feature (217)..(217): n is a, c, g, or t
  misc_feature (222)..(222): n is a, c, g, or t
  misc_feature (231)..(231): n is a, c, g, or t
  misc_feature (236)..(236): n is a, c, g, or t
  misc_feature (239)..(239): n is a, c, g, or t
  misc_feature (251)..(251): n is a, c, g, or t
  misc_feature (272)..(272): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (297)..(297): n is a, c, g, or t
  misc_feature (299)..(299): n is a, c, g, or t
  misc_feature (309)..(309): n is a, c, g, or t
  misc_feature (342)..(342): n is a, c, g, or t
  misc_feature (408)..(408): n is a, c, g, or t
  misc_feature (503)..(503): n is a, c, g, or t
  misc_feature (510)..(510): n is a, c, g, or t
  misc_feature (516)..(516): n is a, c, g, or t
  misc_feature (520)..(520): n is a, c, g, or t
  misc_feature (583)..(583): n is a, c, g, or t
  misc_feature (590)..(590): n is a, c, g, or t
  misc_feature (608)..(608): n is a, c, g, or t
  misc_feature (625)..(625): n is a, c, g, or t
  misc_feature (884)..(884): n is a, c, g, or t
  misc_feature (989)..(989): n is a, c, g, or t
nanacccantttaccagctttacttttttaaacctaagcttaacattacatatttaaacaattgtcaaaacttactaagttgccagcattcatgcacaactagaaaacatccttaatttatattaaaccagaaatntattaccattaatgtattaatatctttcactactaaatactnaaaaaaattnaaattatttctntagaagaatcgtcctgncaatnttaacttcncagcnggncgacactacgtngctcacatttcagacacaatnaaaagcaggtccatnctgntnttantntacaatcttntcctacactaaagagtcaagactcaccttggantacgtttaataaaaaatcaaagttcatacagagatttacaacaattttaaagacaaaaaaaaaatngtcctattattttgtcccaacaatcaactcaaaagtctattacaaatagaggctccgattagctttttataaatactttaggtacaattatactnaaattcnatttcntttnaaatcttcaaaaaaattttccttttaatcctcaaatggtgcttgttatagtttaacatttctnttaagtncgtgcgttgaattacttnttatccaagcgcagagnctgctccttaccatttattgttaaggactttaactggccatcttcttcaacttctactctttcttgaccgttctcgacaattctctttgtagtgatttttctgccattaaccattttagttgaagttgatatcgatttgaagttgcccatgccactaccaccaaatgacgtggaagagaatgaagtgaggcccccgtgacctagtgacccaaatgaagtaaatcctgtatcaaaagaagaaaatccacttccaaaaganggaaatccactgaacgcagagaaaaacgaccccgtccctcggcttctgcttcctcggggaccccttcgattccaaagaagtcctcaaaagggtcttcaagaagtnaattgaaatgggtccttcaccaaaaattcctgaa

SEQ ID NO: 527041 - DNA, 269 bp, Homo sapiens
tatatgtcatcatcggcctgtctgtggctggctccctattcccatcccacgcctgggaacggcgcacttgctaaggcaggtcaaggacgatgcagctagacctgccgcccaagccccacgaatactagagcaacagcttcagcctacggtgggccttctcgtactctctcactcgcatgcccgcccgcggctatccatgcgcgtcagagtactggtcattaactacaatgtacgaaggaagtacgtattcgccggcggacaggacggca

SEQ ID NO: 527042 - DNA, 1022 bp, Homo sapiens
  misc_feature (1)..(1): n is a, c, g, or t
  misc_feature (3)..(3): n is a, c, g, or t
  misc_feature (9)..(9): n is a, c, g, or t
  misc_feature (136)..(136): n is a, c, g, or t
  misc_feature (178)..(178): n is a, c, g, or t
  misc_feature (188)..(188): n is a, c, g, or t
  misc_feature (200)..(200): n is a, c, g, or t
  misc_feature (217)..(217): n is a, c, g, or t
  misc_feature (222)..(222): n is a, c, g, or t
  misc_feature (231)..(231): n is a, c, g, or t
  misc_feature (236)..(236): n is a, c, g, or t
  misc_feature (239)..(239): n is a, c, g, or t
  misc_feature (251)..(251): n is a, c, g, or t
  misc_feature (272)..(272): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (297)..(297): n is a, c, g, or t
  misc_feature (299)..(299): n is a, c, g, or t
  misc_feature (309)..(309): n is a, c, g, or t
  misc_feature (342)..(342): n is a, c, g, or t
  misc_feature (358)..(358): n is a, c, g, or t
  misc_feature (362)..(362): n is a, c, g, or t
  misc_feature (370)..(370): n is a, c, g, or t
  misc_feature (409)..(409): n is a, c, g, or t
  misc_feature (419)..(419): n is a, c, g, or t
  misc_feature (445)..(445): n is a, c, g, or t
  misc_feature (467)..(467): n is a, c, g, or t
  misc_feature (472)..(472): n is a, c, g, or t
  misc_feature (491)..(492): n is a, c, g, or t
  misc_feature (495)..(495): n is a, c, g, or t
  misc_feature (502)..(502): n is a, c, g, or t
  misc_feature (507)..(507): n is a, c, g, or t
  misc_feature (516)..(516): n is a, c, g, or t
  misc_feature (518)..(518): n is a, c, g, or t
  misc_feature (521)..(521): n is a, c, g, or t
  misc_feature (541)..(541): n is a, c, g, or t
  misc_feature (582)..(582): n is a, c, g, or t
  misc_feature (589)..(589): n is a, c, g, or t
  misc_feature (607)..(607): n is a, c, g, or t
  misc_feature (624)..(624): n is a, c, g, or t
  misc_feature (883)..(883): n is a, c, g, or t
  misc_feature (988)..(988): n is a, c, g, or t
nanacccantttaccagctttacttttttaaacctaagcttaacattacatatttaaacaattgtcaaaacttactaagttgccagcattcatgcacaactagaaaacatccttaatttatattaaaccagaaatntattaccattaatgtattaatatctttcactactaaatactnaaaaaaattnaaattatttctntagaagaatcgtcctgncaatnttaacttcncagcnggncgacactacgtngctcacatttcagacacaatnaaaagcaggtccatnctgntnttantntacaatcttntcctacactaaagagtcaagactcaccttggantacgtttaataacccngccnggtgcctncgggggtttcccaccattttaagggcaaaacaaaatggncctattatgngggccccgccctcccctccccggtcnctggcccatgggggctcgcggngggcngtttttccctcctttgggnnccnttgtccnggggncgggttcgntnggnatcttcccggacctgttccngttgatcctccgctggtgcttgttatagtttaacatttctnttaagtncgtgcgttgaattacttnttatccaagcgcagagnctgctccttaccatttattgttaaggactttaactggccatcttcttcaacttctactctttcttgaccgttctcgacaattctctttgtagtgatttttctgccattaaccattttagttgaagttgatatcgatttgaagttgcccatgccactaccaccaaatgacgtggaagagaatgaagtgaggcccccgtgacctagtgacccaaatgaagtaaatcctgtatcaaaagaagaaaatccacttccaaaaganggaaatccactgaacgcagagaaaaacgaccccgtccctcggcttctgcttcctcggggaccccttcgattccaaagaagtcctcaaaagggtcttcaagaagtnaattgaaatgggtccttcaccaaaaattcctgaa

SEQ ID NO: 527043 - DNA, 805 bp, Homo sapiens
agcggaagagagacgcgcgcgcagtcgcgcgcgggtcgtgccgtaccaccgtcgcgggcaggctcggccacgagcgccagagccccgcgcctcccctcgcgtgctgtcccaagtccctgccccgaaactagagcgtcacttccgacatccccggcagcggtaggagagcggggcgcacggggggagggggccaggtcggagggaagcccgcccgtgccctgaagcccgacgcccgagcagggactacatttcccgaggggcctcggcaggacggcatgcgagagaacgggacgcggaaaacgtcccccggaagtggagcccgggacttccactcgtgcagtgaggcgaagaggagccggagaacagagaaccaagagggccgagactcgggtttcttgaccaagtatgagccgggggctggaccccgtcaagtgaatcatcaaagggataaagcaccaagcagtttatggactgggcggaggaaccgcaggtttcccttggcattcaaaggccaggaaaccagcatgaatgaggcgaatcagccccggattaattttatcaattgtgggatcatttgactgggacccatcaaggaattcacaccccatttggaagcggacgaggaatttttataacaccgtggtaaacgttattccctttgcccagaaagaaataccgcaaaggggacagccactaaaaagtacggtgttacatgacgcaaaaatatatgcaatccctaagtgtaagaacaagtaggcgcacgacattagtgtgtagaataatgtggaaagaatgagtggtcccc

SEQ ID NO: 527044 - DNA, 457 bp, Homo sapiens
  misc_feature (171)..(171): n is a, c, g, or t
ctgcgtcattctagaggatcccgcaatggtcctgtcggttgcacagcaaggctcgtcctgccgccgtgctgtgatcacctttggtgccttcctcatcggggccctgtccactgtgcactctggtacatctactcgcacacgcgtcccccagcaagcgggagcccgtgttgncggtggctgccccggcctcctcggagagcagcaagaacaaccacagcatcgggagcaccaagagcaccccctgctcgaccagcagcatggaatagccctggcccccggggctcgcccagcaggaaagactgagcagccggcagctgggagcactggtgtgaactcaccctggggagccagtcctccattcgacccaagaaattgcaggctggctctcggcgccatacctttcccggcatccctctcaagagggccctgcttgcgcagtgcgcccactgggtttgga

SEQ ID NO: 527045 - DNA, 302 bp, Homo sapiens
gtatatagtgctctatttatatagtcaactatatattaactatacgtagcctgaagtgtcataaaaagtattaagtcatctgttttctacctggttgtctttgtctctttttataatctcctgaactcttcatagtttaatatgaactcataatggagacaaatgttacatatttgttaactttgtctctgatattgcacaaacttatgtctcaaactttatcagtgatttcctctgtcatttcttccagaatttctttttttttctgttttatatggggaaaaggggcctggcccggtcca

SEQ ID NO: 527046 - DNA, 523 bp, Homo sapiens
caagtactagacaaagcagaaatgtacaatatactggtctgtgtataccagagaaatacatagaagaagagaatagaggggatgatgtgacttgaagtatatgcagcttattttcccccccactgtcagggcagaggcccattattaatgaatgtggttgcatgagctgttcttatgttaaccacatatttttgtcttcccaatgccacacagtaggtgatatcccgtgtgacatattttcttcatagtccctaatatagtcatcctctacagagttggcgtgctgtgtgcactggggataaggaacagcagtggggctgtaaccgagtctcttctctggccctttgcctttatgtcagcttgcagctttcgcctcatttattcctagtcagatcccaacggcctgacttaagggaccagaacggagatagggatattacaatgcagagggggaggggaagggatggtagagatagacagctctcccctactaggtagggtcatttcccctaataactataga

SEQ ID NO: 527047 - DNA, 800 bp, Homo sapiens
cccaccgccgtcccgaatcctggaattaatattaaatggcttattgaaaaggcccccagggtaggaaataaaaaaaaaaaaggggttccatttaagcccctaagcccctaataattaatggttttttctggtccaaaagggaaaaaaccaaaatttcttcaaaatagggaaatttcttaaaaaaaataattttaccttaaaagggtaaaaaataaaccctacctttaaaaaatggtttttaatttcccaagtttgggaaagggaaaggggtaccaagggggaggaaaaatccgccaaatttattttttaggggggaggaaaggtaataattttaatttattaaaggaatgggtgggtcccctccaaaaatttaagcccctaccccattgggccaccggtaaggggggccaggccagccttattattttaggaatttttaccttaagaagggttggccttaaaggtttaagaaaaccaccttaggggctttttttaatttggaggggccaggggggtttttaaataaatttggattaaggaatggccttttttttggtttttgggggtttggggttttcttttcttgggggaaggaagaaaatggggagggggaccttttaaaggttaggaaaaggtaagcctttccttggattaaaccaaggaccttttttcttaggttaggccaagggttttcccacctttccccaccgggggttaaccccttttttttaaggggtttccaataaaggtaatccttttttttcaccccaaagggtaattttacccaaaaataaaaggcc

SEQ ID NO: 527048 - DNA, 522 bp, Homo sapiens
  misc_feature (1)..(1): n is a, c, g, or t
  misc_feature (517)..(517): n is a, c, g, or t
ntttttataattactgaactctctgttaaacctttcgtgtgtgtgtatgctgtatgttgtcttcatgccaaacgcctttctggttctggccaattttggggtccaggctgtgaccagaggataaaggttagtcagagaatgtgaatgatctgaaaaatccatctcatgccctccccttaagtagaaagtttcctcgtctaggtctcccttcagaatgggctggctggttagatttgtacctaggggccacccacagactgaaaagataagcctgctatggtccctgggatggccggtggtttaccctggtggtcttccaacatgggcttgacttaacttgaatttctggggcaccattttggacctaacaggctcttaacctgcacctataaagacaaaaatgaaaccaaacccagctttagttgggaggctgaggtttttagcagctagtcattttttcctaggtgcattttctctctgaaatgatagggactggataacttctaaattccttccngctaa

SEQ ID NO: 527049 - DNA, 940 bp, Homo sapiens
tctattactttccccccccctaactaagggactattatggtggggggtttaaaattaagctctaagggcttagctatgggggttttctgggcgggggtccgggctcccggtctcccgggtcttcccccggcccggccctgggggccccaagggcccctcggtctcctccaagcccggcgaggagtggggggcgccggggccggcctttaaaaggggagggccaggggaacgcagaggcggggagaccgggccggaagactccgggcgcccctcgcacctcctctccccatgaggagggcgcgcaataggggacctcccgggggccctcctcttttcactcagagggcggggcggagaagacacgcagaaaggggggactgcgcctcctcgcgggagtggcgcgcgcgcacatatctctcgcggagaacctcgggggcgacccacttcccccgggggcggcccacacaccaacaccgagactcgcggacaaggggagcgtgggggaagacgcgggacgcggaaatacaacacaccggggacagcgagaaatagtaacgcgaaacgcgcaggggggcatggggaaccacatttaaataaacgcacttcacaaaataatacaacgcacactctggggatcaagggacgcgactaaaaaggggagatcccatacagagcaccggggcccaccaacggcgcgggggacgggcacacccttataccccccgttagggaaaccacgcgacgaggaggcgctacacaaaaagacgcccgacatccgtaaggtggagaagtcaggagagacaacactcgccgggacaacaggcaccggaagagggcagggacaacggagagaagcagacgagacccagagaaagggtacacggagaaagcaggagccgcacagggaacgacgcagaacaccaaaacgcgacggcaaaag

SEQ ID NO: 527050 - DNA, 117 bp, Homo sapiens
aaaccctaattacgggaggctatgtgttcatggtcatcaattagttaacttcttccatttggtgaaggtttaatcatccgtaaaacaacttatgaaatgtgcatcagatcctgttat

SEQ ID NO: 527051 - DNA, 1489 bp, Homo sapiens
gcggcgtcactgacgcttcgctccgtgtcctcggatcccgagcgcggggagtgcagaccagacatgtgagcatgcattgatccccaatcctgcgtgccgtccatggggacacagaagcccatccgatggatgcccgggtgattggattggagccaggacctcacttccatcacatcatgaacccatgacccatgacaccatcccagacaccctggaaccaacaacccatgacagaacaccagaaaaccatggatcatggaaccctggggtgagagaaagagcgatcacagagaaggaagatccacaaaaaaaaagagcacatgagaataaaagaagacaatgagcaaacaatggacatacacataggagagagcaaagcacacatcacatgcaaatggggacagcacgatcatagaaacaaggccacaagacgccacaaccaacaatcgggaacacaacatccgaaaggaagaagcaagcctacagcaccaaaccaagagagaaacggaaagaaacatgcagcaaaccacgagaagcaccacacaacaaccaccacgaccgtggcaccaacacgagcgagaaaaaaaccaggcatgagcaagaactaggaacgaggagagcaaacaagcaccaaaaacagacgagagcagaagacgaagaccacaacaagaagcgagcacaaacaaaacataagacgaacaagagacaaacccagaagacagacacgaaaacgaaacagaaaagacagcacacacagcagcgacaaagacgcagcgagaagacaaagcagaaagaggacaaaaaagcccgagaggcaagagccaacaagcaagagcgcagggaaaggacgacaccaccggcacaccacggccaggaaagaaagagggcacaaacgaccccccagcagagcagcaagcaccaaagaccagaagaaaaggacaaagaaacgaaaaaagaaacacaagagaaaagaagaaaacacgacgaacacaggaaaaacagaaacaaaaagcaaaacaaggagcagacaaaagaaaaacgagaaaaaagaaaaagagagagaagagagagcggaacacaaccggcaacagacacacacaaaaaaaagaaagcgcaacgcaaacacgaggaagagggcgaagagacgcggagacggggccggaggaaggaaagaggagaaggacaagacaaggggcgaagcagccgaacgagcgagggcgaggaagagagaggagccgaggcacaaagacagaggcgaagagacgggagggagagggagagcaggggccgagagggcgcgagaagagacgggagggagagcggagaggcgcagaggaagcgagagagaaaggaagagaacgagaaacgggagacgggaggaggccgaggaaagagagagaaagcaagaggagaagcgacggcaacgaaagagagaaagcacagaagcagaaccaagacggagcgagcgcgcgaggcgcaaggagagggg

SEQ ID NO: 527052 - DNA, 319 bp, Homo sapiens
agcaggagatctgccgtactggggagggctgctgagtatttgtgcgggctgtgggtgtctccgagtttggggagatcatttagggaaggaacggctggcagaggaggatgcctcttctgcggagtcctctccttccctcaccaaaacttggcatgaaagggtgggtcggtcccacatccccaagctgcgcaggtggcaggcggctgctttattcaagcaactctggggctcgactgacaggtagaggtgcatcaggcgtggagcctctatgccatatactctccttacagattacccctgtagctggagggaccggctg

SEQ ID NO: 527053 - DNA, 739 bp, Homo sapiens
  misc_feature (39)..(39): n is a, c, g, or t
  misc_feature (97)..(97): n is a, c, g, or t
  misc_feature (103)..(104): n is a, c, g, or t
  misc_feature (113)..(113): n is a, c, g, or t
  misc_feature (123)..(123): n is a, c, g, or t
  misc_feature (141)..(141): n is a, c, g, or t
  misc_feature (187)..(187): n is a, c, g, or t
  misc_feature (193)..(193): n is a, c, g, or t
  misc_feature (200)..(200): n is a, c, g, or t
  misc_feature (229)..(229): n is a, c, g, or t
  misc_feature (233)..(233): n is a, c, g, or t
  misc_feature (258)..(258): n is a, c, g, or t
  misc_feature (267)..(267): n is a, c, g, or t
  misc_feature (272)..(272): n is a, c, g, or t
  misc_feature (293)..(293): n is a, c, g, or t
  misc_feature (296)..(296): n is a, c, g, or t
  misc_feature (301)..(301): n is a, c, g, or t
  misc_feature (304)..(304): n is a, c, g, or t
  misc_feature (329)..(329): n is a, c, g, or t
  misc_feature (342)..(342): n is a, c, g, or t
  misc_feature (434)..(435): n is a, c, g, or t
  misc_feature (474)..(474): n is a, c, g, or t
  misc_feature (484)..(484): n is a, c, g, or t
  misc_feature (495)..(495): n is a, c, g, or t
  misc_feature (523)..(524): n is a, c, g, or t
  misc_feature (578)..(578): n is a, c, g, or t
  misc_feature (600)..(600): n is a, c, g, or t
  misc_feature (629)..(629): n is a, c, g, or t
  misc_feature (691)..(691): n is a, c, g, or t
tttaaatttacgttactggccatgaagatccagcaaganaccaccctttcccccacacttcagaaaaaccagccaattcctgtcctacgaggattgntcgtgnnttaacagtncttggctctnccttgtcagcatccaganatcccgcgtgttcagatctctgtaaacttgaggagttcagcagtgnccaatnagctagnaatgccccaccatcttcttcactgcattncagngtagcaaggcacctaccaacaatgnagtttgggnaatgngccatgaaaaacataatggcntgngagtnagncatacatcctaggtctgccaattgnatgaggacattantgggaatgtaaaattccaggagagcattctgtttattgctcactctccaagttactagcagtgggcagtatcagagagaaaacagtagaggnntgtggcaatagctcatatgtgataccttagtagagctantaccaaactnaacaaaatgcnaactacagtgggacaaagaactgactcnnatttgagttttatttgtggcttcaagcaacctccaaactaagaggctcataatntaggaaataattttaatgcacngagggatcagtaatttgcattagaatatnattaaatttatgttttgtaagagttgcatatacttcattgttgaattcggtgccaacagtanacaaataactaaatgagatataacctcaaatatacccacttgcaaaac

SEQ ID NO: 527054 - DNA, 302 bp, Homo sapiens
  misc_feature (54)..(54): n is a, c, g, or t
  misc_feature (93)..(93): n is a, c, g, or t
  misc_feature (159)..(159): n is a, c, g, or t
  misc_feature (216)..(216): n is a, c, g, or t
  misc_feature (267)..(267): n is a, c, g, or t
tagaagcctaggcacagtggcctcacaccctgtaatcctcagcacttttggagncccgggcgggaaggattacttgaggacaggagttcgagnccagtgtgagcaaaatatggagaccttgtctctacaaagaatagaatagttgtgggtgtggtggtnccagatgtggtggtacacacctgtgtagttccagctacccgacaggctgaggcgggnagagctcttgagcccgggagttcaaggctgcagtgagctatgattgcgccnctgcactttaccctgggtaacagagcaagtccttg

SEQ ID NO: 527055 - DNA, 318 bp, Homo sapiens
tgagacagagagtcgctcgtcgcccaggccgcagtgcagtagcatgatctcagctcactggaacctccacctcccgggttcaagcgaatcttctggctcagcctcctaagtagctgggactacaggcacctgccaccacgcccatttaagttttgcatttttagtagcgacgggttcaccttgttggccaagctggttttgttggccaattggctctaaactgctggcaaaaaaaggaatggatcagattggcttgaatagggcagagctaacctggaatcacctgtgtgatgagaaacagctttgactgcattttac

SEQ ID NO: 527056 - DNA, 1302 bp, Homo sapiens
cctgaggacgccgccgcggtgctggcgccgcacgtgtgtgcggccggctgcctctcacgtccgctacgagcccgcgcgcgtgtgcggcccggcgggtgtgcgctggtgaggctgcggttgctggtaggcatgtgcgtcacggccgggtgctagggttgcggcgcatctgctgcggcgtgccctccggggctggctgggtgcggtgcgtgcagcgtgcgtgtgtgttcttgtcgtgtgttggtcgtgtgtggtgtgtggttgtttgggtggtttcatgtgggggggttgtgtgtggtgtgtgtctgtggtttgtggtgcgttgttggtgtttttcggtgtgctcttgggtgtgtgtgtgtcgcttgtgtttcagccgctggtggtggttatcgggctaccaagtgggaggcccagggcccctgttaggttgtgccgaagcaaacaaagagggagtttgtagggggggaccaactttttaggaactgtcgtaaagggagtccccacagagtgtgtgtgggtgcgcaaagaagatagcccagcggcgtttggtgtaaagatgggctggccccgagggggacttgagtttacacgggttctctaaaggggtttcgcgagagcccattggagttggcagaaatgtctggccaaacagaaggagggcgccgacaccttgtccgataagtgggagacgcacgctctgcccaaatggtgatggcggcaaatgggtggcacaagttgggatgggtgctcggtggcgcggaacgtgggatctcacaaggtgtgtctcgtggagtctacaagaaggaaattatagcgcagaaccgtatcaagccagcgtggagccccccaagtgtacgtttgatagggcgccccccaaagtttctcgtgtgcgcggtatctccagggactggagttcccaccgcaagagccttgtggggcatggagacccggccaaccagacagagccaaagagtgttctcgtgggtgggtccagttaagacggagaatctcgggcccaacgcgaagaccgtgccacacctctcatatatggtgcgggacaccacccatctcacaagaatgctctgcgaccacaagcgctagcagccatctagacaccatgatctcaccaagaacaagttccgccccagacacatgcgcatggccaaccatctcccatgggccagcgccatctctgcgcaacctagaagcactgtgatggtgaagaaggataacggacccgcccccccaagagctcctgaggccccctgcccccagagccaattaaatcaactggctttttcc

SEQ ID NO: 527057 - DNA, 251 bp, Homo sapiens
  misc_feature (133)..(133): n is a, c, g, or t
  misc_feature (183)..(184): n is a, c, g, or t
agtcacggagactctcctgctgctctgcggtttttgggctgtgttgacatcaaggatctaccagtgtctgagcagcaggagagagccttcacgctggggctagcaggacttctcggcgagggagtttttaacnttggagaactcctcatgcaccctgtgctggagtccctgaggaatactgannccggcagtggctgattgacaccctctgtgccttcaacagtggcaacgtagagcggttccagactctg

SEQ ID NO: 527058 - DNA, 346 bp, Homo sapiens
aatgaaggggaccctgatcgacaatcagttcaaataatcaagatctttctgggttcagactggaggcagcagttagatgaggaagagtagcttcaagatgtgttttcgtttctgtttctcccagaagggttttctgaccatcctattggttttctgacactttttcttttcttccattgaagtccttgactccatttcacttgctttctaggaggtagattgtttgtaaaatctcctgtatatatgttttctgtctttcttgtctttgagatcaggtcttgttacataccagagtatggccttgaactttgtgagcctcctctcctgtcttagtctctctctctct

SEQ ID NO: 527059 - DNA, 236 bp, Homo sapiens
atttcacttcttactatttcttgagacagagtcttactctgccacccaggtgtggagttcaggtggtgtggtggtctcggtcactgaaacttcacctcctgggttcaagcaattctcatgcctcagcctccccagtagctgggattacaagcacgtaccagcacgcctgtgtaattttctgtcattgcagtgcacatggggtatcgacatgttgcgcagtttgttctcaaactcct

SEQ ID NO: 527060 - DNA, 295 bp, Homo sapiens
gggattgaacccaaaacctcatggttcctagtcgtgatttgttaagccaggagccacgacgtggaactcccaggccaggggttgatagtcactagctgtttccgtcgtgtctacaccagagccacagcaacgcgggatcccagccgtgtctgcaacctacaccacagctcacagcaacactggatccttaacccactgagcaaggccagggatcgaacccaaaacctcatggttcctagtcggatttgttaaccagagccacgacgggaactccgttcacttaatgccgctagcg

SEQ ID NO: 527061 - DNA, 921 bp, Homo sapiens
aacactggaaaattgagagaactctcattacatgttcttaacacaataacaatcataataaaacaattctaaagatgaataaacataaaattcaagcatagtgtatagtctgaggagaaggccacatgggtcatggtgcaagcacacaggtggatgtggccagtagtgtaatgttctagtatcttcaagtaaagtaagtaagaggttcatggcgtatcactttctatacatagcgctattatatacttaatcttttgagatcaacctaacattaccttaaccacaacaggtaacaaccatctgtctacaactcaaagtgcatgtcattaaaagtggaaacaaacaatgtacacttgaagaggaccatggtaaatgtaatatgtatcattttatatagggggaagaaaaattataagatatatagataactagtaaacaaaaataaaagaataatatactaaaatttaaggaaaatggcacatacaaggccatacgaatcaacacatccacagctgtacaacagaaacgacaagtgaccaggactagcaagatggctcaaaacctaatactacatccctaagacaataaagcgaacgagccaaaaagacagggagagaacaacaaccctgaagggccaagagaagaatgagaaaccagccaataggcccaacaatgggcgaaaaacacccaaagcacgaacaacacaaacaacggaagacaaaaacatggagatgaaagagtgaaacaacaattaaggcacaaaccggagatacaaacgcgaaagacaaaaacgacaagaaaaaacaacaataaacacacacaagccaagagaagaaaaaagagacgagaaaaaagacaacaagaaacaaaacgccctggagaacagaagggaccacaaatgacaacaacaacacaaaaaac

SEQ ID NO: 527062 - DNA, 546 bp, Homo sapiens
  misc_feature (57)..(57): n is a, c, g, or t
tccgcttctccacccacccctcctgcatgcaagtccttccccaggaagctgagcagncaggcctcatgggtccctcttggggcacctggtggcttcatctcgggatttggcttgcttgatgccaagtcctgtctgtgccctggaggtctggcccggtttcaagtgcactgaggggcaggtggctgcaaatcgcacttcctcccccgggcgtaagcttctctctggtgatgctgcttatgggctgggggcttcctgtgggccagactggtccctggactgcagggtggccacggggctgaggtctccgctgcctctctgggcagcccctccccaccatggtgcctgggcctggggtgcctctagcaaggctgggttcgctctgggggcctctggtccgagtgtgcatatccgctacagggacaagctgccccgagcaggaggtgggggattctgggctccaaagggcagaaggcctggctctttggggtgggccttgtggggttgctggggtcaggagctgaggtggtcgtttcccttccagaggcc

SEQ ID NO: 527063 - DNA, 1168 bp, Homo sapiens
tttccaactttccagaagtttctcgggacgggcaggaggtggtgtggtggactgccatatatatgatccctggtgagcagggtgagctgggcataagagtagaatctgatgtctgctgtgctctgagagctgagatgtcactgtccctggctgctagcccagccctgacccagtgcccaccgtggtgcacgcaaaccacttcctggccatgcagctccctcctgcttctcagactgccttcttgcctcctggaggctggccctgtgccgccgaggtgaagaaacctgcagcctgaagcagctcctgtgcactgcggagaagtatgagccccaatggctggacacgcttgccgagcgcagcgcctggctggccattcagcttgtaccaggccatggccaaggaccaggcagtggagaacatcctgggtgtcacaccgtggtgcgtggactcgatcgactggtggctctgtgtcagctggcccggcaatcgtgaccacaggacgtacgcaaggccaagtgcagtgctggagacgccgaagcagctgcagagaacgagcgacggtgcacgcccgggccttgggcagagctgctgacgcctcaactccagcaaagatccacgggcggcgcaaaggtgacctgggaacgactggcgcagcctcgactcggtacgagcacccaggcacacggtgcaccctccagccagcatagaccaccacaagcggcaagacaagacaaagaaagcaaaacacacatgggagacagacacgcccaagacgcacattgccggaaaacacgagaccacagcgacaggaagcccaaacagacacatgggcacgcagcccacaaaacccaccgaaacagcgacaggcactgcgcacggcaggcgaccacgcagatggaaacgggacgcacgggcgaccgagacaaggagaggcccccgcgtgaggtcaacgcggaccagtaccaagccaacgccacagacaggcagatggaagaaagcaaccaccagaaaacgaaggaagggaaccaacgcaggagcaaatgcaaacgtcggcaaccaaaccgcagcggcgcctcacacataacgacaccacgaaacccgacacacacaaacaagcgagaagaagagcaaggaagcagagaagagacgaaatcacacgcgcacaacc

SEQ ID NO: 527064 - DNA, 170 bp, Homo sapiens
atcctaagctttggtcagttcatcctcactccccatatatgaccgggcaagaagaagatggtggtgatgcacccaatgccccgtgtcaacgagataagcgtggaagtggactcggatccccgctgcagcctacttccgccaggctgagaacggcatgtacttccgcatgg

SEQ ID NO: 527065 - DNA, 370 bp, Homo sapiens
gtagagcataattgtgaccattacgtattgtctttattatgattgattatgtatcactctccggagatgttgtatggcgtttccactttgacacacgggagtggatcatcgtgatgtttaataccgagtgtcaacttgcattggatgcaaggatgcaacgtattgatgctgggtgtgtctgtaagggtgttgctcatggatattaacatttgagtcaatgggctgggaaaggcagaaacacctttcatctcggtgggcaccatctaatcagctgccagtgagtctagaatataaagcagtcagaaaaacatgaaaagactagagtggcctaacctctcagcctacatctttctcctgtgatggatgcttc

SEQ ID NO: 527066 - DNA, 757 bp, Homo sapiens
gatgaaaccccatctctactaaaaatacaaaaaaaaaaaatgggccaggctgggtagtgcacacctggtaatcccatctattcgggaggctgagacaggagaatcacttgaacccaagaggtggaggttacaatgagccaagatcatgccactgcactccagcctaggcaacaagggcaagactccatctcaaaaagagagagagagagatgtaatctacataaaattcacacgtttggaagtggcacaatccagggttttaaatggggttcacaaatagtggggattatcaccacagctgggttttagaacattttcatcaccctaaaagaaagcttttacccttcagtcaatcctcatttctccccaaacccccaagcccctgggcaaacaccattctactttctggtcttaatgggattggtcatattcgggacgttggatattaaagggattcatacaaggaaaaaaaaaaaaaaaaaaaaaaaaaaagtgtgtgtgggggcggctggggcccctggaaaaagttttataagaaccttggggtggggacgcgggggccccaagtgggtatagggaaaaggggcccaaaggggttcccagaaaaaaccggggcaagacaaggggggggattttcccaaatattaaaagaggccgcggggggaaccagagagtttgtggaaaaattccgaaaggggattcggggaggcaagagggagattttaaaagggggagtccaaggagctgaattcaattg

SEQ ID NO: 527067 - DNA, 837 bp, Homo sapiens
tagtgttaaaaacaaactatttaattgtaaaaaaaagtttaaagtctggtttccaaactttgctaggggttctagttaactttagctgttttatatttggaaaaggctttaattaggatctggccccatttacaggtactttcttaggatgtatgtatgtaaaataaagctttcttataaaggcaaaaaaaacaaaaaaaagaaaaaaaaaaaaaaacaagaaaacaaaacaaaaaaaaaaacaaaagaacaaacacaaagagtgggcgacagggactcccaccaagaagagaaaaatttagtccaaacacaacaccggtaggtgggcggcggacgccgccaacaacaaagggaagagaagaacacacgcagcaggaagagcacagctccgcctaggaaaacagacggcgcgataacagacaagacgtaggtggagagcggccccacaaacaaaaaaaagaaaaagcagcgcggggagagcaaaaaaaagaagggacagaacaaaaacaaacccaccggaggaggaaaaacaggagaaactcaaaccaaaggcgcgaaccaaaaaaaaaacagaaagaaacacgcaaaagaacgagagacaaaaaaacacaataaataaacaccagacaacggagagaaagaaaaacaagacaaaccaggaagcacacgacgaagctacgaaaagaaaagacaccagaaaaaaacaagagacgcgacgaacacaagacaaacaacgaacgagaagcaacgacaacaagaacaatccagacgcataaaacaaaagaacgtgagcaataagagccgaacagaagaaccacaagaaaacagaagcagaac

SEQ ID NO: 527068 - DNA, 329 bp, Homo sapiens
ggtgtagctacagctggcatctcacggagagtgcccaggaacgctgtctgaacatctgcagtgcacaggagagtcctccacaaacaacaattagcagattttaaagatgtaacagaaagaacaagtggatcctcttcagatgaaatagcagcaggtgaatggacttggccagggacttaattcagacgctgcaggaaaacgacctgtgactgtacagggctttcgaaccactgaccatggacacgacgactcacatcgctcgactggacatacacttgaagtaaacacagggtcgcacaaacgacattgcacacgctaaccggaacgct

SEQ ID NO: 527069 - DNA, 2782 bp, Homo sapiens
taaggatctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527070 - DNA, 2677 bp, Homo sapiens
  misc_feature (13)..(13): n is a, c, g, or t
ggaggcgcgcggncgcgagcggacgcgcctccccgcctaggtgctggccgagcgcggggcgggcaggcgagcgcggcggcggcggcgagcgtggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527071 - DNA, 2662 bp, Homo sapiens
agcgggtgcgagcccaaggaagaaaggccgacccgtgtgggacgcacacgtgggagttcaccggacatctgtggacaggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527072 - DNA, 2857 bp, Homo sapiens
taaggatctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatccctagacagtccagggaccctggcctccggctggccccagctggccctggctcaccctgtccccttggccacaggtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527073 - DNA, 2509 bp, Homo sapiens
taaggatctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527074 - DNA, 751 bp, Homo sapiens
ggctggtccgcatgtggtgaggctctccgctctcgaggcactggccaggttatattgtagacatagttaagtccgcgatgccactctacccggaagcagtgacaccgcttgagttgaacaagacttggggcactgcatgtgaaagctcgcctgtacacacataatgtactgagctagtgtcatcggatagactccatgatgacttaaggcctacagcctgagggagggagtgatgcagtgcttactacctccacaagatgggcattataggtggtcgtgttcgagagtcctaataactaaacttaggattgcctagaagtcgttgcaatgcatgtatgcagacgattgaacaacagtccatcaatgaattcgcacgaggtgtggatagaccggtcgcacaattggtcaaacagtgtaatgagccgagaacgcagtagacgtagagctgcgttgacgacagggatagtagcctgtcgccgtacctaatgaaggaaaggtaccatatacatggtagagcaacttcatacaaacagctgaagctcaccgcataagtctggccatcctggcaggaacggggacttgtgcgagcactgattgagaagagtcctgtctcagtaatgacgcttctgagtctactagctaccatgaaggggctgggagtcgacggagggactctctcatgagaatcatcctgtcaagagcccaagcaagagcttgccggcaaatgaacccgcagtcttcacagcggact

SEQ ID NO: 527075 - DNA, 2417 bp, Homo sapiens
taaggatctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttctgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaa

SEQ ID NO: 527076 - DNA, 387 bp, Homo sapiens
gatctgctgtctgtcagtatctgcctcacatctccagcagtatcagtcaggtctgaggctcgcatgaaggccgtttgtctgggccatttagctgccacttccctttttttatcagctcatatttcatgccgcctgttcaaaagtttttggaaagaaaacaatgaaaaagtaacacaatctctcaaatatttattgagtatctactatggctcctctggaggattacagaacaggtgattattcttgtttgcattttatgtgtttagaaaggtatagtttggaaatttagaatgaaaacatattcctctttctcagttcattccttccacacccccaaagaattctccgaggaagggtgcgaggctcttccaggtcttttcacgtgct

SEQ ID NO: 527077 - DNA, 1873 bp, Homo sapiens
taaggatctgggctggagtgtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggccccgggctgggcgggcaggtggacataccccagtcacagctcagtctcacagcatctggcaaaggcccaaaactattttgatctgtggccagggttcgcctcgcttccagcggttgtggtggggattgactggtctggcgctgaagaggggctgcccctgtgcgacccgagtggcggtggtttggccccctgttgggggccccgggcggggtttttttgcggggggc

SEQ ID NO: 527078 - DNA, 156 bp, Homo sapiens
cggtggccagagttaatataacttgaaatttgcgaagagagtagcccgtaggcgtctgtatctccaaaaaaacggataattgtatgaggtgaaagatgtgtattaagttgattgtgtcatcagttcccaaaataaatcatcccgttgtccccctta

SEQ ID NO: 527079 - DNA, 530 bp, Homo sapiens
gacgacggtgtactggtcagtttttggttcgttggtctgtatgtgagacggagtctcagtggcgtgacagagtgagactcggtctcaaaaagaaaaaaaaaaaaaagaagtccacagggctgccaggtgcaggggttcaggccggtaatcccaacatttggggaggccaggggggggggatcaggtgaggccaggagttggagaccaagccgggccaatatggtgaaccccggtctctactaaaaaatacaaaaataagcggggtgtggtgggcacgtgcctgtattcccagctactcgaggggctgaggcaggagaatacattgacccggggagccagagtgttgcagtgagtcggagatctcacaatggcactccagccggggggaggggagcgagagtccttctcaaaaaaattaattacaccaaaaaaccaaatgagaaatggtaaaataaccgggtcaccggggtgaaatgggtatcaggggaattctccactagaagtctcggagttggagggttttggaaatg

SEQ ID NO: 527080 - DNA, 669 bp, Homo sapiens
  misc_feature (417)..(417): n is a, c, g, or t
gcgggctccaggcaggccaccccaacagcatcttcctcatcgaccacgcctggacgtgccagtggtggcagcatgcgcgccagcaggctgcagcaggtgcccgggctgctgcaccggatggccaacctgatgggcattgagttccacggtgagctgcccagtacagaggctgtggccctggtgctggaggagatgtggaacgttcaaccaggacctaccagctgggccgcatggcgaacacgcgtgacggacgacagatgccgggtgtgggtatatcatggacgagttcggttcgcggatccagcacgcggacgtgcccagcttcggcgacgggacccttcttgctacagtgccggcagcgaggtgggccctacactgctgtcgtgtggcccactgaggggcacctggtgacagctnggacgaagcgagcgctgacgcctgacgacctctgtggaccttaactgggacgcacggaacccgtagccgcctcctggaatcctgggacacgtggcatgactgcatgcccctggtgccccctacctgacatgctggacctcagctcttgcacacccgagccggccgccgagcactaccagggccattctggacggaaaacaaggacgaagctggccacttggacatcaaaccccgttgagtgcagccctcctc

SEQ ID NO: 527081 - DNA, 611 bp, Homo sapiens
  misc_feature (3)..(3): n is a, c, g, or t
  misc_feature (201)..(201): n is a, c, g, or t
  misc_feature (608)..(608): n is a, c, g, or t
tcnttagatcccggtcccagcacagtttctgttgggatgatgaaaatgttctagaaggatagtggtgatgatgcacaacaatgtgaatgcacttaatgccactgaattgtacatttaaaaatggttaaaatggtcaatttcctgtcatgtatattttaccacagtttttaaaaattcctattttcatagagcctacatttnggaagaggagatagacaataaataaatgaacagataatagaccaagataattctagattatgataagtaaaatgaaggaaaaagagggataagatggagggactagaggagtttattttggggtcctcaacatgtgtttaccaacagcagcttggtacccctagagaattaagactaagagaaaaatcttgggagacagggctagaaaagtagttggaggccaggatccacattatggagaatcttgtatattaagatgctttggctttgtcctgagaatcaacgaagaaaggcagtcatgtggttagctttggccacagtgcatgggaagcattggtgggtgaagccagatgcagaaacacatgtgtaggaggctgtttctgctattctgctctgtggagggaggnctc

SEQ ID NO: 527082 - DNA, 126 bp, Homo sapiens
atatgtagagaaagtggaaaatagggcacgttgcatattatgttagttaaaaagttatatgtgttatgattttttcgttcgcgtttctatttggtgaatggacgttttacatttgtctgttatcaa

SEQ ID NO: 527083 - DNA, 946 bp, Homo sapiens
cgctcctaacaccgccttccctctctcattctttccaagtctcgctctcctataaccttccctatctctcctcttctccacgtcactcgcaggacgtcagcgagtttcagactccacaccatgccgttccccgggcctgtagacatcatctccgaacccccattggctttatgtcgccctcttcggctaaacttggccacctcatggacttaagccagattgtacagtagttctaacatatacacggttgtcactcttaacatgtacatgcgcgatttttctactagagactgatgtccacagacatggtcaaagcaaaatgcttttatgtgttttgcaccaagaatgcgccatttgtaaagacaatgatccgtacaagaggacctggttaggggcagtaaattctagggcagtcactaggagatacatggtggtccgccttgtgtcaaactactgcaagacccccgttacttcgcgaagttcctttcttcaggtccattgcagcctcctgatttaccactctgccgataaaggctgttttctctctctggtacagggacggttatccctcccagaggaatctttatgacctcgacgcatgcagaaagggacaggtcgtctagccctttctgacactccaatttctccaatgtgtgttgtaatttgcccataatcacccttagccaatttggcaaattttgggagtggtatatccttcagtcccttagctactttgaagtatttggtggtgatattgaattattgtggtttatgtgttttaattatcttgtataattatctcatataatttctcatatgaattattacttgcctgacagatgcatgtggtcttttagcattttgttagcatttgcaagttggccaactgttctccttatatacatcattctctccattgaatatcagtgcaagtgattcaagctgg

SEQ ID NO: 527084 - DNA, 122 bp, Homo sapiens
gaggtagtggacagtgtaaccagaatcttccccagcatgtcatggccacaacaactgacgcagcccagcacgaatcccttagcaccagcacgaattcccttagcaccagcacgaattccctt

SEQ ID NO: 527085 - DNA, 234 bp, Homo sapiens
cacgaggccccgccaaacgctccgcccagtcgctcgggcggaagacgcggccatcggtggtgatcccctggatgaaaaactcgcggggcttggaggtcgtcatgggcgggaggtgaatgggccgcttgtggcgggttgcgagcgggatgcgaagtgtaatgtgcgcagccgcgacttcactcctcgaaatgatatcttatataagagtgtcgtcgcgcctggcgggatggaaat

SEQ ID NO: 527086 - DNA, 674 bp, Homo sapiens
gatattccccttcctgtgtccatgtgttctcattgttcaattcccacctacgagtgagaacatacagtgtttggttttttgtccttgccatagtttgctgagaatgatggtttccagcttcatccatgtctctacaaaggacatgaactcatcattttttatggctgcatagcattccatggtgtatatgtgccacattttcttaatccagtctatcattattggacatttgggttggttccaagtctttgctattgtgaatagtgctgcaataaacataagtgtgcatgtgtgtttatagcaggatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctgttttctccacatcctctccagcacctgttgtttcctgactttttaatgatcgccattctaactggcgtgagatggtatctcattgtggttttgatttgcatttctttgatggccagtgatgatgaacattttttcatgtgtctattggctgcataaatgtcttttgagaaagtgtgatcctcttagaccctgaactggtttgggggaatggggaatgga

SEQ ID NO: 527087 - DNA, 520 bp, Homo sapiens
gtcactcgcgacgtaaacgctgctataatcatagaaacttcgcttacttgctgcgtggccaacgcagggatctagttcagactatgaacaagggcgctgttcatcagccgaattcaaccgtgtagaaggaagcctttgtatgaaatgctcatcagttataatacactgttcaacgttatcgttaaatttgatatgcctctctcgtggcttgcccattatatctctccttttgcgtgccttaaaccagcttctccaaaaaaggttctccaatctttgatcattgtccactttcttgtgtttttgtaacggtaaaacattttcattttttacagtgttgttcgagcttctcacatgcttattatttttattgtaattgtttttactactacaattaataaacttgatgaatttccataaatttaaattcaagattaaacttctttgctcgtgaaagtcgaaatttttcttctttactgctggcaacatgcacatcttttctgtttatttcccagaataggcg

SEQ ID NO: 527088 - DNA, 605 bp, Homo sapiens
  misc_feature (137)..(137): n is a, c, g, or t
  misc_feature (605)..(605): n is a, c, g, or t
tggaagcagaagtggcttaatcagggggtgaagtcctcaatcagggggacctcacttaaccttgggtggggggggtctcagcctaccccccacaagccctgaggcccctcaggaaggggggagcagttgaacaacanaattatgggcgagagggccaggtggaattgggtgattgtggtgggaacccggggtcagggtgaagggggcatggacgctgaaatgggtgggagtgaatgctgaagtggggcatgtgaagagtcttaacccaggtttctaccggggggctggctgcagggtggctgtggtgcatcgggcagaaggggccaccagaagggctgagggctcaaaggggcacagcgagggggaaagggaggtgcttaggagacatgagcgcgacgtggtgaagcgtgggtgcagctgtgctctccttgggctcagccaccaggccgggtggtcggcggtgtccaaaaacacatgcgcggcgacatttgaagaaggtgtccacttttggcgccattgtgtaaaacgtggggtccatccgggggagtgtccttcctttgtggccctggagggaaagtgctggtgaaggggaacgggtgggcaan

SEQ ID NO: 527089 - DNA, 517 bp, Homo sapiens
cactctccagtccggatggaacgtcgagcctctgccttggtggacgttggttgtctcggtgattccgttggcatcgtggttagctgtacggggtcaaggggcttgtggtctctgccgcgcgcagtatctcctgtgggatcgaggcccgtgcctctcaggcggcatggctagtgaatcctggattgcgaggtgtcgcagactgatggatgaaagttgaagcgctgtgcgcggaatgtagctagcctggtggtgggttttgcgttgtcctgccgttttgctcgtggtgtggtcgagagcagtctgtgctggttgcttgcgcgagacggcgcttgccttggttcccatgcgctagcagcacgatatcatgagcgcaatactcagaagcgcgtatgtcctggcgcatcaggctgtggggcttctgtcttctgggtgatagtggctcagcgctccgtggagtcagccatgcttgccagatctagccggtccccgtctggggtgcccttggggactacctgct

SEQ ID NO: 527090 - DNA, 326 bp, Homo sapiens
atgcggcccatcaagttgcaggaccaggcccggcgcagccgctgtgtgcgtgacctggtgcactcgctgcccgctaccaaccacgacactctgcggatgctcttccagcacttctgccgggtgatcgagcacggcgagcagacccgcatgtcggtgcagagcgtggccaatgtgttcgggcccacgctgatgcgacccgaggtggaagagaccagcatgcccatgaccatggtgtaccagaaccaggtggtggagctcatcatgcagcagtgcgcggagatcttcccgccgcactgactgctggcctgtgactggggcggcggccg

SEQ ID NO: 527091 - DNA, 275 bp, Homo sapiens
gaaagaaaggaaaccacaggaaagggacctacctcttttatcatctaggtatttagtactaatggtttagagcaggaattgacaaactgtggcctggactcatggcccaactctggcccaccacctgtttctcagaggaaattttattgggactcagccacattacctcatttacatgtgtcctcgcctgcctttgtgccagtgcagacctagtagctccagcgaggttgtccctctggctttaattacaacagggcgctttaaggaccagaact

SEQ ID NO: 527092 - DNA, 267 bp, Homo sapiens
ttttggaaatttcccccctgaagccctcgggggcccccccctcttgggggatgaggccccagggattcccccccccttttgggaaccccaggtgtccttttattatcccccccctcccaggctccccccccgggggttggccgggaagattttggcctagcaaattgggtgggttttggggggggtgttttaaccaaagagggtgggggttgcccattggctttttttcccgggggggccccccgggttggaggcaattttacccca

SEQ ID NO: 527093 - DNA, 536 bp, Homo sapiens
tgtatggctgcgagcttggggcccgacgggcgcctcctccgtgggtatgaccagtcctgcctgcgagggcaaggattacatctgccctagaacgaggacctgcgctcctggaccgccgtggacacggcggctcagatcacccagtgcaagtgggaggcggcccgtgaggctggagcagtggagagcctaccgtggagggcacgtgcgtggagtggctccgcagataccttggagaacgggaaggagacgctgcagcgcgcggaacaccaaaagacataggtgacccaccatcctgtctctgaccatgaggccaccctgaggtgctgggccctgggcttctagctgtggggagatcacacttgacctggcagggggatggcgaggaccaaactcaggacaccgagcttgtggagaccaggccagcaggagatggaaccttccagaagtgggcagctgtggttggtgccttctggagaagaggagagataccggtgccatgtgcagcaggaggggctgccagagcccctcagcctgaa

SEQ ID NO: 527094 - DNA, 194 bp, Homo sapiens
acggacgcatggcgcccgaaggagtatgaaatgtgtgaagtacttgctctacgtactcctgctggccttttgcgcctgtgcagtgggactgatatgccgtgggtagtcggggcacagcttgtacctgagtcagaccataatccagggggctacccctgtgctctactgtatgccacgtggtacatcaatacgca

SEQ ID NO: 527095 - DNA, 868 bp, Homo sapiens
  misc_feature (414)..(414): n is a, c, g, or t
gcacagagagaggcagcagcttgctgcagcggacaaggatgctgggcgtgagggaccaagggctgccctgcactcggtggcctcctccagtccagctgctgaccaggggacttctagagccgtgcatggccagccaggacctgtgtgtgggaggccctcctgcgtggcttggggtgacgaatctcaggctccaggctacgagggcatgaccggtgaggatcgacagaggccgatgctatggatcctgacagttggatcaagctctgagaactagcctcggatgtcaagaaccctagcgcgaaagcctcgtagtccccaatggcagaggcttcagaacaggtgggggaatccctcatcagtcatagcacttactgagcactgagagagtatcgatcatatgtggtatgtcctcantcgaggctgagttctgagataacaatactgactgtcctcatgcgaggcagtgctactccatcgttcatcgccgagtgatagcagacgtgtgtgactggagcagcttggacttgtcccctatgtgcgggaaggacgacggaagacgactgatagtacaacagagacgtttcccgcgcaagggccctgacagatggcaagatcgcgaacatctacacgagagagacgaagtacgacacatgacagggtgcttggaacatcagtgactggcacggggaaaactggggattctcctgaacctggtattcgggaaagggttacagcagtaacgactgctctggtgaagaaaagactgtacgtgcctgcatggagtctacagacaggaagacccagatttacagagggtgagaggactaggggcagaccagggatctggaatgtagtagaaagtgcgaaa

SEQ ID NO: 527096 - DNA, 752 bp, Homo sapiens
cgagcccctgtgtccccactgtggggcagcagtggcggtgtgggtgtgctgaactgcggagtggtggcggagggagccctgctggctggctggcagacaggttacaatgctgaaattgtgctgtgatgcacctgtggctttgacaccccgtgcggcatgaattcaccaaacgcctgaatgcaagcttgacatggaccgcctactggaaccacccccagcaagttccctcgatgatcggattgtgaagcaacaccgcaaacggtgggcggtcggccgaggccgctatcaccagcttaccgacactccacggggtccaccgacaaacatcttacgctactgttcacgactgacaacgacatctaactgtcagcacacgaacgaatacccggtgacatttagacaattgcgcttggcagaaaggtgccttcaacgacaatgacgagagcacagggtccgtaagttcccacacggttcccttgggtacacgccggtcatacgccactccgactatccccaaattatcgaacgtgcgaccgactgggaccctcttaggattgcacccacttcacactttgcaggaacacgcaatccccacggggacttgccagccacgtattatccccacaaagcgtcgcatggtccatcccttctggcaaacacgacccgaacacgttcggctcccacattgttctcacccacaattcacgctcacttagatccacacgcatctacctccatcctagcctacagcc

SEQ ID NO: 527097 - DNA, 289 bp, Homo sapiens
gagtgagtagcatccactataaacccggctccagatataatatggacgccagtctcttctgcgacgcctcttcatacgtcgtgtagtctcggctaatcccagtgttgtgttcccaccagagcccctccaccattagcctttacaataacaacagttcttccttcatggcttctgtctcctgatttaattgaaggtttcttgatgggaataggcgtttttctgaatccaatataaatttttcatcacgataggttctttggaaatagcttcctggcacgggggaggtgga

SEQ ID NO: 527098 - DNA, 265 bp, Homo sapiens
agtcctagagtatcccaagcttacgaggggtctgaaaatgatagaatgtagaagatacttgtattaaaaaaaaaaaaaagaagtagcttggtctttctctgtgcagggttagttttaagatttataatcttatttgtttggaaacgttgggcaaaattttccacaggaattaaacaagtttactattttaaaccgtgaaccaaatttagttaaattgcacaagcaaggccatttagtgttgttatttatattgccaggctttctt

SEQ ID NO: 527099 - DNA, 726 bp, Homo sapiens
aaattcccgggcccaatatgagccaactggggctcgggggagaaccccgatggggaggttatgacaagtgatctgggtttcaagacacgattgtatgagaggagcactccccacgtgggtgcccaccacacaccacgttcctgtctggtaggtttgtgaagccttcttgaagtgaacggaacggtttcaccacgagtgtgaggaacgtacacggtccacgtcccctggaagaatcgaacctggagctccactgaggaaaattctgaagggccacgcttggaggaaccacacctgaagggaaggttggagggccccctaatacgccctatcacgagtggaggcacgctcaaaacgggagatcctgctgcacccctgagatcacagaagctggcaccacgacaccgggcagagggacaagcgccaggccccgggagatatgtaggccctgctgtacaatcaaggtcaagactggaggctgagatcgccacactaccgccaccctgtctggaagatgtgcgaggacatttaatcttggtgatgcccttggaccagccagccaacgtcccatgccaaacccatcccaaagacccccaccccccggatagatggatggccaagatggtgtttgagacccatgacaacccaagattttgaggccattaagcccagccagaagcagggtaccctttggggagcaggaggcccaataaaaagttcagagttcca

SEQ ID NO: 527100 - DNA, 913 bp, Homo sapiens
  misc_feature (785)..(785): n is a, c, g, or t
ctacttgtgtgatgacgcgcgcatgctttttttggtgcctcttatcgaggtctctccgtgctggtccgaataaattcgctgggtttcttctcatatctgcccggggggattctctcattggcggttatctctggtgatacccacccaatgggtcgcttcttctcttggtttgtctcgacgctaatccgggtgctgttccgtgtcgctgtaaagcttaatgtgggacgcgcccccccagcgcgcgacagtttttcctggaaatcccccttccggggcgtacgtccttctctccctctctggcgtgtgtatccgctccgggagattatagatttagtattgaatggttcaaggccccccgttttcccgctcgtatacgtgtagggtgattttgttccctgcgttccgcacctggagcttagttatctttcgttgggcacaaaacactgctgtgagacagatctggagcagcgtaagctgcttcgtatgcagccaccacactaattgcccataagagcggtcttatagttctctactttgttatgtgctggacagacaagttatcggtggtgtgctttcacaaacataacatgggagcaaagaaagttttgcatgtccttctctcctccctacaaggaagtaatgcccccgaggaacaaagattatagcggctacactgtagaaatttatatacgcgggggatgtcaagaccgtggccacaattgagtgctccttgcccgtagaggggtccctcttctgaagaataatgcgtgctcggggcgttcttnaagcccagatgcacttgtggtacaaagcacagattcgggccaaactgctgtgagcacaggaggtgtcaccacaccgcggaggccccgcgaccgcagggggtattaaaacaacccggcccccacataac

SEQ ID NO: 527101 - DNA, 224 bp, Homo sapiens
tgttagcagccagctatgaaagatgcaggtggatcagtcctctatgccctatctagggaacgctttgtcctcgccacaatctttactacctaccccataggcatttgcattacccctagattctgtgccacctaccttttatggaaatacagtccttgggaatatgaattattgatgatgaattggggatgttagggaaggcaaagattgtcatatatggatgc

SEQ ID NO: 527102 - DNA, 173 bp, Homo sapiens
tgtgctagggatgacacacagagcggtaagagctctcgtagcgcctgcatctacacagctgagcaccccttcatatgctcaaacccaccgaccaccagcatggtgtgaataccatagatgcggatgttctccacaatgtactccagctgcccttggcatgggtctcttggtcc

SEQ ID NO: 527103 - DNA, 194 bp, Homo sapiens
tcttgacatgctgttgactcttgcatatcttttgcgccattcagctactgaggcgggaggatcgcttgagcctaggaatttgagaccagcctgggcaacgtggtaaggccccatctctacaaaagataaagaattagccaagtgtggtggtgccatgtttgtaatcccagctgtttgggtactacgctttggca

SEQ ID NO: 527104 - DNA, 284 bp, Homo sapiens
cacatatatatatgtgtatatatatacacatatatattttaagaatcgctatgtcgggagcttaaatttgccctttaaaagcagattacagcctgagcaacatggtgaaaccccatttttaccaaaaatacaaaccagccaggtgtggtggcgggcgcctgtggtcccagctactagggaggccgaggcgggaggatggcccgaccctcggaggcagaggttgcagtgagccaagttttgcccctgccccccagcctgggcaacagtgagcccccgtttcacca

SEQ ID NO: 527105 - DNA, 301 bp, Homo sapiens
aatttacacttaagtggttaaaatggtaaattttatgttatgaatgttaccacaattttaaaatatcaatcaagaaaacaaagtattggccaggtgtggtggctcatgcctgtgatcccagcactctgggaggtcgaggtgggcagatcacgaggtccagagatcgagaccatcctggctaacgcggtgaaacccagtctctgctataaaaaatacaaaaaattagccaggcgtggtggcaagcgcctgtagtcccagctacttgggaggctgaggtaggagaatggtgtgaacccaggag

SEQ ID NO: 527106 - DNA, 240 bp, Homo sapiens
tctgtaaatagttaagtatggacccgaggccctacttttgatttattgcaatgttcagtcctagtttttacttttatttttaaagcattcagttttgctttcaattttatggaccttagttttgagttaaacctgcaaatgtgtacaaatagttcatatttatgtattgcccataatcatgctattcagccttgatgctatattgtattatgtaaataataaaaaccatgtccagaggga

SEQ ID NO: 527107 - DNA, 220 bp, Homo sapiens
cgctctcgaggatcccaaagagtgtcactcaagacgtaggacccgtggtccgcgggaaaccattcccacgctgctcgacaaaaacacttgggggagaatttccgcaggagcttcgatttcgacaacgatcttgtagtcacagatcaagcgacaggatccggagacgtccaattcgagcagaacaccaagcttctggccagtcctacgtcttgatggacag

SEQ ID NO: 527108 - DNA, 279 bp, Homo sapiens
  misc_feature (129)..(129): n is a, c, g, or t
ccccccccccccccccaaataaatggccctgttttttcaggcctttttatcaactgtaaaatgattttttggcatttaaaaaaaaggggtggtttgctcccccggagtttttttccctttttttgccanccataaccggaggttattatttttatgccccgcccccctcctcttttttgaaaaaaccttgttcccttaaaatgtttttttttggggttggggcctttccccccaaacattggtttggggccaaaccccaaggccaccaaaaatttttca

SEQ ID NO: 527109 - DNA, 241 bp, Homo sapiens
  misc_feature (22)..(22): n is a, c, g, or t
  misc_feature (30)..(30): n is a, c, g, or t
  misc_feature (81)..(82): n is a, c, g, or t
  misc_feature (93)..(93): n is a, c, g, or t
  misc_feature (97)..(97): n is a, c, g, or t
  misc_feature (112)..(113): n is a, c, g, or t
  misc_feature (116)..(116): n is a, c, g, or t
  misc_feature (148)..(148): n is a, c, g, or t
  misc_feature (163)..(163): n is a, c, g, or t
  misc_feature (169)..(169): n is a, c, g, or t
  misc_feature (181)..(181): n is a, c, g, or t
  misc_feature (195)..(195): n is a, c, g, or t
  misc_feature (213)..(213): n is a, c, g, or t
  misc_feature (221)..(221): n is a, c, g, or t
  misc_feature (231)..(231): n is a, c, g, or t
cagcagtgcagtgaccccagtnccacccgnatccctcttgggctcaggcaccaagcctccaagtggggctgacctcccggnnccctcgctgcngctngctcccctacgcagnnctnaccaaaaaaaggagtgtccagtcccgcacccncgggaccatagccangggggncatcggccccgngctgtactagcctncgtatacatattgtcacnaatattanattaaagtgngtccgtgctg

SEQ ID NO: 527110 - DNA, 520 bp, Homo sapiens
ggccaacatgaactatgtgcaccgtgacctggctgcccgcaacatcctcgtcaacagcaacctggtctgagtgttgacttggctgccggtgcgagagaccgagcactacacacagtgcggagacccacgtgacgccgggccttcctacgagtcactctgcacgacttgagcttgcatgtcatgtggaggtgatacctatggacggcctacggatgtcaacacagtgataagcatcaatgatgtccggtcccaacatggactgccccgctcaccagtcatgatcatgctggagagagcgtgccgcgccaagtcgtgactcgtcgctcctgacagctcatcggcccctatcctcaacctgctgattgacccggtgttatcgtcccaccgagaggtcgagggtgcctccgacgggtcgatgctgggtcctcagatcagagtatacggagatcatgggccggtacatgcatcgaaagtgtgcatgacaacgagatcaaggattgcgtgcggtgccgggccaaag

SEQ ID NO: 527111 - DNA, 129 bp, Homo sapiens
gcggcttgccttcacatctcagcagctacaaaatgaaatccactgatacagaaccccttgttgtgagcagtgaggcgagcgagctgtaaacagacacaaattgcgctttctgcacttccaaaaaaatcc

SEQ ID NO: 527112 - DNA, 675 bp, Homo sapiens
cggcggtccgtctcccaatctgtgctatacagagtacgacgacacttgactggccgcatgtggacagctaaatgactggagaatccctgctgcttcccaacatacctcgcgtgcggtacaataccacgtcagcagctgactgaatatcatgatggcccacaccgggcgctacttgctacagatgggcacaacgcatgcccaacgaggaagtggagcgtgcacatgacagacaaatgctctgtcagattgttgttgcccagatcatggtggaaccgataggccgcgcatcgcaagcatccttactgactaaaagaatagacctggatagccttgcatgttcttccagatagtaacaagatggcactatgaaagaacgtggacttccactgagagggcgaaggacacgatataagagggacaggccactacgagagccaacacactcatcgaagactgtgttgtcgaggagccagagagcactaaatcgtaatcctaaagagagctcccccattcatagcactgagcttgccttctaacgcctccagaaaggtaaggtgaaagctgtatccatcgcataggcacatgctaatcttgtggtactctttgcgaagtgaccatatgcgcgtggttaatgtcggatatgagtgccccaacgttcccattacggtgtgcctc

SEQ ID NO: 527113 - DNA, 1729 bp, Homo sapiens
  misc_feature (2)..(3): n is a, c, g, or t
  misc_feature (1086)..(1086): n is a, c, g, or t
  misc_feature (1097)..(1097): n is a, c, g, or t
  misc_feature (1103)..(1103): n is a, c, g, or t
  misc_feature (1226)..(1226): n is a, c, g, or t
  misc_feature (1261)..(1261): n is a, c, g, or t
  misc_feature (1310)..(1310): n is a, c, g, or t
  misc_feature (1317)..(1317): n is a, c, g, or t
  misc_feature (1338)..(1338): n is a, c, g, or t
  misc_feature (1380)..(1380): n is a, c, g, or t
  misc_feature (1399)..(1399): n is a, c, g, or t
  misc_feature (1411)..(1411): n is a, c, g, or t
  misc_feature (1423)..(1423): n is a, c, g, or t
  misc_feature (1467)..(1467): n is a, c, g, or t
  misc_feature (1470)..(1470): n is a, c, g, or t
  misc_feature (1473)..(1473): n is a, c, g, or t
  misc_feature (1481)..(1482): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacattttcatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 527114 - DNA, 275 bp, Homo sapiens
  misc_feature (13)..(13): n is a, c, g, or t
  misc_feature (15)..(16): n is a, c, g, or t
  misc_feature (22)..(22): n is a, c, g, or t
  misc_feature (167)..(167): n is a, c, g, or t
gagaggattaggntnntttccngccaacagtactccaccggtgaggccaacgaggccagccgtttattcaagtgacataagcatttatttcaacttgggtggggggggggtcaaatatatactcatttttataaattaatctaccaagatattacaatgactactanattaaaagtatttgggaaacagcctggttatgaaataggacttctatattgaattaacatatttaggcaatgtagtgggggggggggggccatttactgcttcctaat

SEQ ID NO: 527115 - DNA, 702 bp, Homo sapiens
  misc_feature (2)..(3): n is a, c, g, or t
  misc_feature (561)..(561): n is a, c, g, or t
  misc_feature (581)..(581): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacattttggctaaggataagctgtntacagatgtgcaactgtgtnaagtgctgctgtgcaaagtcgtgacttcgatgagggagtcgttgcaacaaactagtggcagctcaaattgagaagactcaagctgcagactgctgacaaattcaagtggtgcgagtcagta

SEQ ID NO: 527116 - DNA, 1638 bp, Homo sapiens
  misc_feature (2)..(3): n is a, c, g, or t
  misc_feature (995)..(995): n is a, c, g, or t
  misc_feature (1006)..(1006): n is a, c, g, or t
  misc_feature (1012)..(1012): n is a, c, g, or t
  misc_feature (1135)..(1135): n is a, c, g, or t
  misc_feature (1170)..(1170): n is a, c, g, or t
  misc_feature (1219)..(1219): n is a, c, g, or t
  misc_feature (1226)..(1226): n is a, c, g, or t
  misc_feature (1247)..(1247): n is a, c, g, or t
  misc_feature (1289)..(1289): n is a, c, g, or t
  misc_feature (1308)..(1308): n is a, c, g, or t
  misc_feature (1320)..(1320): n is a, c, g, or t
  misc_feature (1332)..(1332): n is a, c, g, or t
  misc_feature (1376)..(1376): n is a, c, g, or t
  misc_feature (1379)..(1379): n is a, c, g, or t
  misc_feature (1382)..(1382): n is a, c, g, or t
  misc_feature (1390)..(1391): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgtggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctcatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 527117 - DNA, 1664 bp, Homo sapiens
  misc_feature (2)..(3): n is a, c, g, or t
  misc_feature (1021)..(1021): n is a, c, g, or t
  misc_feature (1032)..(1032): n is a, c, g, or t
  misc_feature (1038)..(1038): n is a, c, g, or t
  misc_feature (1161)..(1161): n is a, c, g, or t
  misc_feature (1196)..(1196): n is a, c, g, or t
  misc_feature (1245)..(1245): n is a, c, g, or t
  misc_feature (1252)..(1252): n is a, c, g, or t
  misc_feature (1273)..(1273): n is a, c, g, or t
  misc_feature (1315)..(1315): n is a, c, g, or t
  misc_feature (1334)..(1334): n is a, c, g, or t
  misc_feature (1346)..(1346): n is a, c, g, or t
  misc_feature (1358)..(1358): n is a, c, g, or t
  misc_feature (1402)..(1402): n is a, c, g, or t
  misc_feature (1405)..(1405): n is a, c, g, or t
  misc_feature (1408)..(1408): n is a, c, g, or t
  misc_feature (1416)..(1417): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcatacccttttcctttttggagacaaattatgcacaggtgcgactcttcgtgaaacctatggtgaaatggctgactggtgtgcacaacaagaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctcatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 527118 - DNA, 241 bp, Homo sapiens
aactatatgagtctctcggtcaggaaacttcttcagcatcatataagctcatcctgtgcgtatcgctgtcacggtttcagtgcgattcggctcatcgctgttcggtgtctgatttatgttccctgtaccgcttgtcttcagctgtcactcgaataataccattcacatctatctcaaaggtgactatcaatctgaggagaccccacgaggagcaggaggaattccagtcagatcaaatgta

SEQ ID NO: 527119 - DNA, 101 bp, Homo sapiens
aggaagggggggggaaaacaattttgcttttttaagggcccctttttgaaaaagggcgggaaaaaattcccccaaaaaaaaatttttccccctccggggga

SEQ ID NO: 527120 - DNA, 1693 bp, Homo sapiens
  misc_feature (2)..(3): n is a, c, g, or t
  misc_feature (1050)..(1050): n is a, c, g, or t
  misc_feature (1061)..(1061): n is a, c, g, or t
  misc_feature (1067)..(1067): n is a, c, g, or t
  misc_feature (1190)..(1190): n is a, c, g, or t
  misc_feature (1225)..(1225): n is a, c, g, or t
  misc_feature (1274)..(1274): n is a, c, g, or t
  misc_feature (1281)..(1281): n is a, c, g, or t
  misc_feature (1302)..(1302): n is a, c, g, or t
  misc_feature (1344)..(1344): n is a, c, g, or t
  misc_feature (1363)..(1363): n is a, c, g, or t
  misc_feature (1375)..(1375): n is a, c, g, or t
  misc_feature (1387)..(1387): n is a, c, g, or t
  misc_feature (1431)..(1431): n is a, c, g, or t
  misc_feature (1434)..(1434): n is a, c, g, or t
  misc_feature (1437)..(1437): n is a, c, g, or t
  misc_feature (1445)..(1446): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaaacatgtggtgctgatgagtcatctgaaaatgtgacaaatactttaaacccttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctcatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 527121 - DNA, 169 bp, Homo sapiens
  misc_feature (81)..(81): n is a, c, g, or t
gacagatgactccaggaatccactcaagaagctagccattgcagaagaggcgatcggagtatgacgaggtggtcgtaagtnggtgatcattgaaggagacttggaacgcacagaggaacgagctgagctggcagagtcccgttgccgagagatggatgagcagattaga

SEQ ID NO: 527122 - DNA, 131 bp, Homo sapiens
aaactacaaagctaaagataaagcagagggacaaggtgtcatacaagaatacacttgagtactatgccttcaacatgaaagcaactgttgaagataagaaacttcaaggcaagataaacgatgaggacaaa

SEQ ID NO: 527123 - DNA, 1677 bp, Homo sapiens
  misc_feature (2)..(3): n is a, c, g, or t
  misc_feature (1034)..(1034): n is a, c, g, or t
  misc_feature (1045)..(1045): n is a, c, g, or t
  misc_feature (1051)..(1051): n is a, c, g, or t
  misc_feature (1174)..(1174): n is a, c, g, or t
  misc_feature (1209)..(1209): n is a, c, g, or t
  misc_feature (1258)..(1258): n is a, c, g, or t
  misc_feature (1265)..(1265): n is a, c, g, or t
  misc_feature (1286)..(1286): n is a, c, g, or t
  misc_feature (1328)..(1328): n is a, c, g, or t
  misc_feature (1347)..(1347): n is a, c, g, or t
  misc_feature (1359)..(1359): n is a, c, g, or t
  misc_feature (1371)..(1371): n is a, c, g, or t
  misc_feature (1415)..(1415): n is a, c, g, or t
  misc_feature (1418)..(1418): n is a, c, g, or t
  misc_feature (1421)..(1421): n is a, c, g, or t
  misc_feature (1429)..(1430): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgacacatgtgtcgctgatgagtcagctgttgggacaaagcacttcatgccctttttggagacaaattatgcacaggtgcgactcttcgtgaaacctatggtgaaatggctgactggtgtgcacaacaagaacctgagagaaatgaatgcttcttgcaacacaaagatgacaacccaaacctcccccgattggtgagaccagaggttgatgtgatgtgcactgcttttcatgacaatgaagagacattttaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 527124 - DNA, 869 bp, Homo sapiens
tggggttaaaaatggttttctcccttggcaaaaataacataggaaaaactaaacccaaaaattttgtgaaaaggtgtcctttgggaggacgataccatttttgggggataaaaaacccctgataaaaagaacccaattacccttaatgtaggggtgaagggggacacaatctcatgtagcctatacccattatccctaagtgaccactagtgtaacatggggtttatgggagtgtcatcatcactctcatattatttctcccctcttttaataactaaaataatacaaaagatatatctctccttcatgaacacagtatgggagcataggaattatagacaaccggttgagggaggagtattttcattatttctcataatgtgagtgaggggacagcgacaaaatagtgttggactaaaacactaacggggaggatagaggaggaagcccattgagatctcttaataaaactgggacaagtcccatcatactcgctatttccctcgccagatacatgtgcacttatgctgcgagaacaacgccataattttttacacacgtagggccgagggacctaagaatactgcccaaaaggccacccagggaacaagcatatcaaactagtgtgggaaacaaatcggctatgccaactacaagtcataacatacggccacaaccattaagtgctggagctatttaagaaacccaatactgtgtcaatgtgcgctgctcaaaacaagccgctataacacccccgccttaactgatgacacacaaccattcgtagtctcaacacgtgtacatgacaccatccggacatataatacacctgacattatttaatccaacacacaccccattggcagaca

SEQ ID NO: 527125 - DNA, 338 bp, Homo sapiens
gatgcagtataccctggcctaactgagatttccgcagaaattaatgcctagacaccaaaccacaacatccaggaagctcagagaatgccaagccaaataaatgccagaaaaaaactacaccaaagagtatcatactcaaactgtagaaaaccaaaggtaaagaaaaaaaaatcttcaccaggcatggtggctcacacctgtaatcccagcacttaggaaggctgaggtgggtgggtcacttgaggccaggagtttgagaccagcctggccaacatggtgaaagcctgtctctactaaaaatagaaaaaattagccacacatggtggcatcgataaaca

SEQ ID NO: 527126 - DNA, 682 bp, Homo sapiens
  misc_feature (2)..(3): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaaacatgtggtgctgatgagtcatctgaaaatgtgacaaatactttaaacccttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggttaaaccggtttttacaaaggtggccaaattgtgtaaaaacttctcgcccttgcccaaattcataaatctcgga

SEQ ID NO: 527127 - DNA, 1001 bp, Homo sapiens
  misc_feature (2)..(3): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggttctgacaggactttcgtggagcatagaaagaattttcagaagcatggtggagtagctcgccgtggagcctaggatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctcccagtaatagctgaaggacatgctgtgatgaaagtctcgtgttggatagataatcccaactgtcattgcccgaatgatggacactcgtgattgaggactggcctgactgaactgtgcctttcattttagcgtgcgtgattcttctgttggataaggtaatggattcgttttgcatatagtactaattgtcgtgaagggccaacaggggtatggtcctattccctttggggccacttgtttgttgcagtaaatggaaacttattgccaagaaagggaatgtcctcggaatttacctcctggttcgctagcttggcgtagactcggatgtaagctctgccaacagaacgacttattgaaaaaggcaattccttaagaagaaaggtggcgttgttggcccagggttggcacgtgaaattccctctcatttggaaaatgtggcgttaattgggcccgaaaaggtgggcttcccggaatgcaaatctctgtcaaaacccttctttgggtgggggaacgaagagacccctgtcggaacagtctacatgtccacgaatcacgaaattggtcggacaccgttctgtggaggacaaaccttgtggccaagttttcc

SEQ ID NO: 527128 - DNA, 305 bp, Homo sapiens
caggcgctggactcttgaagacgtcggagaccctgtccctcacgtgcggtgtctacggtgggactgtcagtggttactactggagttggattcgtcagccccccggaagggggccggaactgattggagaagttgatcaaggtggaaatggcaactacaatccgtccgtcaggggtcgcgtctccatgtccctggacacatcgaagaaccaattctccctacagctgacttccttgaccgccgcggacagtggtgtctattattgtgcgcgttatagcgacacctggcataaatatgtccaatat

SEQ ID NO: 527129 - DNA, 114 bp, Homo sapiens
tcgtaagttgtaaagtctctcatgcaaccagcgccgcagtccaccccttaactgaggtccctgccctccccgactgcgctggccgagactgagggggcagctcgcccctgagtt

SEQ ID NO: 527130 - DNA, 204 bp, Homo sapiens
  misc_feature (11)..(11): n is a, c, g, or t
  misc_feature (17)..(17): n is a, c, g, or t
  misc_feature (79)..(79): n is a, c, g, or t
  misc_feature (92)..(92): n is a, c, g, or t
taagagggagncaaacnaagtggcccaggctggtctagaactggtctcagatgaaactcccaactcattgtcctgagtngctgggttacagncatgaggcactgtgcctgccctacttttttatataaaaaaattataaataacatattttagagccaggagggggggcccatgggtataatcccagcaactcaggacaatgag

SEQ ID NO: 527131 - DNA, 961 bp, Homo sapiens
  misc_feature (2)..(3): n is a, c, g, or t
  misc_feature (782)..(782): n is a, c, g, or t
  misc_feature (959)..(961): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgatagcgcgtttgctcacgtatcttcagtcagtgtccagtatgacagatcgatgtaaacattcagtgagatgatagtaacgtgaactttgcggaaacacatagtgttgcatgatagagtcagcgtgaaagattgtcgacaagatcagcttcattaccacttatttgtgacgacacaatgtatgcgacatgttgacaatctctttgcgtagaaatccctataggtagaagactggcgtgtacgtgcagtgtgacaagagacaaggataccctgcagtagcaagatcgaatggcgttcgtttgcaacgacaataggatggacaagcccagagacctgcccccgcagtggggtgtagaccgagagggttgactgtgatagtgcacggcgttttcatgtacaatgaagagacattttgaaaaaatacttatatgaaattgccagaagacatccttacttttatgccccggaactccttttctttgctaaaaggtataaagctgcttttacagaatgttgccaagctgctgataaagctgcctgctgtagcgaaagtcgatgaactacgggataanggcaggctcgtctggcaagagaaatcagtgtggcaggtcaagatggggaaaagtcaaacaggcgtattgctgactcaaatattgggattcagtataagttccagcacgaggcgaatgtatgttaggggcattttagaaattctttggtgattttcttgtatatgttattggttttcnnn

SEQ ID NO: 527132 - DNA, 251 bp, Homo sapiens
  misc_feature (2)..(3): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaagattgggagaagaaattcaagctgtgtgatgcttgctcagtatctcagcggtcattgagacagaaatagtgatgag

SEQ ID NO: 527133 - DNA, 361 bp, Homo sapiens
agttcatatgtcgcccttcctattgatcacgccctcctaagtatatcatctacgaacgacctaaatcgaacgaccagtagtgcacctatgtttaagactaggctgcagagactgaatgaataaatcagtacagcatatgtgaaatgaaggcaaaatctggacatcttcatatcattacattgatatccgtttaatgctgatatatctgattgtgctaccagacatagacaccttactcctcggatacctctcgtgtgcatcacatcatgctttgcaccataattgagctctgaactgataatcattgactgcttatccgatgtgccaatgccacatttatgaaccagggtctgctggtcgc

SEQ ID NO: 527134 - DNA, 550 bp, Homo sapiens
  misc_feature (490)..(490): n is a, c, g, or t
  misc_feature (504)..(504): n is a, c, g, or t
  misc_feature (525)..(525): n is a, c, g, or t
  misc_feature (529)..(529): n is a, c, g, or t
gaggttcctgagctgccgctggtggttgaagataaggttgaaggttacaagaagaccaaggaggctgttcagctgctcaagaaactcaaagcttggaatgacatcaaaaaggtctatgcctctcagagaatgagagctggcaagggcaaaatgagaaaccgacggcggatccagcgcagggggccctgcatcatctataatgaagataatggtatcatcaaggccttccgcaacatccctggtattactctgcttaatgtaagcaagctgaacattttgaaactggctcctggtgggcatgtgggccgtttctgcatctggacggagagtgctttccggaagttggatgagctgtatggcacttggcggaaggctgcttccctcaagagtaactataacctgcccatgcacaagatgatgaacaccgaccttagcagaatcttgaaaagccagaaatccaaagagccctccgagcaccacgcaagaagantcatcgcagagtcntgaagaaaatccactgaaganctgngaatcctgttgaagttaaccc

SEQ ID NO: 527135 - DNA, 954 bp, Homo sapiens
gaaccaggcggcggccatcgcggcgaggatacagtggcttctcgcagactgccgcagaactactgagccggtggagtgacaggctccaagtagccgcgaatcagtgttatgcttcgcctcatgtgtcctctgtacaaggaggctggttcactggagtctgcctcgtgatgagagcctccaggacctagagagctatgactggcccttcggggtgacggtgctgcgctggaaagagctagtgttctgcatgtaccagtctctggactgtgcggagacagaagcgtgaatgccatgaactcgaggtcttcttggatgagagatgctacgacttgctacaggcgcgcatcttcgcgagaccgctgacggtcgtccgcgggggtgatcctctggtgcgggatgaaatgttcagcctgcaggtattgcgggagtgtactatggcttctgtgcagcgtcctgcaagcccaacggggatgatgtgggccgcattcgagctggtaccgtcggtgattatcctccacttccgatacaggagacccttcacgtgatcggaatgttgcccaccagcccgtgtgatcgcttgctgccattggtggctgattgaccgtgcgttgtggcccttgttcacctgtctgtgccttcggtcctgttgccacggctggtttctccacggtgcccagagggccggcggtgggagggacgagacactgaaggcgctgccagtcatcggtcacccagcggtccatgggggcatcccgcggacacatgctaccagccaggaagggtggtaccggttgcacgcaaagagcacgggtagataaagcagggcgatccagcaagccgggcgcagcaagcccgggatcgcaacgggcgcccagggtgagagcgctcacaacaagaccagcacaagacacccacaacacggagcacagaagcacctcgacgactgtgtcggag

SEQ ID NO: 527136 - DNA, 1117 bp, Homo sapiens
ctccctgtcagctcttcactagcctcggcctgagcgagcagaaggccctgtgagactgctcaatgaactctgtgctctgagcgcgcagctgcgcgatggcgctactcaggctcagcatgaccctgggttccaccattgacaaatgctacctggtgatcctgttatatgtgcttgtgcctccctgactcagtggataccacgagcgtctcatcacttacctctgcctaaccctacactaccccagtacgcaagatccaacacctgagcccccagactaaccctgcctgccctctgcagctactgctgcgcgacgctcaccaccatagcagcacacaccaatcgcaccaacatgctggaccctatcagaaatgccgcgcgcaactgctcgcgacccgatggcgcgctgctccacctcgctcgcacccctcaacgcacgcccacgactcgaccgcgcaccgccctgcaccgcgcaccgcctggcctaactatcaccaccactcgcgcccactcatggagccccccccccaagcacatccctggaccttgcgcacaacccgctaatcaccacaatctatatcaaaccccatggcgcgacgcccttgcctctgcaccttgcgcgcagcaagtggccctcacgcaccgccatagaatgactctggcaacacgctgggcacgcaacagtagccgccgacacatcaacactctgtgaactacgcatcgcactacctttgaccaccgcctgcggcaaccaacgttggcccccagacgtatccacaattgacaaacaccctttccattgggcagtccacccccaacaacgccatctcggccgacgctggtcccatgcccactccctatgtgctcacgccaataactgtacactgccttttccccaaaccggtggccctggccgtcctctacacaatccactgacattaccggcgaccctcatacgcatatcgctgacaaaacacacatgacatccctggggcctcacgcctcacactcgacgtcaccaacaaatgcgtgaacgcttggatatgacggctaggcaactgcaaaccacctgtgcgtgcccggcaatggcaactgcattgctctctatggctcctaccca

SEQ ID NO: 527137 - DNA, 193 bp, Homo sapiens
tcagagcatcccctagtgcactatataagcactgataacttggctagagtataataacggacatagtgccaatataggatttgaagagtagtcaaataggcaaataaaaaagcagaaatataaagcgttgagtcatcctcttcatcttcctcatcttcctcctcttccttcctggttaccgcgctcgacttcg

SEQ ID NO: 527138 - DNA, 180 bp, Homo sapiens
tctgacgtctcccgtttgtcgcgccttctttcaccggccaccatctttcccccttcgcacatctctgtgcaggcagcattattccatcatcgcaccgggcatgaggttccatccacctttccagcaagcctcttctcctgagcagttccggctccgtgccagctccgtgtgcctctatga

SEQ ID NO: 527139 - DNA, 225 bp, Homo sapiens
tgaggaccatcaaatagaaatatagactgacaaaacagactcttgggaataagatacccaattccaacctgactctgatatagcatcgcatgacagatagcagactctgaaggaaatcaaaatattgtatcccaaaatgtttctttgacatattttgaaatgaccctgcaaagctgtcttttctgaatctatgaagaacctccatgaatgcgtccgtcgaagttg

SEQ ID NO: 527140 - DNA, 119 bp, Homo sapiens
ctagcggatccgagaagcggtgtgatatcattaaccccatttgaaatggtcgaaggtgtctaggtattggtggtagttattcctggtaccatcgcgaaacacaattcaaacacacaagg

SEQ ID NO: 527141 - DNA, 922 bp, Homo sapiens
  misc_feature (141)..(141): n is a, c, g, or t
gtcctgatgggcaaacccagacatcctcacttaccagctatgtccgaggacctgatcaggcgatctagagcggagaaggcggcgtgctggagaccgctcctccatcgcgtgaagctctatgctgtgggtgataacccatantgtctgactgtactaccgagcagccaactcatgattccattccaggtaccatgacatcggaaaggcaacagcagtgatgggggcgcgcagaatctaggggccgcggggcacatcggtgcatgtcatatcaggccctcatggcaaatccagtagcttgcagtctccatccttgggtgtgtacatggctgtctacaattcccaggaaccctagctagtccacggatgcctgtccttgtgaggatgcggcgagcctccattccacgggcaccgatacttatgcttcagtccagggctcatggagtgcctcccacgatgagtgaatgacgtgaatgaggctgtgcacgcttggttcttccgcagggcagggtctgggcctttggtagtgagggctgttgccggtggcacggctgagcggggtgagcctggacctgtggccgagtcccattgtgctgggctctggcctgatcactggcgctcaggtctggcgacttggttcccttgccacccttcttggctgccccagtgagtgtggccagttagctggtcgacttggcctgacagacagtgactcgtttatccctgctgcgtaggcatctggtattcgacccggtatggacattctcttggggcccacgttcccagcgtgaccttttcgtgagcatggtctaatcctcatgggccaattcttcattcccccttggtgttgccctcaagtgtcctttcgtcagtttcaagtacggcgaccttctggaaaatggggaggaggcagggtagagaatac

SEQ ID NO: 527142 - DNA, 283 bp, Homo sapiens
gtgtccttttcagccagggaccctttttagcatcgccgatccttctggcttgagaattttctatgtgtttctttagctcaggatttttttcccattctccagtttttagtgccctttttcaatattgtagacagttgtcattttaagcttttttctttcctttattagtacaaattcaggtagtaaaatattttagtaattcatattgttcagtaccaattttctgaatactactttgagcattacacaaagcatgatgtggcgtgccatttactctgagttc

SEQ ID NO: 527143 - DNA, 142 bp, Homo sapiens
taaaaatctaagaaacttacctatccagtttagggcttctaactctaaccttgatggccacatttcacactaaggccgtcaatgtacttccccagtcgttcatctatcatgagagcaaacaagacctaacattctcagaaga

SEQ ID NO: 527144 - DNA, 163 bp, Homo sapiens
ctagaggttacccttccaggcttattgcaggcagtggccacacagctcctgcccggagcacgtaacgatggtgctgggaggagagggcacaggaggacgaggctgcctctctgctccaatgtaaggcacttgcagctggggtggcctgcaatcgagcctggaa

SEQ ID NO: 527145 - DNA, 161 bp, Homo sapiens
ccacctctgcctcccaagtagctgggattacaggcacacacctcctcacctggctaatttttgcatttgttgtagagacagagtcccatcatgtacgcccagactgatcttgaactccggggctcaagcactcctcccacttaggcctctgccaactgctg

SEQ ID NO: 527146 - DNA, 241 bp, Homo sapiens
  misc_feature (64)..(65): n is a, c, g, or t
  misc_feature (174)..(174): n is a, c, g, or t
  misc_feature (176)..(176): n is a, c, g, or t
  misc_feature (178)..(178): n is a, c, g, or t
aactataggctaggtacgaggctggtgtgatcggccgagggcagccctggcagggttgctctgnngattggtgaggccgtgtggctacttctgtggaagcagtgctttgtagttactggaagataaaagggaaagaagcccttgggtgggggaaacacggcttacctgcgcccntngncgatgatggcatttcttaggacaccttggattataatgaaaacaactactctctgagcagctg

SEQ ID NO: 527147 - DNA, 132 bp, Homo sapiens
gtgtttgccgtggttcaggaatgctcagtgaagcttcactttgattcttattattttttatttttattaatttttttttttgagacaagaatctctctctgcgcccaggctggagtacagtggtgtgatctc

SEQ ID NO: 527148 - DNA, 135 bp, Homo sapiens
gttgccctggctttgtgaatggatcatgtgtctctaggtacttaacctgacatcatcttgtccacccggcttacctccaccagatttccccagttctgtctccatcttctacctgcagctgagtttcacttccga

SEQ ID NO: 527149 - DNA, 285 bp, Homo sapiens
gcatagtgtgttgcagctgatttaaatttctcacaagtttcatacaaaaagaagttttaccatgaccacagcaatacccaaatatttattttacatccaagtgtccaggataactatattcaaagttgagcatttatctctttatatgctaacagtagtctaagagtataaatccaatactgcaaactactctcacttcttcctcatattaggacttcaagaacatggttaagcatttaactagaaactcaacgtgtctacaacatcacttaaccagcaaggaat

SEQ ID NO: 527150 - DNA, 112 bp, Homo sapiens
ataacatgttcagtgttgtcacaaaaaactgaagattagaagccaggagaaatacaatgatggcctgtggcatgatgtgatatttattcgagaaaggcgcagtgcccgacgg

SEQ ID NO: 527151 - DNA, 137 bp, Homo sapiens
agtttgagagtcttcagtcacaaacaatagacagcctgaagactgtcaaactggttgataatcaaagaataggtcggttcgattaagtacggttggaattagtaagctatagcttaccagttttccatgtgctggga

SEQ ID NO: 527152 - DNA, 587 bp, Homo sapiens
ctctttcacaccatcctcccccagttcgccccccccatcggatggaaaaagccaccccgttgtttcgcgctgtccaacccgcctgaacaatccacccctgtttgcttaattttaccagcattctaatatatctccctacggttctctccgccctttccatgttcttcaatcccatcaatttatatttcccactccccctcacgatcgccttacgtaatatatttattgcccacccgtgaaaccagacgttatacactgatgcgtaacaccccctctgtatttctgccacgccccgcctctcctcctgtccctcacaggaggggcgctcgtcgccccgcctgtactagcgggctttgtgtgccccaaacatgggggccctctttttcgctagagaaattctcccctcgcaaccgcactatgcctttgattcgtcactccccaccctttattacctccacctctacaccctccttccttacactctcttgattgttcacatataccgcctataatttatttccgaccctctcgactctaccccttctctctcccccataatttctaccccccagttaacaaaaaaaaca

SEQ ID NO: 527153 - DNA, 226 bp, Homo sapiens
agtcgcccgctttcgtgagactccctggaggcgctttccagcacgggaataagctggacagggaggtaaagtaggcgaggtccctcctttttgattcttgggaaggaaaagccccgcccgcaatgcacaaggtcatctttttatttgttcccttgtatgggacccgtcagcgccaggaggcgtgttaatagaaggtccttgttagaagcagcagcttagctcacgg

SEQ ID NO: 527154 - DNA, 427 bp, Homo sapiens
  misc_feature (32)..(32): n is a, c, g, or t
  misc_feature (93)..(93): n is a, c, g, or t
  misc_feature (154)..(154): n is a, c, g, or t
  misc_feature (187)..(187): n is a, c, g, or t
  misc_feature (191)..(191): n is a, c, g, or t
  misc_feature (341)..(341): n is a, c, g, or t
ttcctgactgcgctcctctggcgcggccgcanttcccggcgtcaagtggatcgggaagcaccggcggccgggttcgtgtcgttgcgcgccaanagaacatgatccgccgcctggagatcgaggcggagaaccattactggcctgagcatgcccntacatgacccgggagcaggagcgccggccaccnggtngccgcaaggagggaggccttcgaggcaataaaggcggccgcacttccaagttcccccgcatagattcattgcggaccagctcgaccatctcaatgtcaccaagaaatggtcctaatcctgagtcgtcacccttggattttatggatcacnggagctgaccatctttacctggtcctggaactgaaaaacttgtagctttgtgtgaaaatgagcctttggaccagtctttattaaaa

SEQ ID NO: 527155 - DNA, 617 bp, Homo sapiens
caccttgtgtaaacaaatccatgctctccacgtgagtgagcagagccacatgcccaccccagcgtaacacaactccattcgaattcttgtgctctatcctatcatctgagaggacaagtattgaatagagctggcatcaaatacaatgccgacacaatgaattgtgtcgttcagcgatggggactcaatgtagtcatgatgatttaattcgattgattccatgggattaatctggtatctctcacgagtgtcaccgttcaagatatagaatatgtcatccgtgcacaggccgcgttctttctcactcagccccagtgagtcacacacaataaccgacaggtatttgccatctttccggtctctaatagagtatgtcctatccttctcagatatcccagtgtgtattagtgcccaccaaagcatgatgcgtcacatgcccttggaaaccagccctcattgagttgaaaaagtgtggacttcccagctccaatgtggacacaccagcagaattggtatttgttgaaccagggatccatatggttatctttctttcatacagtgaatctggtgcactgtctgtagtaacagctagatctgagggtagctgctctgtctgg

SEQ ID NO: 527156 - DNA, 356 bp, Homo sapiens
  misc_feature (1)..(1): n is a, c, g, or t
  misc_feature (31)..(31): n is a, c, g, or t
  misc_feature (67)..(67): n is a, c, g, or t
  misc_feature (77)..(77): n is a, c, g, or t
  misc_feature (211)..(211): n is a, c, g, or t
  misc_feature (224)..(224): n is a, c, g, or t
  misc_feature (247)..(247): n is a, c, g, or t
  misc_feature (264)..(264): n is a, c, g, or t
  misc_feature (288)..(288): n is a, c, g, or t
  misc_feature (305)..(305): n is a, c, g, or t
nctgcaggaattcggcacgagtaaacacgtnatcagtgcatgatgagccatgtaatcagtgcccgancagccacgtnatcagtgcatgtccagtcacgtgatcagtgcatgatagccacgttatcagtgcgtgcacagtcccatgatcagcgcctgtaagtcactgatcattgcctgataaacacgtgatcagtgcatgatgagccatgtnatcagtgcctgancagccacgtcatcagtgcatgcncagtcacgtgatctggncttgatcagccacgtgatcagtgnctgcagagtcacggggntcaggggccttctgagctgcgtggattcctgccgggcttcatctgcatgga

SEQ ID NO: 527157 - DNA, 1508 bp, Homo sapiens
  misc_feature (42)..(42): n is a, c, g, or t
  misc_feature (45)..(45): n is a, c, g, or t
  misc_feature (147)..(147): n is a, c, g, or t
  misc_feature (158)..(158): n is a, c, g, or t
  misc_feature (1133)..(1133): n is a, c, g, or t
  misc_feature (1164)..(1164): n is a, c, g, or t
agccctagcccgcctcttagaacctctcatttcctttccatngtngaaatctatcctcaaggaaataacttctcagtattccatctgctattctactgctcctcagggattattcaggccccctcccttccctacacatcaagctcnaggatttgccnccacccaggactggcaaattagctttactcaacatgccccgagtcaggataactaaaatacctcttagtctaggtagacactttcactggataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaacggactaaaggtcttttaaaaacacacctcaccaagctcagccaccaacttaaaaaggactggacaatacttttaccactttcccttctcagaattcaggcctgtcctcagaatgctacacaaggtacagcccatttaagctcctgtatagacgctcctttttattaggccccagtctcattccagacaccagaccaacttagactgtgcccccaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctaggtcctcccaattcttagaccttttatacctgtttttctccttctgttattccatttagtttcttcaattcatccaaaacggtatccaggccatcaccaatcattctatacgacaaatgtttcttctaacaaccccacaatatcaccccttaccacaagacctcccttcagcttaatctctcccactctaggttcccacgccgccctaatccgnttgaagcagccctgagaaacatcgcccattntctctccataccacccccaaaattttgcgcccaacacttcaacactattctgtttattttttcttattaactataagcaaggcaggaatgtcaggcctctgagcccaagccaagccatcgcatcccctgtgacttgccatgttttacgctcagatggcctgaagtaacttgcagaatccacaaggatgtgaaaaggccctgccccggcttataactgattgacattccaccattgtgattgtcctgccccaccttaatgagtgattaacctggtaattccttctctggttcaaaaagtccccatgagcaccttgtaaccccggacccgtgcacagaaaacagcc

SEQ ID NO: 527158 - DNA, 1042 bp, Homo sapiens
ctcccgcgtttcagatcctggccatttgctaccagcggcggcgcggcggagccaggccggtcctcagcgcccagcaccgccgctcccggaacccggagcgcgcaccgaggccggcggccgagctcgcgcatccagtcatcactcttccacctgctccttagagaagggaagatgagtgagtcgagctcgaagtccagccagcccttggcctccacgcaggaaaatggacagtgcactagagaagctggggccgagggcagggtcgcgcaagcagtctccgggtgagtcccgcggacagcgctggtaggggagtcagagaggagcccagcgaagtggcaacacctagagagacctcgggggccgacccaaagggaaggcgaacaatcattgggtgctgccaagagctggaaaaccaacctagtaagtcctggaatggaaacccatggggcagacccaaaaaaaagttgtagaagcgagtgaacgaggagcggctctctcgcaggagtcctcgtggaggaggagcaggttgacccatgctgtgccgcctggttcctcacttggaggaagcagggctctcctttctgggactgaacgagtttgtgtccgctccccgaagggttgtggctggtcccctcggggcaaccaagtgagcagtcggtgtctgcggcggcaacccccagaatatatcatccttgtgccctctaacctggcgcagcggtaccagggctactctggcaggctgatgcgtcgcctgtggcgtgaatggcactgggtttgccgttggtgtccgctctggcatcgtcgtgccagcgacttgacctgctgccctctaggccgtgctacattcagcttccgcacgtggacactctcgtcccatcccctgaggggggcagtgctctggcgatcggttgggcgccgcacttgcactgaccgcccttgctcacaggggcgggaggtcctgcgataaggcgcgcctttttagagcctatcttctgggacttcatggtggtgccgtccccatttctggggaacaccctcttgc

SEQ ID NO: 527159 - DNA, 1486 bp, Homo sapiens
  misc_feature (42)..(42): n is a, c, g, or t
  misc_feature (45)..(45): n is a, c, g, or t
  misc_feature (147)..(147): n is a, c, g, or t
  misc_feature (158)..(158): n is a, c, g, or t
  misc_feature (1111)..(1111): n is a, c, g, or t
  misc_feature (1142)..(1142): n is a, c, g, or t
agccctagcccgcctcttagaacctctcatttcctttccatngtngaaatctatcctcaaggaaataacttctcagtattccatctgctattctactgctcctcagggattattcaggccccctcccttccctacacatcaagctcnaggatttgccnccacccaggactggcaaattagctttactcaacatgccccgagtcaggataactaaaatacctcttagtctaggtagacactttcactggataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcagtttatatcccttatagtcctctgtcttcaagaaaagtagaacggactaaaggtcttttaaaaacacacctcaccaagctcagccaccaacttaaaaaggactggacaatacttttaccactttcccttctcagaattcaggcctgtcctcagaatgctacacaaggtacagcccatttaagctcctgtatagacgctcctttttattaggccccagtctcattccagacaccagaccaacttagactgtgcccccaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctaggtcctcccaattcttagaccttttatacctgtttttctccttctgttattccatttagtttcttcaattcatccaaaacggtatccaggccatcaccaatcattctatacgacaaatgtttcttctaacaaccccacaatatcaccccttaccacaagacctcccttcagcttaatctctcccactctaggttcccacgccgccctaatccgnttgaagcagccctgagaaacatcgcccattntctctccataccacccccaaaattttgcgcccaacacttcaacactattctgtttattttttcttattaactataagcaaggcaggaatgtcaggcctctgagcccaagccaagccatcgcatcccctgtgacttgccatgttttacgctcagatggcctgaagtaacttgcagaatccacaaggatgtgaaaaggccctgccccggcttataactgattgacattccaccattgtgattgtcctgccccaccttaatgagtgattaacctggtaattccttctctggttcaaaaagtccccatgagcaccttgtaaccccggacccgtgcacagaaaacagcc

SEQ ID NO: 527160 - DNA, 784 bp, Homo sapiens
cgtcatctcacgtgtcgaggtgatctcgaacttttaggctccagagatcctcccgcatcggcctcccggagtgctgtgatgacacgcgtgggcacgacggagtttcactcttgtcgcccagggtggagtacgatggcggctctcggctcaccgcaccctccgcctcccaggttcaagtgattctcctgcctcagccttcccgaggggctggaatgacagagatgagccatcgtgcccggctaatttttctatttttactacagatggggtttctccatcttggtcaggctggtcttcaacttccgaccgttggagaatcttaactttcttggtggtggttgttttcctttttcttttttttcttttcttttctttccttctcctccccccccacccccccttgtcggcgtcctcctcctcctcctgctggtacaagtagagatgaggaagatcggtctaaggatagcgcggggatttgtacgagtgggcttatgtgcgggatggtacgctcccgtccgttgtgggtggagagcgggcgtgggtatgttgggcccgcgcgattgatggtttgtaaggggcggaggcacaggagctgttatgatagactgtttgaggggggggctagtaggttgttacacatgtgttcgcgccggtacgccggcgacgcgttgtgcgacgcaggtttcgttgaggattttaaataacgcgatatatgaatgatcgaatggcgctacacctaccccagagttggcaggtgagctgtgggtacgagtcgtggggccga

SEQ ID NO: 527161 - DNA, 1003 bp, Homo sapiens
  misc_feature (42)..(42): n is a, c, g, or t
  misc_feature (45)..(45): n is a, c, g, or t
  misc_feature (147)..(147): n is a, c, g, or t
  misc_feature (158)..(158): n is a, c, g, or t
  misc_feature (881)..(881): n is a, c, g, or t
agccctagcccgcctcttagaacctctcatttcctttccatngtngaaatctatcctcaaggaaataacttctcagtattccatctgctattctactgctcctcagggattattcaggccccctcccttccctacacatcaagctcnaggatttgccnccacccaggactggcaaattagctttactcaacatgccccgagtcaggataactaaaatacctcttagtctaggtagacactttcactggataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaacggactaaaggtcttttaaaaacacacctcaccaagctcagccaccaacttaaaaaggactggacaatacttttaccactttcccttctcagaattcaggcctgtcctcagaatgctacacaaggtacagcccatttaagctcctgtatagacgctcctttttattaggccccagtctcattccagacaccagaccaacttagactgtgcccccaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctgggaggactangacatctgattagagagtgcctaaggagattcagcatagtcctgccagcaaagattatttatttacctcaagagtttagacgtggcatatttctcactccttgggagtgggtaccgtagctc

SEQ ID NO: 527162 - DNA, 115 bp, Homo sapiens
aaaaattgaatcaccacagtttaactgaaagcaaagaatctacaacaaaagacaatgatgaaattcatgatgttgctatcaaaagttgagaattgtcagagggaatcatggagta

SEQ ID NO: 527163 - DNA, 514 bp, Homo sapiens
tgaggtatcctgtaacccactcgagaacgtcaagcaatgatcacaggacaaggatggcattctctcctgagccagcagagtgttgatcttttgccggaaagctgctggtaagatgggcgcaccctgtctgactacaacatccacaatgatcactaccttgcacctggctgcgccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtacgctgtctgactacaacatccagaaagagtccaccttgcacctggtactccgtctcagaggtgggatgcaaatcttcgtgaagacactcactggctagaccatcacccttgaggtcgagcccagtgacactatcgagaacgtcaaagcagagatccaagacaa

SEQ ID NO: 527164 - DNA, 1098 bp, Homo sapiens
  misc_feature (30)..(30): n is a, c, g, or t
  misc_feature (723)..(723): n is a, c, g, or t
  misc_feature (754)..(754): n is a, c, g, or t
tgagcggaccactcggagagtgcaggcatnttctcaggttcttagtattcagtgacagactaatggtctattaaaaacacacctcaccaagctcagccaccaacttaaaaaggactggacaatacttttaccactttcccttctcagaattcaggcctgtcctcagaatgctacacaaggtacagcccatttaagctcctgtatagacgctcctttttattaggccccagtctcattccagacaccagaccaacttagactgtgcccccaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctaggtcctcccaattcttagaccttttatacctgtttttctccttctgttattccatttagtttcttcaattcatccaaaacggtatccaggccatcaccaatcattctatacgacaaatgtttcttctaacaaccccacaatatcaccccttaccacaagacctcccttcagcttaatctctcccactctaggttcccacgccgccctaatccgnttgaagcagccctgagaaacatcgcccattntctctccataccacccccaaaattttgcgcccaacacttcaacactattctgtttattttttcttattaactataagcaaggcaggaatgtcaggcctctgagcccaagccaagccatcgcatcccctgtgacttgccatgttttacgctcagatggcctgaagtaacttgcagaatccacaaggatgtgaaaaggccctgccccggcttataactgattgacattccaccattgtgattgtcctgccccaccttaatgagtgattaacctggtaattccttctctggttcaaaaagtccccatgagcaccttgtaaccccggacccgtgcacagaaaacagcc

SEQ ID NO: 527165 - DNA, 318 bp, Homo sapiens
  misc_feature (181)..(181): n is a, c, g, or t
  misc_feature (299)..(299): n is a, c, g, or t
  misc_feature (311)..(311): n is a, c, g, or t
gggtgtgcctgcaaactggggaaaacccaacttgactgggctgcccggattcctcggaaattagcaaggaggaaagactaaagtctgctggtccatggagactacaaccaagccctcccctaggggctcagtccccagggagatcagagttctgtccttgacccctggctggagttgttgnagttcctgcagggaggccccactcaatgaggaaggaagggttacggtcagcctaaagagcactctggccgcaatctgccaaagccagtgtgttgggctgtggggaataccgtctaggncccagccgtttncgtctgt

SEQ ID NO: 527166 - DNA, 515 bp, Homo sapiens
ggttgctggtcttcctgtccggtcgccggccgtctaggtctccgggcctccccagccgctcctgcgccctttccggcccgtgctgtccgcagccctggcgctccctcgtggccccgtgctgagtgccgctgcttgccctgtgccagcgcgcgccccgtgacaccggtgcgcgcttgactgacggcaccggttctgtcgggcgtgcgtggtgcgcttctgggctcgaggaggacgggccctttccgtgccccgagtgcgccgaccgactgcttggcaggctgcgccgtggagcccggtatggtccccgctcagtgccgtcgccttctggcgctctagggattgcggccgctggagctcgcgcgcgacggcccggccagcgatgtcgcgctgcagctgctgtgccagcgccgacggcgggccggctcttgcaccggcttgccgattggtatgtgggacctcaatgcctgcccgagtgggaacctgtgctggaggaaggcgctgagcggcaaggagaa

SEQ ID NO: 527167 - DNA, 798 bp, Homo sapiens
  misc_feature (42)..(42): n is a, c, g, or t
  misc_feature (45)..(45): n is a, c, g, or t
  misc_feature (147)..(147): n is a, c, g, or t
  misc_feature (158)..(158): n is a, c, g, or t
agccctagcccgcctcttagaacctctcatttcctttccatngtngaaatctatcctcaaggaaataacttctcagtattccatctgctattctactgctcctcagggattattcaggccccctcccttccctacacatcaagctcnaggatttgccnccacccaggactggcaaattagctttactcaacatgccccgagtcaggataactaaaatacctcttagtctaggtagacactttcactggataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaacggactaaaggtcttttaaaaacacacctcaccaagctcagccaccaacttaaaaaggactggacaatacttttaccactttcccttctcagaattcaggcctgtcctcagaatgctacacaaggtacagcccatttaagctcctgtatagacgctcctttttattaggccccagtctcattccagacaccagagaacaaaccccctttgactgtaattttccattaccttccctaatcctataaaacggccccaccccatctccctttgctgactctcttttcggactcagcccgcctgcacccaggtgaaataaacagccttgttgctcac

SEQ ID NO: 527168 - DNA, 202 bp, Homo sapiens
gttaaagtcatttttattaataatgactagcatttagttcacaatttttatgaaatatgccccttctctattaccactactttctcttattaatcagtatctcagaataatttttcttttcctttagaaaccttgtagagatatgcttagttctataactgttcttatttacttatgaacacatggaatattcatttatctt

SEQ ID NO: 527169 - DNA, 262 bp, Homo sapiens
tcggctcggtaccttgaatgggcacagaaatccaacactgtgttgaatagagtggtgagagagagcatcctgtcttgtgcccgttttcaaagggaatgcttccagtttttgctattcagtatgatgttggctgtgggttcgtcataaatagctcttattatttttagatacttcccatgaatacctaatttattgcgagcttttagaatgaagggctgttgaattttgtagaagggctagtgtgggtctattgagatagtca

SEQ ID NO: 527170 - DNA, 292 bp, Homo sapiens
tggtgataggagctcactcagttgtaccaggattggaggatacaataccagattcataattcactgcggccgtcaaactcctagggtcaaccgatcctcctatctcagcctcccaagtcgctcggcctccaggtacccaccaacaagcacagctaatatgacacttttttagtagagacggggcttatgccatgttggccagtctggtcttaaactcctgagctcaagtgatcccaaagtgttgggataacaggcgtgagccacagtgctagccctgtagtttaccagccta

SEQ ID NO: 527171 - DNA, 203 bp, Homo sapiens
gactgcgcgcggcgctctgtacgcattcgatttaccacggccgcctggggagaagctaaccatgcagaacctcaacgaccgcctggtctcctacctggacaaggggcgcgccctggaggcggccaacggcgagctagaggagaagatccgcgactggaaccagaagcaggcacctgatgcctctcgcgactacagccactact

SEQ ID NO: 527172 - DNA, 267 bp, Homo sapiens
cacgtatggacagcaccgtgcaacagatcatccgcctgcagttgtgaactaccggactccccgatctgactgtgtggccgtggttctacgccatcgctggggggctattcctggacagggcctactattacgcctttgccgccacatcacactggcgaccacggacaccacccgcgtggcaatcatcctggtcgcgtggcacaccaagcctgcatctctttcatgttctcctacatcttgctcaccatgtgccgtagcctcatcacc

SEQ ID NO: 527173 - DNA, 1514 bp, Homo sapiens
  misc_feature (398)..(398): n is a, c, g, or t
  misc_feature (877)..(877): n is a, c, g, or t
gctggtgtcgtgttcttgtgctttacttttgtgtttggtttttgttttgttttttgtgttctttctttgtctttttgtctctgttttttttctcttctgtgtcttgtgccatccttcttcttctttttgttttctttatacactcattctgtcttctctcgtctttttttgtccttttcttttcgtgtgtcttcgtttttctctttttcttttgttttggtttttgtttttgttttctctctttgttttttgtgtgttttcatctgctgtcttcctgttctctgttcttactttggcttcttcatctgtttcgctgtttcttctctgtgttccttcattttgtctttgctcgttctgtctcgtcttgttgtgcatttgttgtctctgctgctttgcanttgttctccgacgcccgtggggtggggggggggggtttttaatattaaagcccacggagtgcgttcctctgtttttatgttggggggacccccccgctctcccgcgggatgtttccttccctcgtgtgtgtatccccccccccgtcgctccccacgcctgctgtgtgtgtgtaccccccccccgccccttaatggtggaggacactccccgcgcggcgggccgctcatgtttcctcacgccttcccccggggcttttttggccctatgggcccccccggggccccggtgttaccccactgtgtcacacacacccgggggacacaccgcgtatttggcgccccccttatgagcgcgccatcatctatataggggagccgcacactcatttattggacacacacatgtgtgggccaccacacacataagcccccgcgcgctcggtgttctacccgcgttctctcgccgagatatttccccngcgcgagatatattctctgtcgcagcaccccacacgcgcgtgtctcgcgcgcgaggacgcgcgtggggggggcaccactcgcgcgcgctcgccacactactctactttgggagcacccccacccccactggtgtggcgcacacgctctctctctcacacagtctgctgggtcacacagagggtgtccccacacagcagatcttctctctggcgcacaggacgcccggtgtttctctcacaggtgccgcacacgtggcacaccacacaggtgtgcgcgccctgtggagatatatctctggggccgcaccacacgcaggcgcgcagttctctctctctcttccgcgccacttgtatatataggggccccgctcggcgcgcgcgggggcgcacactctggtgtccacccctctcttgtgaggtctcacgcacgcgcgcgcgagaaccccgcgcagaggtgtgccgctgaggcgcttggcgtgcctctcgcctgggtctttggagtttctcggggtctgaccccacttggcgccgatgtgggatggtctctgtcccccatcttgcctcccttttttttttccccccccaccggaactgaggatgctcccttttaaaaaagggtttttgtttccagagttta

SEQ ID NO: 527174 - DNA, 387 bp, Homo sapiens
aaaaaaaaaaagtgctcatacacccctcgcaaatacgtcaaccgccataaggaaaaaagccccctgctgctatgagctgtctcaacaggggcgtcctcctgggggacggcgaaaaagcagcagtaattggggctcataacagccataatactccaaatcacaggggcctttccacatgtagactctcaaatctcatattacgcaatccacagcatataaaagagtgtttcacagtgtagactcgcgtgcctcaccggtaatgtgtgagaccccccagtgtaattatagtcccagggtcacctgtgactgtgtcagtgatacgccagctgctccactaaacacttcagatatggaagctgtgtggaatcaggcaaaacctcatgaatt

SEQ ID NO: 527175 - DNA, 349 bp, Homo sapiens
taagtaaaaataatttcatgttttccccaaagaaaaattaagcctccccattttaggatcccattgggcagtagaattcaaagacttttcattcaattttggatcctaagcagctaccaatattttttaaatgttagtaataaaccttggaattttgttttaaaaagttcaaaaccttggaaccccgttttctccctacgtctataaaggcccttacagacccaaggctgttttgcagttttcatatggtgtttgctgaagtccttggaattttttttgcctgctttgcccttttttttacaggagttttgagtgtgaaatgaaaattaaagtttgggccctattttta

SEQ ID NO: 527176 - DNA, 602 bp, Homo sapiens
tgtgaagccggacatgaacactggatgtgggctacttgccaagctgttgcaagcagctgcaggtgcatctgcccgggcctgtgactctgtcatcagcaatgtactgcctttacgtgctggaacagattccacaagcactagtcagagcgagccagcggcggacaatccttgtaaatgctcctgggtttcttgaaagctgcacgccatgcataatcggagctcattgaaccacaaacgtatctacaaggcactctgacatggcttcgagaggacctagctgtagcatcactcggtacatctcataggcgtcgtaacgaagacccgcagataccgcagcgttcgagcttgtctaggacagtccgtacacgtgacatgtcttgaggtagccccagaacagagtctccgtatgcttactgaggacttgcgagtctggcgcagtgggtcacacgtgtacagactgagcttcctgtaaggcaggattcccagaagtcgccacgggtggcgagcactggaatgcatcaggaaccctggatgctctctaacctgtggccttcaggcagcatctcgtacccaagactcgctgaggagctgcgtgtaggggc

SEQ ID NO: 527177 - DNA, 326 bp, Homo sapiens
taaggggcttagcagaggtaaaacatttcacagctccctcgaaacactgccccctaggctatcacatagccaagaagggacgcctctatcctgacctttgctgagtgcatctggcatgaatgagctcaaaaggcacttctgacttaaacggactgaggttaccagggaccagacagtgagggcggtgacaggattgaggctagaccggcctggccccaaagcccactgccccagtgactcccaaccttctttctgcctttaagcctttgccaggcagcacccacccatcagagacgcttgtcatgattatgcatttcgtttgccta

SEQ ID NO: 527178 - DNA, 743 bp, Homo sapiens
  misc_feature (704)..(704): n is a, c, g, or t
tggtcatctatgttttgcacgtgcagctacgtgaaaataaaatttctttgggaaggtgaaaaaaaaaaaaaaaaaaaaaaaaaaaaaaaaaaaaaaaaaaaaaaaaaaaaaaaaaaaaaaaaaaaaaataacgaccgcctaaacccaaaaaactaataaacacaaacaaactaatacatgcgaacagggttaaaaactaattaggcaaatttttccgcccccgggcccccttaaattttttagccgggccatttttttcctcggccccggaaaaccccccctttgcccaacttccccttttgggggggcattcccctttccccggcccccgttttaccccagggggccggggaaaaccccctggccaccccaaataattcctttggggcaaaccccctttttccccgggggtgttttataaaaaagcccccccccttttcccttttccaaaaattttcccacccttagggccaaaagaaaattaaccccttaatttttttaaaaaaccacccggaaatttttgagaaaaagcccctttttttaccacaacgccccaaataggaaaaaccccttttaacaaaaaaaaaaaaacccgcatttggggggggggttggcccccccgtggacaaaaaccccctttataaaagggggggcccccccccccaaagggcacaaaacccgtttctcgggggggggggcccccnacaatacctcccccaagggagggaataaacccctccggg

SEQ ID NO: 527179 - DNA, 282 bp, Homo sapiens
cacggagagagagagaagagagaaaagagaaagagagaaaaaaaaagggagaaaacaaaaagaggagacaagagaaaaagaggagaacagggagcgcgagcagaaggacagacacggcggacgaggcaacgagagaagggaacgcgcgcggaggagagagagcgggccgcgggaggggggcggcgcaaaaagacgaagagagagagagaaggaagagaaagaagaacgagcgacataacgaagagacaagcagcaaagagaggagagaagaaagaagagata

SEQ ID NO: 527180 - DNA, 788 bp, Homo sapiens
ggctcaagtgattcacctgcctcggtctcccaaagtgctggaattataggtgtgagccaccacatccagcccattttaaccacgtttaaatgtacaattcattgccattaagtatatttacaatgttgtgcaaccatcacgactatctatttctagaaaattttcatcatcccaaacaaaaagcctatacctattaaacaataactcctcattcccctgtcctcacagtcaggccctggtaaccacctttctactgtctgtctctgaatttgcctattttaggtacctaatgtagtggaattatacaatatttgcccttttgtgtctggcttatttcacttagcataatgttttcaagttcatccatgctatagcatgtatcagaattgcattcctttttaaggcttaatattccattgtgtgtacataccacatttcatttattcattcatcggtcagtggacatttgggttattttcgtcttttggcaaatgtgaataatgctgcagtgaacatcagtgtacagtatttgtttgtgtccctgtttttaattctttggggaatatatctaggtgtagaattgctggaccatatggtaattctatgttttacctttttggaggaacttggcaaactgttttacagcatgtgcatcaattttatattcacctaagcaacgtacaagggttccagtttctccagcatcttcgccaacacttgtaatttcccttttttaaataatagtcaatctgggctgggaacgatggggttgcggcctgttaattcca

SEQ ID NO: 527181 - DNA, 125 bp, Homo sapiens
ccaaattattcttaagcactgataaaattacggtctatcagaggtcaaaattcaagccataatagtaggcagttctttaataagaaaggctactatggtcactcattaaactaagttcataagga

SEQ ID NO: 527182 - DNA, 131 bp, Homo sapiens
ccccctccccgggtggttaggactacaggtgcgtgccactacacctggataatttttgtatttcaagcatagaggggtttttaccatattggccaggttggtctcaaacccctaacctcgagatccgcatg

SEQ ID NO: 527183 - DNA, 123 bp, Homo sapiens
tgtttctttgctcgtgtgttcttgtgctggtctgtctgggtttggggcttcttcagttgtggtacagggagcaaagaacacacgccagacaagaacacacgagcaagaacacatgcaccaaga

SEQ ID NO: 527184 - DNA, 287 bp, Homo sapiens
  misc_feature (151)..(151): n is a, c, g, or t
  misc_feature (196)..(196): n is a, c, g, or t
  misc_feature (255)..(255): n is a, c, g, or t
  misc_feature (287)..(287): n is a, c, g, or t
ggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacnaccatccccgatagaggaggaccggtcttcggtcaagggtatacnagtagctgcgctcccctgctagaacctccaaacaagctctcaaggtccatttgtagganaacgtagggtagtcaagcttccgactcctctn

SEQ ID NO: 527185 - DNA, 952 bp, Homo sapiens
tatcaactcagagatggttattagggccgggaggtaggggatgcgccggcacagcaaaaatggggggccattacgggtgtcgagggtcgggccaatggtcagcgttctggcgagcggtctccgcgtcggggtccgaacccttttgtgccaggccatctctgtaactgaaagctctcgagacgatgggacggtcctgaggccagccataagttcgtttcgacgacatggagcgacaggcgaataaggtggtggtcacacttcaggagcccggatcacatcagcatgagttgtgtggacaagccgcacggtagaatttgttccagcatggcagggggagagcctgcttgagggggtgaggccctggcaaataagaagcccggggggtgggcagccccagggttgctcataacccgccacatctgtgattggcaaggcgttttgaacgggagacacatggcagaagcctgaagggcaatgggtggaatggacatggtccttcacctttgggcgttccttctggagattgcttgatgaagggcacaaccatcttcaccttgagaccttcaaagctgtgcctttgtggacttgatgtggtccttgcccaggaaggttcgccccagggagggtggaaaccttcaacgtgctgggtttaccggaagacctcttcatcaggacttctggactggttggtcggaaaagggccagttgatctcatttccaggagccgaagcagtcagcatgacaagaagcgaacgtaaatggttggcccagagcagagcagctcatccagtgagtgcggacctgccaagagggcggagatggccaccctggaggggaaaaagtcacgtgtggaagcgcatgagccgagaaaaaccagggggctaaaggcgggcggaccggaattggaatggacccacacacgcagaaccccgggagaggtgccgccccctcc

SEQ ID NO: 527186 - DNA, 134 bp, Homo sapiens
agggccgcagttctcaggggactctttgataaggacaccaatcccatcatgagctaatcacttcccaatggtcccaactcctaataccatcacattggtgattaggtttcaacataataaatttagggttgatg

SEQ ID NO: 527187 - DNA, 1327 bp, Homo sapiens
ggagtcctgttggtcgctgcagcgtggcctctgcgtgggcggcgggaatccgcggacatcgggatctgggtctagtgctcccgcagtccgctgctcctgtggcgggatgcccattgatcatgggtctcgctggtgtggtgctgccagatgctgtaggccacacatgactagttccttcttgtcagcttttcccagcaaatgtgcggatgactgccggtgcagctgtggtggggcccgtgtgggcccttggttggccctgggattggggaacctgctgtgtgtgcttcctgcgtgcaggtttctggcagttggccatcctggtggcctgggggtctgcggcctgttggactgtgggccggaggccagaggccgcggagactcggcggcggcaacggccgacggactacacggagtgggactgcccgatcaccaagtgtgggaccgcattggatcaacggacactgaacgactcaacgtccctgtgagtgacgactctactactactatactccctggcccattaccggaactcatgacgactcacttgactattcttatcctggggggccatctctccaacggagtgacggcattatgaacgacttattgccaggtagtgcagaacccagaccccggagggctgggacaagccgacaccaagggtatcaagggcataatgataggcaatcaggggcactacgacttggccacgatcagagacatagaggtgatacaaggtggctaccaagggacgagtgggccaccgaccattccggggggagaccatccattcctaggcacaatgacgtctccgatccgggcgccccgtagcgcaagaaaggtacaggaggaggcaaacaaggcatccggcaagggccccaacactggtccccttggcaacggtcgacagggccgctgccgggctcagatgacatgaacggcacaatacgtggacccaaggcacatggcatagacccggaactgggcaaagaaagagacaagaaagagggaactgggcactggctaaccgacaggcggggggtgcaggcacccccggggacacatcgccaagggcaccatggacgccagatgagaacaccgaggacggaccccggaccaggcggggacgggcaccaagtgcaccacaaggcaacggccacagtgagaacacagacgtgcggacgacgcgccagggacgacgcgaacaacacgacgggggacaaaaacacaggccggtggtggcgtgtgccctggacaggacccaacgaagggaggaaggcttctccagcagcaggcgcccgcagagagacagaagtgtaagagacgc

SEQ ID NO: 527188 - DNA, 113 bp, Homo sapiens
gctcgtccgtatctgtttgcgcacggtgggcgatcagctgggcttcctttgtggcagtccactgttgcatgcttccaggcccaacactgtcttcctctcctcctctccctaac

SEQ ID NO: 527189 - DNA, 332 bp, Homo sapiens
  misc_feature (98)..(99): n is a, c, g, or t
tagctggaggctcaggagtagagtgggggttgggagtgtgtagaccagaactctgggacgtagtcatagtactaatattgaggcagtggagatgctgnncccagtgaggtatcagtagagcagaacaatgaactagagctggttttcctttgggtttaggtgtaagtgaactattatcattggagtggagaactggagagaaagggttgtcactgtccagcactacacagctgcagggacacagaatggtacacattcccatgaaagacacatagtgtagacacggtggctgtacaccccatgcacacacacgccccggtcggggtggagcg

SEQ ID NO: 527190 - DNA, 999 bp, Homo sapiens
gaggcaggtggatcacttgaggctaggagttcaagaccagcctggccaacatggtgaaaccccatttctactaaaaaaaaaaaaaaaaaaaaatttggggggcttgggggtccccccttgtaaatcccttagctatcgttgagaggctgaggccaggaggctcacttcgaccccgggagggctataggctggcagtgagccaaagatagccccactgctctcccagccctgtgttgatcagagcaagactccatctcgaaaaaaataaagataaatataaaatagacttcacagaacttaggaactacctcccagaacacaaaacattcaagattggtcggtttcaccaccctttaatttggggccactgcactaatctggagttttcccccttagttgtttgcacgcgtttaccctacgaattatttttacaggcttacaccttacgacattatttttacgggggctcttcgtctcagcagacctaaaattttcccacgcccttcttcattgtgattgttacgagaggggtaatttgccttcccctttcaaaggccttgggcgggccacagcactttttcattacctcagctcgggcactttttgcggttaattgcggagcgactttgacacaaccctaaaaaacataccaacaaaatacaaaaaaagaacactttttttcgggcgccaccctggcccccatagaaaaagagttttcgttcaaaccacacttcggttgttggcggcgcgcgagccgccagtcatgtataagtctagccaaacgtggtgtaccaacgggtggttcgcacagagaggaagatccctccggcggcagcagacaaaggctgcggtgagcttttcaccgccaatataaaaaaaacgcccggggggggaacccagagcggtttcgtagaccacacccaagggagaggctgggaggaggcaaacagggggaccttaacaaacgggggccacgagaggagccatattaaattgcct

SEQ ID NO: 527191 - DNA, 995 bp, Homo sapiens
taaattagaaacctttatttacaatgacatccaaaagggtcagcaaagcagtcacaagtctcaccattcccccattaagttctatttcagtgtgtggtttcaattcttgtgcaagataaagaataatttctatttttttaagcaacataagtgtaaacttgattgaaactgaattcattctcaagaagtataagtcaattccgtggagaattttaacattatgtgtgcctcctcatattttatatctttctcgaaacctccactatttttagaaaggaagagagaaaacacccgtggctcggtttattaaccaggtggtgccttggacgtttgaacaaccaattaaattcaattccttaagggtttggctcctaggaacctaattgtggtgaaccacaaactcaacaggcttcgtggcaaattaaaaagggaaccgtgggcaggcattacatgtgttaacgtgggcaatccattcgtggtttactttcaggcgtggacccacctcgtgggatcaaagaacttctaggacatcaagccaattatcttctgtaatacccttacccctaatttagatacccccaattcacctcagaattttaacatacgggtaactaaagtagcccgtgttctggcatatttacacctttcaatccagatgccggttagaaaagggggatcctaattgtgaccttttacactggtacactcgcgggtatattttcaaaggggagaaacatgtgtctccgttatatccattcgagactttataaccctctctcttccagctaaatattcttgggatccccgcaaacaaacaccagcgggtctcggaaaattcccccatttttaaagagatataacataaacttttggtccccccaaaatccacgtgtaaaaagggggcgcaagtctagcaagttaaaagagataaaacaccagaatacatctaggaaataatctcaaggatataaatttttccgactaaaaaaaataca

SEQ ID NO: 527192 - DNA, 621 bp, Homo sapiens
  misc_feature (172)..(172): n is a, c, g, or t
  misc_feature (205)..(206): n is a, c, g, or t
  misc_feature (208)..(208): n is a, c, g, or t
  misc_feature (257)..(257): n is a, c, g, or t
  misc_feature (370)..(370): n is a, c, g, or t
ctgccagagggggagaggagcccccccgccccctccccctctttaaaataaaaacaggttgtgcctttctaaaaccaaaaaacaagtcgccaacaaattagggttaatcctaaaggtttggccgtccttttcaccaaaccatttaagaaatgcctcttttgggccagttttntttttaaaccccttccgaaaaaacagggacatnnancaaaccagacggcgagctcatttttaaaaaggtgtcttaaaaacctgcntaatagctgagctaattctcataggcacaactgccttgacttgaggctcactcttgacaagcagttcccacaaatgaaactaacaatgcaacccagaccccttgtacaggtgnaagtttccagctttctcacagtacaagtttaaggtaggacgcagcattttatagtgttaacgtccttcctccccacattcttgtgaggcggaacaagaacaattacttgaccttggaggaagacgacgccttgtggtcagggagagaacagcagttcatgctggctgcctcgtctttccaggcccgctgctgcccaggcttctactgaccttgttaggtctgattctagaaatgaaggcaggtactcaaaa

SEQ ID NO: 527193 - DNA, 862 bp, Homo sapiens
  misc_feature (862)..(862): n is a, c, g, or t
tggctccagcggtggtttatttgacatacaggtaggctctatagcaacaggccgtggaggttgctgcagatagtgtgggggaaaatgtggaagggtggacggggtggaggtgttgtgcgtgcagagacagctgtgagtgtgagagggtgtgggtgcacaggttgcacaactgtgagaagaggccataagagagcttaagagaacgcaatgtaaggggccagggcgccagatgctcggtcttccaatgggcaacaaacaggcccagtgggccctaaagggcccctaaactctcttggcctgggctggtttttcttggacgcccagagcacagggttaggggatgtcctctctggggctatcccatttgtttccataaaggagacactgggacaagatgtcacacaccaggagaaaggaaggcttgtacacccttccttgccattctgggctcccaggggggcctcacagtcacagcattccctccctttctatcccttagattgggtgtggggcgccacattgatgtgggacagccgaggcctcgtgggctgtgtcccaccatagaagcagcgctgacaaaacagcagccagtgttccaggtgagcgcgtgagactctctctttcccgtgtgttgtcccaagccataccaggtgccagcgttcacagcccagaaggtgagcttcctacaagcgttgctggcctaagtggactgaggctgggggcaacagggcggtggcaacacgggcgctagagacagaacgggcccctaggagtccaaacaccggggccaagagaaacacacccaatggaagaaggaaaagcagcacccaggccgcccaccgggccagacacaagtgaccan

SEQ ID NO: 527194 - DNA, 824 bp, Homo sapiens
  misc_feature (12)..(12): n is a, c, g, or t
  misc_feature (112)..(113): n is a, c, g, or t
  misc_feature (115)..(115): n is a, c, g, or t
  misc_feature (135)..(135): n is a, c, g, or t
  misc_feature (138)..(138): n is a, c, g, or t
  misc_feature (144)..(144): n is a, c, g, or t
  misc_feature (159)..(159): n is a, c, g, or t
  misc_feature (172)..(172): n is a, c, g, or t
  misc_feature (179)..(179): n is a, c, g, or t
  misc_feature (192)..(192): n is a, c, g, or t
  misc_feature (195)..(195): n is a, c, g, or t
  misc_feature (210)..(210): n is a, c, g, or t
  misc_feature (212)..(212): n is a, c, g, or t
  misc_feature (224)..(227): n is a, c, g, or t
  misc_feature (238)..(238): n is a, c, g, or t
  misc_feature (241)..(241): n is a, c, g, or t
  misc_feature (252)..(252): n is a, c, g, or t
  misc_feature (282)..(282): n is a, c, g, or t
  misc_feature (289)..(289): n is a, c, g, or t
  misc_feature (291)..(291): n is a, c, g, or t
  misc_feature (310)..(310): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (329)..(329): n is a, c, g, or t
  misc_feature (338)..(338): n is a, c, g, or t
  misc_feature (340)..(341): n is a, c, g, or t
  misc_feature (387)..(387): n is a, c, g, or t
  misc_feature (392)..(392): n is a, c, g, or t
  misc_feature (396)..(396): n is a, c, g, or t
  misc_feature (765)..(765): n is a, c, g, or t
aggatccagggntgggggaggctgggcggggttgggggcctggaggctggggcctggttacttggtgacgtgcagagctctctctggggggctgcagctcatcttggggggnncnggactcagatgcccccgtangtncaaaancaacatctatttctnactcttcccggtnctttttnttgtattcctgcngcnctttctccgccacgntntccataaatttnnnnttcttcctggnganttctacagggngcgtcacagtgatgggatcagagtcaaagngcttcangnccacctcagtgacaccggngggggcgngngngtgagangtgtgggangnnaccgtggtgacccgcagatagtactggtcttcgccttgcgtgaggnttgcnaggngggacacccagttaaactgctcgttcagctgctccagcaaggaggaggtgttgagcatcttccactggtaggactttagcagctcgttgtatttcctggtcaacctctcagcgacctggagggattcgtcgagctcccgcgcgcagcttagcctgggaggggttgttggtggaacagtccacagacaagatctcccggcacttgtcacactggtccttcatccgcagcagcccgtggagttgtggcggatctcccggcacacagtccggtcatcgtcgccttctcgtatgaattctgttggcgggtgctggaaggccgggctgtggaagtggatgtccatggcctgctgagcctcgtgtatcatctcanggaagggctggaacatggcgtggaagttcaggggctcgtacggagagaagggcatcaag

SEQ ID NO: 527195 - DNA, 134 bp, Homo sapiens
atcgtggcatggagtacctggagagcaagtgctagcatacaccgggacctggctgctcggaactgcctggctgacagagaagaatgtcctgacgatcagtgactttgggatgtaccgagcaggaagccgatggg

SEQ ID NO: 527196 - DNA, 240 bp, Homo sapiens
tttgtgctgaacgaaaagcctacactgtcctttcgtcacgagacaacgttggccccaccaattctcactggtttgagctaaagctaccagaagcaatatgtgtggtgtcagcctgatatggtgctggctgaaattctgtacttcatatcctggagaaagcagcctaggtctagcacctcgaggtatagctctgtagccacagaagaagagcaatctgcccatgtagggggtaccgagctc

SEQ ID NO: 527197 - DNA, 1288 bp, Homo sapiens
  misc_feature (275)..(275): n is a, c, g, or t
cagcgcatgcatgtagggatgacagccaaaagtacctgtcagacaacgtccacctggtgtgcgaggagacagccaattacctggtcatgtggtgcattgacctagaggtggaggagaaatgtgcactcatggagcaggtggcccacctgacaatcgtcatgcaatttatcctggagctggccaagagcctaagggtggacccccgggcctgcttccggcagtccttcactaagattaagacagccgatcgccagtacatggagggcttcaacgangagctggaagccttcaaggagcgtgtgcggggccgtgccaggctgcgcatcgagaaggccatgacacggagctacgacggacggaggagcgcaagtagagcgtgcctcgagccccggtcgggcctggatccccgtacgaggttctacgatgtccctcacctgagtgaactccatgcaagtgcttcgagtgtgagaggacggtgcaagaattgctgtcagagtacgtccgaaatcaaggccaagaattggacgcccaacctgacgccaataggtaccgactatgtcagacgcatgctagttgagcttcttgtgtccatcttgtgtggtccgcctagactctaacggcgcagtcgagtgccaacggacgggacgaggacggcacggtcctagggtgaccacatgtactggaacgcttgttcaccaaggatcgtggcgattgaagaacgggatgtcaggtgtgatgaccgtgacccgagcgtagcaccggacacactggcttccagagccccgtatggtgccccattattcagaaaaacacgatagatgccagtctcggaccggctccgtgagcttccgtctaacttgacgctagctccgagcacagcactgaggggaccccgaccaggcctcccatggcctctccacatgtcatccactcatccgagcagcccattccaagtctcatgcttatgagtcaaaggggacttcacgtgaccgagagtgcaaagcgcaaggtgggccgatgccagaggaaactgaaggagctggaggtggacgagggcggacaggcagagctgatcgcttgaggacgaggacagcaagctggcaaggaaggagcggagctgccagcgaagctgcaggacatggccgaagggggacgaggataccaggagcgggacacgccaggacagaggacggacgaacatggaagccaggcgagaaagaggagctccgagaataggagagaaaagagcaagcgcagcacacgcaagacacacagcagacgagaagga

SEQ ID NO: 527198 - DNA, 405 bp, Homo sapiens
cccagctcctggagtccagcctccagcccccggggttcacccaccagcccccggagtcagccaccagcccctggggttcacccagccagccccaggggtccatccgtcccgccattcatgcgggggttcagccactcagggcccccgggtggtgcacccaagcgagccccaagccgttcacgcctcgaggcccacagggcgtgcacctcatacagcccgcagggggcatgcatcccttcaggtgccccctgggcggtgcgagcgccgtcaagccctccccgggggggtcccaatccgggtcggggctcccctggagaagttccaaccccatcaaggccttccgggggaggtttcaacccccttcaaatttcctggggggtgcaagcccggcgaaagttccccatg

SEQ ID NO: 527199 - DNA, 773 bp, Homo sapiens
agcggtgaggtcgctcgggtcgggtgtcgcctgtgaaccggatgaggcggcgacgtgatgccgagccgggagcgggcgtcttgccgagccgggcgggcgggggagcaacggctacagacgccgggggccaggtcgtgagggtcggcggcgggcgaggagcgcagggcgctcgggccgggggccgcggcgccaatgggcaaccggggatggaagagctgatcccgctgtcaacaactgcaggagccttcagctccatcggacagagctggcacctggaccatggcgcagatcgctgtagtgggcggcagagcgcggcaagagctcggtgctggagaacttcggtggggccgggacttccttcccccgcggtttcaggaatcgtgagccgggggcctctcattctgcagctcatcttctcaaaaagagaacatgccgagggttttgcactgaagtcaagaagttacagactttgaattaagtcccggctggcgattgaagccggatgaccgacagggtcacggggaccaacaaaggcattacgcgaagtgcccattcaagcttcgagttactcgccccgacgtgttgacgttgacgcctcatgaactcccggtattagcaaggtgcctgtgggcgacaggctccagacatcgagttaccagatcaggacatatcctgcaggtcatcaggcggaaaggaagcctcattgtggtggcaggccccgccaacttgacctggcaacttcgacgcctccagttgggccaggaagtcgatcc

SEQ ID NO: 527200 - DNA, 395 bp, Homo sapiens
ttcaaatgggcacagaaattggagagattgggtatgtgagggacatgctgatcccaactatattcatattggatgttggcagaggggcagataacatcatgagtgacttactttaacaacgtaatacttagctgtaatcccactgagacgtgtacgaaaagagaaaattaatatgacatactacacagcacaggttcaacccagattattattgcatttctgagggtcatgggaaaaccataccattttgaaccattacctacgaatttactagcacatctgtgctaatctgtcgcaatgtgcttcagtgtccttagctagactgtaagctagtttgctgtaatcttggtctccttcatctcttacacacactaacatacatacacacacacact

SEQ ID NO: 527201 - DNA, 1015 bp, Homo sapiens
gctgcaaaattaagccccctattaaagttaattaagcactcattcatcgagctccccaccccatccagcatctccgcatgatgaaacttcgggtcactcctaggcgactgcctgatcctccaaatcaccacaggactattcctagccatgcactactcaccagatcgcctcaaccggcttatcatctagtcgcccacatcactcgagacgtatattatggctgaatcatccgctaacttcatgccaatggcgcctcaatattctttatctgcctcttcctacacatcgggcgaggcctatatgtacggatcatttctctactcagaaacctgaaacatcgggtgttatcctcctgcattgctaactatagcacacagtccttgctatgaggtctatgatcctcccgatgaggccactagtatcattctgagaggccacgagtgaattacacatacgttaactatccgccatcccatacattgggacagacctagttgcagagtgaatctgaggaggctacctccatgtagacagtcgccaccctcacatcgattcttttacctgttcacgttcatcttgacccttcattgatagcagccctagcagcatccgacctcctattctgtggccgaaacgggatcgaaaccaacgccctatgaaatagctccccaggtgcgataaaatgaacttttcagccttatttacggcaattcaataggaggccctcggccttaattagtctttgcttttctccctttacagaatttataatattcttcggcgagcgcctaggcgaaccggaaaaatatagccttatcaaccctttaaaaaccctccccaggttaaggaccgaggaaatttttcctaggggctcaaaaattccgcggcctcagcaaaagggggcctgcgccaaaaatatctctcctcaagaccccccgtattttcccagttattgccaccactattgcgcaccggcacgcaggggaacacccctcgaaggtacacacactcaccg

SEQ ID NO: 527202 - DNA, 175 bp, Homo sapiens
tcacattggcagatggaatgaacaaagacagctttatgctagaggcagatggtcagttaagttagatttctttcactgtctcagttataattttgcgaaggcagtttctttttttcttttcttttctttttttttttttttttggaaatggagtcttgcctctggtggtcccccg

SEQ ID NO: 527203 - DNA, 539 bp, Homo sapiens
  misc_feature (160)..(160): n is a, c, g, or t
ggcagcagtccatgaaccgagctgagaacaacttctgcgctactgaccctcacctatcgtgtctgcccacagtgacagaccagaggccagttccatgccctccacaggtgactctgaggccactctcgtctcccccgacaggcaactcctagtctgcccncgtccctgcaacgggtgactctcatgatgcccctgtgcccctcacaagtgactctgaggctgcccccgtgtcccccttaggtgactctgaggctcccccgtacacctacgggtgactctgaggcccgtgcccaccttgggtgacactgaggctgccccatccccgctacgggtgactctgaggctgcccccgtgcccacctcaggtgactctgaggccgcccctgtgtcccccacagatgactccgaggaagctcagatgctgcagtcattagtttctagtgtcccatcagccttggtctcaagaggccgagggggtgcaaccccaggggctcccctcccatcttgagctcttcctgaataaaacctcattcccctgaa

SEQ ID NO: 527204 - DNA, 173 bp, Homo sapiens
tcatcgagctcggtaccgaatctcgacagttggcaggcaggctctcaagcaataactctacacacacatacacacacacacacagaaacgctgcttgtttagtttataaaatattttatggaaatggtctgattcaaatcggtctaaatcatgttcctgaacgtaatattcca

SEQ ID NO: 527205 - DNA, 155 bp, Homo sapiens
  misc_feature (111)..(111): n is a, c, g, or t
ttttggtggtgtatagaacgtttcttttcttgtcttctttcttttgtctcttgtttgatgtgctcctatgacttctacctctattctctgggaatgagatctttctccggncttggggcttttgggttcggtcgccgactcctagacttagaatg

SEQ ID NO: 527206 - DNA, 135 bp, Homo sapiens
caagaggcgcgctgagggctgcggcagggacagggcggacgtctctgtgaacctgtggtctgaattacaccttcacctgcgctccggggaaacattcggttccgggtctgatcgcgcgcctcgccgaccccgcgg

SEQ ID NO: 527207 - DNA, 110 bp, Homo sapiens
gcagtatcccacggcacgtgcgtgtgatgagagccgtgtatcttgctagacttgctgtgccagtttcctgatggttcctgtttccacactgactgcataccttcccaccc

SEQ ID NO: 527208 - DNA, 217 bp, Homo sapiens
tcctaattggttcttcgatgacgctctgcttactgcgaacatcgtttactgtattgtagtacttctgtgcgctccattagcatagataatcgaccataggttcatgactttatttctgagctttctatcctatttcactgtttttgtgctaataccatactgtcttgatgactgtagctttgtagcgtacatagaacgtgatcgaagaaccaattag

SEQ ID NO: 527209 - DNA, 1086 bp, Homo sapiens
actcaagcaatcatcaacgactagagaatatcgtagatagtatctgctgcgacatcctgcgatatcgctcctctagctaatgcctagaaggatataaagtagcatagtgcagcaagattcatttatagctacgctcgatagcccgtacaagcaacgcgctagcgtactcgcgtcgtgtaatggcttcaagtaagtaggtagtcgcctattagcaacataacttaagtctattagaccaggcatctgcgaagacgccatgcgagttgagggcacatagtccccgttacttggagctacattcgatatgcctgcctcaaccatcgacttattggtcactgaataaactcagcgcataacgctaacgtcggcgtaacagccatatcatgcgcgaatggcctataaagcctacagtcaggtacctcatgggcatagtctactaactgtaggctagaccagcatgaaccatgtggtaccttgtgcctaattaaaaacctcacagtaacgtagtgcataattcagaaacaagcaaaggcgctagcccaaacaggctcttaaaaattaaatttcacgcctatctatactcgcctccgtgaacataatctctattatgtgaaaactcgagagagtgcgaagtcaaagcggagatcacttgaatattttagccatgggtttactcacgctaaacacattttctttctcgttcacagtaacctcccaccttaaaatcgatacccactcgcactttacactttaggaataagctaagaagcttaaaccacatagaaaacttacgtcatcatatcctgctcatactagccaagaggttccaaagtttggtggcaagagcggctctcaataggtggcgacacctaaacaacctcctaaaagttcgctaaaggattagataacccaccgagccagttaaagtatctaagcggagaaaatcactaacaactggatcactcctttaagcccagatacagtaccatataaaatttatcactttacaaaggttccggaaccccgcgcggtataagcaacaaaaagtcagatacccggttatacgagggtcatattatatacacg

SEQ ID NO: 527210 - DNA, 652 bp, Homo sapiens
  misc_feature (10)..(10): n is a, c, g, or t
agcagtcctntgcagaacccaatcaagccgagattttgttctcggcctcatccagtataaggcagccgttactttgcttagaaggcaacattggaaggttagagtccatcagggcatcacaattttaagatgtgactgcacctgaatacatttgattttctgtaggaagcatagagtccatacccgtatttacagcctgcacaagagactaattactattgaagcagttgattaaacctggtagctttccccaacatgatgaacattcagttctatagccacagctgctttttagaaaatgtgaaaatgtatctcatccctatccataatagcttctctaaagctatctcacagtccctttcaaataactattcaagaatgtaaatgctatattcacgtcttagcaataatttaacacgttttataatatgaacactgtagtttaaaacaaacaatctaccggaagtaacagtagacaaggtaatgccaattccagtgccaagctgtattcgccaagttttcttagaatggcttttcccgattaacgaagtcttatacacagaatgcaccatgcagaaacccatttttgtctaaactggcactatagactgctgctgtaaggcgacgagaatgtaagacattattaaattgc

SEQ ID NO: 527211 - DNA, 256 bp, Homo sapiens
atgtgcttgtccctgtgctcccacggttcccaggggccaggctgggagccacagcaccccactatgccgccaggccctacccaccttcagctgcctatgggacgcagggaaaatctgtggtcggtcgccgtgtggccagagtgggtcgtcgtccaacactcgtgctcgctcagacacttggcaggatgtctgggctcacagctggagcgcgtgcaagccgggcacggtcacctagaaccacagccctcgagcacca

SEQ ID NO: 527212 - DNA, 171 bp, Homo sapiens
  misc_feature (22)..(22): n is a, c, g, or t
  misc_feature (27)..(27): n is a, c, g, or t
  misc_feature (97)..(97): n is a, c, g, or t
taaatcgaccccctatgttggntcaancccatcatggctctcacctgcattaacctaaccatctcgtaacccatctcctctctttgttcctttcctntgcaccctccacatgccacctgccatcagggatctttcaaaatgactaatcttactattcttctcctctataaa

SEQ ID NO: 527213 - DNA, 373 bp, Homo sapiens
catactagaactggctctttgaagcaataacatatatgttttaaaaaaatcaaagttaaaatccctcccttggctaagcgctgtggctcccgcctataatcccagcacttcgggaggccaaggtgggtagatcacatgaggtcaggagttaaagaccagcctggtcaacatcgtaaaaccccatgtctactaaaaaaaaagttagctgggcatggtggcacgccctcgtaatcccagctgctcgggaagctgaggcacgagaattgcttgaacctgggaggcagaggctacagtgagctgagatcatgccactgcactccagcctgtgtgacacagtaagactgtgtctcaaaaaaccaaaacaaaaaaaaaa

SEQ ID NO: 527214 - DNA, 174 bp, Homo sapiens
agcacatggctacttcatcctgcaacagttggagatagagtcaagagaccaagcactagtatggcccccaccagagaactggctcaacagatccaaaaggtaattctggcactggagactatatgggagccacttgtcatgccagcattggtggaacaaatgttcgttccattt

SEQ ID NO: 527215 - DNA, 890 bp, Homo sapiens
gtgccccagaaacaagtagggacacttaatttctcactcgcttgtttccccattcctcaactcttgcctaaatatatgtctgttcaccaagcatgtatcatatacttactatatgtatgccagacactgatggccattatccaggcactgcagaatacagcagaagacatgcagcacacagtctagatcttcaaggaatcagagtccagtggacaaataaatacaatacagtgcaaagggcacaaccaaacaaaaagtcatgccataggaagcagaaacggccataacaggaagagagttcttcataacctgggatgaagtgcagcatctgggttggcacagtcctcctgtagctatgtccatcttccacaggataaacaggacatatgcgcgtaagtcaaggtggcacacctcagttatgcagatgatctcacaaccagaaaattattctcttcacaatgattcgatttcagcttggcactggcccgcatcatatctactctttgtcagccacaaggcattgtttcagagttttcactatgccagcattcacctcggagcaaacctcgtcaccggcggtccacgtacctcccaggtgcctctctttctaccttacaatctctaagtaagtcgaggcgctcgctggtcctaccactcatagggctcctacttccagtattctgtgtaatcctcccattcatacccctcccatcctatatccttatggcacaactgtgtatacggcaaagagctgccgccgttcactgtgcctacacgaactacctacacaactggaatgtgagtgccacacggaaaaacttcgaacgacatccactcgataacgaacctctgagctctacatggcttgtaaccaagcgagaacaactcca

SEQ ID NO: 527216 - DNA, 310 bp, Homo sapiens
  misc_feature (86)..(86): n is a, c, g, or t
  misc_feature (100)..(100): n is a, c, g, or t
  misc_feature (132)..(132): n is a, c, g, or t
tgtttaccccccccccaacattgcttttcacaaggcttgtctgggacaatgaagtgtgccttttaacaccaagccgagcccctttncctaggccccaccngggttgcacccaacccctgggctacattactngaatggcaggatgccctgtgtttcattccagttggttttgctgccccccagggctttccatgatgagacaacccactcctgccctgccgtactttttccttttagcccttatttattgtcggtctgcccatgggattgggagccgcccacttttgtcctcaataaagtttttaaagta

SEQ ID NO: 527217 - DNA, 318 bp, Homo sapiens
gaccagggctgggaatggggctctccctgggaaccacagcaatgtggttctgcaattggcttggtctagcactactctccatgaaaaggatcaaacatggcttgagcaactgcctagaataggcaatctccatgggctgggttgctgcactttgaacgcagtgacttgcagcagtgttcttcagctcttgatagctcttccgggtatggcaggaggtcctggagacaaactttgttcgctggaccctgtcgccgccggcccggcgtcccgcagctcgatacttcgtaatcctagctcgtagcgtttttcctgctttga

SEQ ID NO: 527218 - DNA, 275 bp, Homo sapiens
cctccccatcacccctatggaacacccttttttattttatttatttcttttttttggagaacggattctaactctgtcacccaggctggagtgcagtggcgtgatcttggctcactgcaacctctgcctcctgggttcaagcaattctgcctcatgcctgtagtcccagcagtttgggagacctaggtgggaggattgcttgaggccagcagtttgagacgagcctggtagcctggtcaacatagtgagaccgtggctctatttaaaaaaaaaaa

SEQ ID NO: 527219 - DNA, 190 bp, Homo sapiens
tgttgcctctcggtctatttttgaataacctaggaaatatctaggcagtgtaggagatggagaaatagtagagtttgatgtggttgaaggagagaagggtgcagaagctagcaatgtgactggacgttttttttttgtttttttgttgttttttgtttttgtttgtgttttttggtttttttgtttgttt

SEQ ID NO: 527220 - DNA, 428 bp, Homo sapiens
  misc_feature (38)..(38): n is a, c, g, or t
gagctcggccgcccaagaaatattaaaaaacaaagcgnctcggttaaaggaaaacgcccaaattacgggctttttttttccgcccgcaaacaaaggggtctggggtttttcccccaaaacaaaaaaaggccaaccaaaaaaaggggggaccccagtagttttgtgggtttgggtccaaccctctttccctttgcctggggggctggaaccagtccccccccgctggggttttctcctttaggggtcccagggcccaaccccaaaggcattccctttgccctgagtttgaaagggggcccttttggggttccttccccccagggaacctctttccccctgggccccccccgggggggaggggggtaccccctcccagggtttttttttcctgtgggggccccccccaaaaattaaaaaaagctttgtta

SEQ ID NO: 527221 - DNA, 228 bp, Homo sapiens
gaactctacacaacatatttggtcaccaagaccctacttctaacctcccggttcttatgaattcgaacagcatacccccgattccgctaggaccaactcatacacctcctatgaaaaaacttcctaccgctcgcccgagcatttatttatctctccgtccctccccacactcatcgcccttagcacgctactcctacctatctccccttttatactaataatcttata

SEQ ID NO: 527222 - DNA, 102 bp, Homo sapiens
  misc_feature (26)..(26): n is a, c, g, or t
aatcatacagcagacactgcgaggcncaggtgtatagctctatataccatgaaacaaaggcttaggggcaacaaggcttccagctggatgtgtgtgtagcat

SEQ ID NO: 527223 - DNA, 595 bp, Homo sapiens
  misc_feature (495)..(495): n is a, c, g, or t
gccgttgcagttctctttgggtgatcgctccttccctcttcaacggatccctccccgcctccatcctcgttctgtgggagagaccagccttctggtgctgcagtcaggaatggagcttgatagcgctctggaagccccatcgcaggaagactcataattatgtccgaggagttgtctcactccgcctttggacaggccttctcgcaagattttacactgtcttgcccgcaccggaggctacgacagaggcaagcgtaaccagatgcgagttctataaagacctcgagtgatctaatgagaagccacacggatttgagtaggttatttgacggggagctggtgcacaggctccgcgggaatgcccggagacacttggggcatggtagcaacaagccctggagcaagtatgcagccccgctccaaggacggaggaatggtgcgaggtgatgtggcactctcgaagcgtgcgagaatagcagcccacagttgggttanctgtttcgttaaacgtgttacgggaacgttgaagactgctaaggaattgccctggtcgagcctggcttggcatgacgtggcctgcgatcgacttgggcag

SEQ ID NO: 527224 - DNA, 159 bp, Homo sapiens
ggtcccttcccaggctaactaaatagtgaacctcgtatccatgcctaaaacattatgttgagggggctttctcctcaaatgcatagacaataacacaaggacacaagaactacaaagaacaaaagaaatcccaaaagaaactaataaagcttcagtaat

SEQ ID NO: 527225 - DNA, 284 bp, Homo sapiens
cgctatgtctgactcgctggatcacttctttgagccttagcatctcctgtcaggtaggaatgaacttgccagcttcaggctcgttcagtatgaccatctgtgcggtcagggtacactcatgtctcctccccaactccagcagcctttaagaagttgtcctttggcgccccctggaggcagagcattgagctggaccctgtggtagactcccacaggcaggacggagctggcctcaggagtgggacacccagacttggcaggtttttcaagaggcctgggtgggg

SEQ ID NO: 527226 - DNA, 311 bp, Homo sapiens
tccattccaatcgattccattccacccgattccattccattggagaccgttctattctagttcattccattcgggtcgtatcgattctattcctttccactcgattccattccattcgattccattccattcgattccattaaattttattcctttccattcaattgcattccattcgagtccattctattggagaccattgcattcgagtccattccattccagaccactcgtatccattcgatgcgaatccattccatttgaatccgttccataggactccattcctttccagtcgaatctgtgtcgac

SEQ ID NO: 527227 - DNA, 141 bp, Homo sapiens
ggaaacctctgcgccatgagagccagtgaggagagcgatgcaggctgagccaaaagagaagatgaggcagagtcagtaacgctagctgtgcacgtgagcacagagcagaacatgatgcagacgctggatctgtacagtgtg

SEQ ID NO: 527228 - DNA, 356 bp, Homo sapiens
  misc_feature (66)..(66): n is a, c, g, or t
  misc_feature (84)..(84): n is a, c, g, or t
  misc_feature (156)..(156): n is a, c, g, or t
accatattatcagagaccagagacagtagagacagagacccagagacagagggagacagagacccngagacagagacccagagncagaggagacagagaccctagacagagggagacagagacccagagacagagggagacagagacccagagacngagggagacacagagacccagagagagggagacagggacccagtatacaggagagacagagacccagagacagagggagacagagacccagagacagagggagacagagaccctgagacagagggagacagagaacccccctgtctctctctctccgtctctctctccctctctttctccgtctctccctctgtctctgg

SEQ ID NO: 527229 - DNA, 207 bp, Homo sapiens
acaaagccatctggaccagaattccgacgatattactattgaggagtacggagaattctataagagcttgaccactgactcgcgagatcactctgcagtgagcatttttcagttgaggacagttggattcagagcccttcttattgtcccacgcgtctccttttgatctgtttgaacagaagaaagacatttcaatgtatttcgagg

SEQ ID NO: 527230 - DNA, 570 bp, Homo sapiens
gtactcaaagatatctgactattctaagcaagaaagtagtagaattgtacacattgccatgagatggcactttctgaggatactcactaaaactgagtttcttcattagaaaatctcactttttatcatcatctcagtgcctggtattggtgctcttaggtctgtgaacagcattgcgttatgccagtaaatgaatacttaaatcaataattgcattctcagcagtcctcttagtccttgtttgtttgtttgtttttcacagttgaattgcaatgtagctgtttggcagaggcattaacatttttgccctaaccctggcctggtgcctaggctcaggggagtaaaattagagccaggagccaggaggctgaggagaccacttaaaaggcatgctagcatttgataagtaaggggttactttgtgaggaaaagaaacttttatatgctttaggcaagcctctttatgaggaagaaaaggtcagctactgaagcggggtcccaactactgctgggtttgtagaggagagagacacccccataatccagatgtttcagttaacaatcagacac

SEQ ID NO: 527231 - DNA, 437 bp, Homo sapiens
  misc_feature (170)..(170): n is a, c, g, or t
tcatgacagagcttacagtagtgatatataggactctactaatgacgaagcagcaaaatactgcaaaagacttgcgttttactctagagatagttctacaagtcgagtgtcacttaaagctaaggtagatagacaggtgagacattgtaacttgtagctatatacttatngcctgttcaggcttttatctgctggtgacacatttcgcttgttgtgctttgttctagtctatgataataaactataatatctctaaatcctaagcttccttattcctggctgggaaaacaaagctgcttctgtttcctgtgttcatcactttaactttgtaatctagtacttgtgtactgtgtaagaaatgggtgtacacccatatcagacattgtagtcataggcctatcaggcactgaacgacgtctttaaagtttactgctgta

SEQ ID NO: 527232 - DNA, 271 bp, Homo sapiens
gtagctgcactccaggcatgattgagatagggtgggtgcgatattaattaagcagtagatcactatcgtttggactatctcgaggattagcgtggtctaattcagtctccttcgattttggtaccctgtgtgtgattgtcttctcccacattcccccctacctccccacaccttgtttttagtgtattctaagcattttgcataaactattaatttcccaccactggtttttttgttcgttttgttttttaaggaatttggccttatcgag

SEQ ID NO: 527233 - DNA, 1024 bp, Homo sapiens
tggtgcttgggactgccccaaagggcacaacaggttaattggtggcagcagtggggaaaatacatgcgtgttgtgatcttgtgccacacgtctcaccagctcgtcctttcttcttacttgggcaatatgtgaggttcagaagagatcgccctagtgtgcagcatctggatagatgctccatctttgccatgtgcacctcaggcaatgtgtgtctaaaagtggtccctgagaaggtgcatgccctcacagacgcagcctggtgcaacaagcacgccaagattgtgcctgtgtgtctcatcatcgtgcgcagtgtgggtgagaccacatctcccaacatgcctttgtcgtgctcctacaacagtgctcccgtgatgcgcgcatgccaccatattttgcgtgttggtggcgattgctcctctcactcgtggtgagcagcccactttgtgtttgagatatagattggtgcgtgtatacaagcacagtgggactcgtgcaaatagtgggtgtcacacatcagctctaggttagaataggcaagggtgtttgatatattagaactactaccagaaaagagatgcaaaatacgctattgaccaagacaatcggcgcggcacacaattgttactaataagactcgactttttcaatagtggcccatgttttgatttgagcatcgaagcctcagagggacaatacaactaccaagggagaacagatcactaaggagagcagcgaggcgagccactacccaaatacataattgaggggaggaaccacccaatgaggaaagcttcatacgcgccgggaagaaacaagcccgttacttgggcggcgcgacgcacaaataaccaccaagcccccacctgtagaccacctgttgtgaagaaggcagacaaaagcagcaaacagagggagaagccaaacaacaatataccaaccctctacaacttgggcacatagaggtaaactacccagtgacaagtggcaaacacttggtccacatacgacattcatagcaacaaaa

SEQ ID NO: 527234 - DNA, 169 bp, Homo sapiens
ctgtatcccagtactttggggacaccaacgcggcggatcacctgacggtcaggagtttgagccactgtggctggactcattttcgtgttgttgtttctattaatctagagatggggtttcactctggtgggtcaggctggtcttgaactcctgagctcatgtgatccac

SEQ ID NO: 527235 - DNA, 324 bp, Homo sapiens
tctagaggatccctgcacacgccgagcatccatactcaaagtcgcaatggacgaagttgttgacacgccgaaaatccataccgccgcaagtcagggtggacgaagttgttgcgcaacaacttcgtccattccgatctgatttcaagaagtgtctggttattcggcgtgtgcagcaacaacttcgtccattctgatttggtgtgtgggggataaggcaggtagagtgctgagggggaggtatggagactcggcgtgtgcatgcacacgccgaatgtccatactgcacacgccgagtgcccacacgagaaatcagagtggacgaag

SEQ ID NO: 527236 - DNA, 910 bp, Homo sapiens
agcctaattattagcatcatccctctactattttttaaccaaatcaacaacaacctatttagctgttccccaaccttttcctccgaccgccctaagaaccccctcctaatactaacgtaccgtgagctcctaccccgtcacaatcatggcaagccagagcgcacacttatccaggtgaaccacatatcacgaaaaaaactctacctctctatacgtaatctccctacaagtctccttagttataacattcacaggcacagaagtaatcatattttatatcctcttcgaaagcacacttatccccaccttggctatcatcacccgagtgaggcaaccagccagaacgcctgaaggcaggcacatacttcctattctacaccctagtaggctcccttcccctactcatggcactaatttacgctcacaacaccctaggctcactaaacattctactactcagtctcagtgcccaaagaagtatcaaactcctgagccaacaacttaatatgactagcttacacaagtagcttttagagtaaagatacctcttgacggactccagttatgactccctaaaggccatgtttgaagccgcccatcgctgggtcaatagtacttgcgagtaatcttgaaactagggcggtatggtatataagctcaaaatcattttaaaccctgagaaaagagatagctaaccctttctgttatatcctatgaggtattattacaggttcattgctagaaaaagactaaatgggatggtagttaaaagaatgctgtagtaaagatttttaacctggaggttaaggggagtttatggcgggatccaaattgggaaaaagagggggggaaactcggggagaccaattgtgtaagggggccaagggaggggtgtattttataagattag

SEQ ID NO: 527237 - DNA, 189 bp, Homo sapiens
cccccccccctttttttcccccccccttttcctttggccttttaatttccaggcgggggccccctgggggccccaaaattttaaaaaggtttttgggtttcccaaaagccccccccggggtttttttttgttttttccccccattgttttccttttttcccccccaaataaatttttttgggggcttta

SEQ ID NO: 527238 - DNA, 268 bp, Homo sapiens
ggttctgaggagcaggcgtctggcccacccaggctcgggcagctctgtatagctgcattctcccgtctgcctagcagccacttgtccgcatggtcctgtcttgccccagcggctggtcaccggacggggcatggtagagccatggtagccctgtgagcgttcgggagtggggccacctgggttcttgcgggccttggggcttctcctgctttcctgtgggttctacctgtgcctgcagtaagggctggatgttccgacgagcgcgctt

SEQ ID NO: 527239 - DNA, 91 bp, Homo sapiens
  misc_feature (7)..(7): n is a, c, g, or t
  misc_feature (41)..(41): n is a, c, g, or t
tttggancccattggatggccgcctgcatttcggactctanaggatccccccaatgcatcttcttatacttgtgtaattagggaacacatc

SEQ ID NO: 527240 - DNA, 165 bp, Homo sapiens
tacgaccccttccccaagtgagcgtctaacgttatctaactactgtcattccctcctatacgagcactcttagttatctaatgctatcttccccccattccgagcactcttagttatctaatactatcttccccccattctgagcagtcttagataactaagagt

SEQ ID NO: 527241 - DNA, 292 bp, Homo sapiens
agtttcgacggacactctcttttttactcctggctggtctcgatctcctgggtctcacgtcagttctcctccctcaggcttgtctgcctgggttacgggctgatctatacgcaggcctgtgctatctatttctaactgctattcttggcagtctgcctcttgagacctctgaataatattttcttatgaaaaattttcaacataccccaaaacagagaacctaattaaatgaacccacagtcggccaacaataatttaacatgaacattttccaatcttgaattatttacgc

SEQ ID NO: 527242 - DNA, 240 bp, Homo sapiens
ggggggggggggggggggggggggttttttttccttttttcccctccccccccccccccccccttttttttttttggtctgggggggggggggggggggccccccccgggttttttttttgggggcccggcccctcccccctaattgtttctctggctggttcgccggggcggtgcgcgtggggatctcgtttaacaaatgaaacaagtgcttccccaacaaacaatctaaagaccaaca

SEQ ID NO: 527243 - DNA, 150 bp, Homo sapiens
tgccaaagcgtagtaccaatcacgatgtgtctgtcgtgtctgaatgtatagagtcgagggagggaaggaaggaactacatatagagtcggagatgatgcagctacacacacaattccccaggcccaggttgcatgctgtgtgtcagacca

SEQ ID NO: 527244 - DNA, 235 bp, Homo sapiens
  misc_feature (22)..(22): n is a, c, g, or t
  misc_feature (76)..(76): n is a, c, g, or t
  misc_feature (82)..(82): n is a, c, g, or t
cagaagattgcttgagaccagngagtttgagaccacccccctggcaatatagcaagaccccgtctctgcaaaaaanattaanaactttagcaggcatagtggcctgtgcctgtagtcccagctactcagtaggctgtggtgggaggattgcttgagcctaggaggtcgaggctgcagtgagctgtgatcttgccactgtactccagcctgggtgagagaggggaccctgtctctt

SEQ ID NO: 527245 - DNA, 139 bp, Homo sapiens
gtaatgaggtgcagtgcactccagcctgggcaataagagtgaaactctgtctcaaaaagaaagaaagaaagaaagaaatgctctgcagtcagctgtgagtaaatgccaggcacggtggctcacacctgtaatcccagcg

SEQ ID NO: 527246 - DNA, 778 bp, Homo sapiens
gacggttgccattggtcgctccctgagaggatgccgctcgcttggtgttgtgcgtggctgacttgtatcagcggctagagcatgcttgctgaaaatgttgggcgtggtgctggctgacagaggggccgacccggtgtacagtcggtggacgattgcacgctagtcctcgatgcggcatacgtgacccggacgcggtcgtgcggctgattcttgacccgtgacgaagggcattcgcgttggacgctctgagagcctccgttggaacggcgcctgagtcgccacgacgtggtcatcctggactcgcttaactacatcaaaggtttccgttacgagctctactgcctggcacgggcggcgcgcaacccgcgtctgcctggtctactgcgtacggcccggcggcccgatctgcgggacctcaggtggcgggcgcgaacgagaaccctggccggaacgtcagttgtgagttgagcggcccacagcgctgaggaggacgggagacgcccaggcggcgggcagacagcgtcctcagggaactgcatacttgtcggactctgtagtaaatggcaaagtgcccagggcgtacgtatccaaggaactggagtcgagaagaataccggggctgacggagtctccagctcttgtgactccggattcagagaaatcttgcaaagcatgggttcggtgcttttactctcccgaaaatctggagggccttaatgcttggctttgaggctccgattctcggaatccgtgggaacggctttattcctttggtggc

SEQ ID NO: 527247 - DNA, 568 bp, Homo sapiens
tgacgctgcccgagcccgcgcccgcttgtcgccacggcacttgaggcagccggagatactctgagttactcggacgtcccgatcgcctgagggtgatatgaacgcgctgagcctccctaaccgtccggacctgtgatcgcttctggcagaccgaaccggtgctccatgactcccccgggcgatgacgcagcagctcccagccgcccagacagcatggcgcccaggccagagcactcccattcaggcttaccccgtggacgggactgcccacccttttcttcctcctgtcccccgtgatagggcctccatcaagccgcgccatggagccgtcctgacgcgggcctgggagcctctagaggccctggctggtggaccgcagtatcaacggagcagctctggtagaagctggcctggagggataagctaggactcctctggtcaatcccctcatagccccttgggtgcagactgcccttgcaagtaggaggctcgcgagacagtaggaggcccttggacgaggacggagcaaacactgggtggctgaatacaccagcagttcccttcctga

SEQ ID NO: 527248 - DNA, 196 bp, Homo sapiens
tagtttatctaacactacaggggtccttaagatatgtagccttagctgggtacagtgactcacacctgtaatcccagaactattgggcaggccaaggcgggtggatcactgtgcggtcagacagttctgagaccacgcctgggccaagcatggttgaaaccccgatctcgtactaaagaatacaaaacattatcca

SEQ ID NO: 527249 - DNA, 1282 bp, Homo sapiens
caaggatagaccacatgttaggtcacacaaatctgaaagtattctaagagaaaaaaacagaaaagaaaaagggacaggctttggaggtggattatcggcgacatctcggggcccacaacagtattaaaatattagaaattcgagtaccaagggaattttggggaactttatacaacaccactgtgggcaattcaaatataattatactccttggaaagaaagcgggtggagtctacaggtgaaacaaagaatgtaacaaaacagggcaagtgtggacaacaaaatttttggggcaacccaaagtgggattgtacgggaacacacaaaaatttagcacaagaaaccttagtggggaattaacaaataaaaaggcggtggtccctaaaggagagcggacaatttataatgagacataatagagtatacccaataacgtgtggacacacaaccacgagcgaaaaaagacacccctatagacacaggtgggtatttctccacaagggaactgtgaggaagaacgagccagagaaaatctaagccgacaaagcccccaaaaggtctcagctacgacagagcaaaaaacggggcccaacataggggaaacgggaatctcgggggacacgcattcacggggttagaaccgcgggaaaacttacacacgacagcagacaaggtattcacggagatagagaacaaaaaggggtgggatcattggggaacaaaggttttaaactcaaacattgtgggccaaaactcgtcttgtaggcccggaggatctgagggggacaaataaatgagttaggaacaccaaattaagagggaaaatgtcgggatttgtggaaaagagggaacacattgggtcaatgtggccacgtggggcaccacatgtccagggggacaccaatagaagggggacaacatcgtgggaggccacacaaattgtgcccggaaacaacgtgggacacaattccgaaaaaacacgggtgatatacacagccccttcaacacgttccgcgcacacttaaccaacgagaggcgaaaccccagcgagaacaaaagcccacaaacacggagcgcgggcacgcaactcaacagcagagggggagcacccaaaggttgacaccgacaaaagaagtctcccagcagacgatagaaacggcccggagacacaaggggttcaaagagccgggaatagattcaccaaaccgggttgaagcactagcaaggaaaaaacgggcaaacgggtgcgccccgacagagtacacaaagaagagaggagcga

SEQ ID NO: 527250 - DNA, 119 bp, Homo sapiens
tgaagccatcagcgtgcgcgcgccttccaggtcgaagcgttgaatatgaatatcgcgtgtctggctactcatcaggtgcacccacggcggttaggcatttgcgcgctctggcggcgcgt

SEQ ID NO: 527251 - DNA, 381 bp, Homo sapiens
tgaccatacacccactgcaggcgctatacttctctggcctcccactctcctcaggcacctcatgatctgcccgccttggactcccaaaatgctgggataacaggcatgagccactgcgcctggctggcaatttcttaaaatgagacaacaaataaagttgacacattgactgacttttcctttcacaaaagatttctctgtatgtagcatgtgatgcagtttgattgcttattatccacaggctttcttttcaaaactggagtcagtcctcccaaaccctgactgcttctgctctatcaacttcgtttatgtaatattttaaatcccttgttgtcatctcaacaatgctcacaatgtcattaccaggattagattctatct

SEQ ID NO: 527252 - DNA, 278 bp, Homo sapiens
gtcaagggagggacctgtaatccccatgtatcaagggagggaggggattggcccatggagtcagtttcccccatgctgttctcgtgatagtgagttttcatgagatctgatggttttataagggtttgggagcccctccttcatttttttttttcgttcccctttttgaaaaagggcctcgcttccccttcactttttgccatgattgtaagtttcctgaggccccccccccagccatgtgaaactgtgagtcaattaaacctctttttttttttata

SEQ ID NO: 527253 - DNA, 104 bp, Homo sapiens
tgacggcagccgttgtcgtgaggccgacgggccgaatgtaggtgggttgagcgcgcgggtgaagcgggcaaccgcagggctacggcggccggcagggggcagtg

SEQ ID NO: 527254 - DNA, 766 bp, Homo sapiens
  misc_feature (264)..(264): n is a, c, g, or t
  misc_feature (305)..(305): n is a, c, g, or t
  misc_feature (571)..(571): n is a, c, g, or t
  misc_feature (574)..(574): n is a, c, g, or t
  misc_feature (586)..(586): n is a, c, g, or t
  misc_feature (594)..(594): n is a, c, g, or t
  misc_feature (606)..(606): n is a, c, g, or t
  misc_feature (694)..(694): n is a, c, g, or t
  misc_feature (723)..(724): n is a, c, g, or t
agcggctgcctgggcgggtgtcctgtgacttgacagtggctccccaagccccaaagccagcccccttcttctgtgacttagtctgttgtagtggtgagctgacacgtccaggtgtgaccgttgctgaaaacttgtgccccctctgtggtatgcccctgccctgttctataaatagctataaattctctctctcacacacacacacacacacacacacacacacacactatatatacctatatatatacgtggccaactgcctcncctctagcactgggaatcagtcccgtgctgtgcttgtggantcttgtagcccagcaagaggaagctgtctcctgacatcgcccctccaaagtgcaccacctccagtgagcttccgggacatgcgcggctgtggacagccagcccccgccatccctcccgcccttctggccaagcatggcgggtgctgtgcaggcagctgtgtggcctgacagtctctaccagtcctgctgtcccttggctgagaaacccatttctggatgacagagaatgtgtcctctgctggctgtgttctctatggagctcaggnganggaaaaggccangccatttntagggtgctgtngggagcagtgaaaaggtcacacccttttcaagggacacttttcctggaaagtccctggagcttagctggctcttaccctgtgaagccngctctggcactaggggacagggccctganntcagctggagggaacctgcggggcacccggcactctgggagg

SEQ ID NO: 527255 - DNA, 115 bp, Homo sapiens
ggaagactgagacaggagaattgcttgaatcctggtgaggctggaggttgcagtgtagctctgagtatctatgccactgtcatcccagccgggtgcgagcggagcacaaaaaaat

SEQ ID NO: 527256 - DNA, 487 bp, Homo sapiens
ggtcgatcactgtactgtgattacaggcatgagccactgtgcctggcatgtgtcctgtgtatttgatacaaataaatttgttgtagccaaagcaaaaaaaaaaaaaaaaaaattccctcagttccctctttttttctccttgaaaattaaaaaccctattacctaaaacataaaatttttaaagattattagggccctcaggttactatattgattccaggcatcctatttaactctatgtcaggcagctcccctctgtagtgtccccgaaatatggcgcaccattaaccaaatgggcttaaagatgtaataaacattgggagaataatcgggtgtctccagttttaaccagtacataatatttggaatttcacattacgtgatccgggaataatgcctattaaaacacctatttaggaggtcctgtataaagtgctaatggtacaaggcacgtcttaagtatatggtaatacttctagtgggtcct

SEQ ID NO: 527257 - DNA, 702 bp, Homo sapiens
  misc_feature (702)..(702): n is a, c, g, or t
acaaacacttttcatttcagatcgacattagacttatctgacttcactggcctcaataatgtcattgaacaatgaatttcctatttccgcatggaaagctattgatccatatggctgcaaaacattactatataccggtactaaagggtgccttaatacaatcaaatctgctatacaaagtatctattgcacaatggccgggctgtggaaacttttccagaaagtttccaatatcacgtctacataagttgaaaaatctctccttagtgcttatcttctaacttaaaattcacctggaactttaaattggaaaggattcttttacatcagtggattataggcataatactgcttgcatctgaattgtctgcaagtgaatcatagtttaatagaggaactcatgatttgtactattgaatgattaaactaagtatgaagtgataccattcagcatggcatcaggtcattgcagctctagctctgtgtaacacatgcactcactgaaattccagtttctaggattagtgtacgagcctaacgtgcttctactgttgtaatgggttaatcctgcattacttaacaatctatgtcaatggcactgggtttaattgctgctaaagaaataatgccctgcgtttagtaacatatacagctcaactattcttgaatatattttgaccaatgtttgtcttccctttgtcn

SEQ ID NO: 527258 - DNA, 284 bp, Homo sapiens
gagaagatcattggtacagcgtgggtatcgaggcggacgacgaccaggctcaaaacaaggttatcagtgagcatgaatggaaaaaacagttgaagacgtcattgacccacgggtattaggcaagcttgccagtgtacctgatggtggggctgtagccgtgctctgctgcacccaggctctgcagcgcctgctgctggttctgcgcaatgctgcaagcagaggatgaagaaagattgagaagaaggaggagtcgaagagttaaacgcatgacatgggattgcctt

SEQ ID NO: 527259 - DNA, 309 bp, Homo sapiens
  misc_feature (147)..(147): n is a, c, g, or t
tgccccttgggcctttttgggggccccaaaaaaacaagttgggcaaaaaaaaaggggggggccgggtcgggaatttccgggaatttttctccccccggggccgggtttaagggggaagggccccccccgggttttttggtttagggnggcccccctcccttctttggggttttgacccttttttccaggggggcccccccctatggggggcccccgggttttttttcccccccccccccccctccccctggggtttttttttggtaatgtggggggggaatgaaaaaaaaaagggattttttgccccca

SEQ ID NO: 527260 - DNA, 605 bp, Homo sapiens
gagttgatggaataggggtggggtggcataatgggttgtggggggtgagggaaaagaaagccacaggggacagaagtggtgggtagtctttggttttctttttggtaccaaagtcaactggacgtgttttatatttttaagaggtcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttacaaaaaaaattcagggaaaattaaaaacctggaactccataaggtactgtcttccataatgtctgccaattctgaggaggatggtagtagagagccgggcagggacctaagttcctctgaaagggggctttttctctcaccgcgatgg

SEQ ID NO: 527261 - DNA, 288 bp, Homo sapiens
  misc_feature (160)..(160): n is a, c, g, or t
tgtatctggaagctctatgagtagtaaaagatagagataggaacttctgataatgttgagctaatatgaagtcaggagtctgtgcaggtgcggtggtcaggctgtaatccagcatttgggaggccaaggcgggcggatcacaggtcaggagatttgagancatcctggctaacacggtgaacacccatctctgaaaacaaaaaattagcctggcgtggtcgcagatatcctgtagtcccagctactcagaaggctgaggcaggagaatggcgtaagacccgggaggcg

SEQ ID NO: 527262 - DNA, 310 bp, Homo sapiens
gtgcagaagatccactctagttgagacaagaattggcaatatgcatagctccggaaagagtgctgactttgtatctaagacctgccagggaataccaagagttgtttctacagacttttttttttttttggtttggaaaaaaatcctgtggcacccaggaaggattggaaaaaaattcctttcctctacagcaatttattgtgaggaagcccctccattcctcgggctattaaggtgttcaaaatcagttccctaggaaaatatcccattgtatgtattttcctgggaactcttattcttgtctcactct

SEQ ID NO: 527263 - DNA, 370 bp, Homo sapiens
aactccctccaagtggtttatttaataataataaaaaagaaatgcccacacataaacctgaactcccccccaccccaccctcctttactcccagtaactagctccaaaaggaaaaaacttcccttgtcccacctggggactaaattcccacctcccctgccttaccgcttgggaaccaaaataaaaaatttgcggcggctcaccccccaccccacaattgaaccttacacaatccccttaaacaaaaaagccaggactgggggttcacaggaatgaaaggagccctattttctgaaaagggatgaaaagagaggtgaacccccccacctcaaataagggcttaacccccacacctgctttttcctttacc

SEQ ID NO: 527264 - DNA, 412 bp, Homo sapiens
cctgggtacactacatgctcatatgtaggattggaccgcgcaggctcggacagtcagatgggccggagctcctcctgctctgcagggtcacagaggaaggtaagtaatgcagataccctagtccaggccgagcttgcactagcgtcttgtctgctgctgctgaaccaagatttagctgtgtgccctacttgcagtctcatggaaccagcaggaggaaacatgggggatactagactgtggcggtgagaggatgagaagtttatccagagccatgagcctaagagcaccaggctcctaatggagctgggcctcatcagtggcatctgcatcatcgtgggcaccatcattggctctgggatcaacatttccatcaagaatgcgctcaggaccatgggctgcagggccctgcctc

SEQ ID NO: 527265 - DNA, 445 bp, Homo sapiens
gattccactgatatgacgtacctggagtcagcagagccacagagacagatggtagaatggtgagtgccaggggctggggtccattgtttaatggctacagtttctactgggggtgatgagatagtggaaaatagtgatgacggtgcacagcgttgtgaaggcaggaatgtacctaatgccaccaaatttcacacgcggaagtggttaagtggtcaattttatattatgtataattcagcacacagaccagcacggccccaagtgcggatgcagtaggtcacggccagccgcccgccgatagcctttcagtctgagggacagcacagacgtgatgtgtggccgggcatggcccccagtctgtgagccatagagggtgggactgggtgtcccagcaggaatcggggtgtggaggagctgcctagatggtctggagagggcagatgga

SEQ ID NO: 527266 - DNA, 130 bp, Homo sapiens
ggtcttagcgactatacatcaagtccatccaatacaatccactaagcaagtgcacaaattctagtatactttttagagcagattaagatcgtctatccgtacttttgacagcctaatacctagttgcctt

SEQ ID NO: 527267 - DNA, 97 bp, Homo sapiens
  misc_feature (15)..(15): n is a, c, g, or t
  misc_feature (28)..(28): n is a, c, g, or t
  misc_feature (33)..(33): n is a, c, g, or t
  misc_feature (38)..(38): n is a, c, g, or t
  misc_feature (43)..(43): n is a, c, g, or t
  misc_feature (96)..(96): n is a, c, g, or t
gataatccagagggnatgatgctggctnttgtntattntctcnctgctttagttggaaaaaggccctcaggttttaattattttcttcccaaaatna

SEQ ID NO: 527268 - DNA, 982 bp, Homo sapiens
agccagagagaacggtgtgaactgcactaacccatatcgactgcatacctattgtactcattcagtgccattgccatgctgatgctgtttgatcgtcagttgtctcctgtactcatctagatcatgcctatgggactacgatggggcatcataaggcccaggatgcctgctgcgcgcgtttcatcgatgctcactttccgcgtgtcgcatgcgacgaacgatgtctggcaccgccggacgtcttgattcatcgtagacccaaagggttcataaccggcatcagactgcgtgggccaccgagtgtaagatcaacctataactagtggtgactgcagactcaatagataggagacgatgcgacacttttcatccctgtgaacgtgcgtggctggtggttcaaacagaacagccagtgggcagccagtgatggagccgttgctggctttaactgcaggcaggccccaccctgtgcacggtttgcgcctgcaattcgctttgcgcgcacccggggccgccgctcattgcgctggctttccccttgtgtaaggcacgcactgcacaaggaaaccgtgcgaaccacttggctggcatgtgtggtccacccacagcgaggcccggagtgtttgacctttcagcccatgccgccgctgcccgcaggccctttgggggggcacccaccgggctcgttcttcgcgcatggatacctccacgcgatgtagcacctaccgcacaccaggaccttggtgtccacgcagatatttcgcgtaaacagtgctaggggcacccccaacgggtactgaccaacagaatgctacacgcgagtcactgtagccccgccacgtgcaccacacaccgtctcgccacccttctttcacattcgactcttcgactcacgacaagcaactcctctttcccgaggggccggacacatctgcagcccgcccgaacacaccgaggcggtctttgcaccaccacctttccc

SEQ ID NO: 527269 - DNA, 147 bp, Homo sapiens
aactgaaaacgcagaactctagctcacaggtacatgatggagcgctgcaacacctgatacatcaatgtcctcttcatcaacatcataatacctacaaaaagtagtcataccgagaaccggtgccggcagctggatagtgcacactag

SEQ ID NO: 527270 - DNA, 1644 bp, Homo sapiens
  misc_feature (476)..(476): n is a, c, g, or t
gtgtaggctgagcgatagttagctacgtcacgaagtgtttgccctggaccagctctgtggatctgggactccgaggagaaacgaggcatgagcgtgatcctacgctgcttgtcccttgaggcggtggtgagggcttggcgcgggtctccatgatataccgatactgcgcaggcatgataatagacaccatggcccccaagtgacagtagtcgccaagcatgaactataccatgatgtcactgtgctttcagtagaggaagtaagcttctctacgccctgacgtaccacgttgtgagtggcagaacgggtacggacaatggcactcctccttcttcgcatagtgccacacttacgcgtcacattagaccgttcttgctcgaacacgaatctcggaaccccctgagtaaattgcgttggggaagaggtcgctggggaccgacgcggtaaagtccccgaggactgtttgtagtctcttnaggtggagggcacctcgccggggcatgagacaccaggacgtggcatctcgatggatgacacgacatcgtagaaagtgcgtgcgctggccctaaggccacgaggaaaatctaacgataggtgtgcacgcctcaagtcaggcaacaggaacggcataagggaaaagactcaaatcaccttcgccaggttgcacgccgttcatggcgctgtgcttcaccttgttgattgagcagaaggaagagggagcggttaagagaaatcggttcaatttacaaccaaggaaaaaggcctttggggaaccgttccgaggaaaccaccacagagaaaccttgagacgccaagggtcacaaggccttggtgattcccccgactccttggttacccgttcgcgtgactatccttatatacaggccccccggcccccttgcaggtgggggaaggccgttggttctccaatgtttacgagcccggtgtgcacttgaaccgaggcgatccatccggactgcccaaaaggcccagaaagtgcaagtgtgcccccggtgtgggacccccgcggagatcccttcccttttccccccgggggagtggccccccttgtgggcctcccgggccctttggggccccttaagttgccctatttggggcaggccttgaaggcacgtggatgcgcctcggtgtgtgtgccacggtggctttgggggttggggccaccccccttggggccccgggaccttcccagcggttgcgaatgcacaccggttggcacccagggctttccacggtccccttggggaattcccaggggccccaaccggagggggcctcaggaggcaacgggggacacatttcctatgggggttggtatgacacccccccgggttgaggaccttttgaaaactttttgccacatattgtgcaacttgaaggcactctatttctacaagaaaaagctaggcctaacccatggatatgaacaacccttcaaatttgctccccttggccccattcttttccgagtgggtggagttctttaccaaaaagagagtgttaccatataattctccacgctacaaaggggcctagaaggacgatatgatgtatagtatgcaccaccatcacaccgcgtggtgtatctgcgcacacacacattcaaatctggttttcaagacc

SEQ ID NO: 527271 - DNA, 1061 bp, Homo sapiens
ggctgcgagtgcgatcacggccggtcaatcgccgagttagagggcccgtgaggggcgcggccaattcgccgccgcgggccctgctccgtgtgctggttttctccgtgtggcgcctcgtgcgtggaacctgggagatattggtggcagcaccttgggggatgccctggctgggtgcggttcgctctttgcctgaccgggcttattgctctctctctacgcgctgcacgtgaagtgccgtgcgcgctgccctgggaccggtgattaccgcgcgctctgcgacgtgggctaagccgacatcagcctgttcgtcgcgtcttctcctccatggtggtggccaggggatttctgggctggtggatgcatgtgctgggacacgtgacagaatcctcaatcattccgataggcctatacggttgccatctatctagcaacagcttactagggttacttgtgacgcgttggcttgcggaccactgctgggcgcctctgatccgtgaagtgcttgcgtgaggctcaccatggatggtctcttcggctggattccttgtcatagcccttggccctggaatcccttgtaccattcgtgcatctaatgactattccttggaattgactgtttaatccactcgatcatattgcttacttcgaaaccgttgatgccgtagaatgattggctcacgctttccccgggaagggtccagagaaaagacccccaaagtaggaccaacagtagcctaaccaagaacgtagccaccttagaggtcaaccccttcaaaacgccccgaaatgacccacagagccgtagataggcgtacacaatctcttggcaatatcaaggatctcttttgggaccaatctcgttgaacaaccacttgtgaccaaattaaagggagagagagcaccttaatccattaggagagtccccctctagcgacaaagagaggcgctattagtaactagatagacagggcatttactctagagaagttaactcagcccattaaactgcactttggcccatataaccccaagacacagcattgcacgtataatgggagccc

SEQ ID NO: 527272 - DNA, 155 bp, Homo sapiens
tgtgacatcagcagatctgctcgctgagaagtcttgctgggacatcgaagattgaggactactttccagaatttggtcgctacactactcctgaagatgctactcccgagacgcggaaggacccacgcgtgaaccgggccaagtacttcattcga

SEQ ID NO: 527273 - DNA, 272 bp, Homo sapiens
gcggctgaactgtcaggtcatgggtggtgtacatcagtgaggcagcagtcgcagcaggttcagttgtggcaatccaaatcattcaggatctcagtcatcagcagcatcaggtcgccttcagtgttgtgtatggttcatccatttgttttgcaggttcagttagcattcagtcattgttgggtggtgattcagtcggttgtagcatgcagcatatttggaggtggggcatcactagagggggcccatcagacatgcatcagttcagacggcgg

SEQ ID NO: 527274 - DNA, 879 bp, Homo sapiens
  misc_feature (243)..(243): n is a, c, g, or t
  misc_feature (879)..(879): n is a, c, g, or t
gggcccagtcctatgcggagagactgcgtctgggttggccgtcattcacggggaagctcagtgcacgaactggacatggacgatggtcgtcactccccgccatatggtcaaaaatgctactgtgcacccaggcctgagttgccattgatgatggccaaagagaagccaccgataactgtagttggagatgtggaggccgcatcgcaatcatcgtgcatgacatattgacgatgtggagagttngtgctgccgcggagatcctgaaagagagaggcgcctataagatctatgtagtggcacccaggaatcctgtctggcagaggtccctcgcctgattgaggagtcctccgtaaccgaggtggtggtgacgaataactgttccctcatgaggttcagaagctgcattgtcccaagataaagactgtggatatcagttgggtcttctgaagccattcggagaatccacaatggagagtccaggcctaccttttccgaaacatcatgtggatgactagctttcacgaggtctcgacccctggtacctcctgagcggaagcatgccaaaatgcagcgccatgagtggtacaggtggttccttgcaggggaggactcgaagagctggagtaatttctcttttgcccgaattatgcgacgaggctcacacagtccggagaggcagagtatgggtattttaaactgcgtaatgttgtgtataaccggtcctaaagttacgggtaaagatggagttttgaaagggggagggcaagtacttatgatatgtgccagagggagggccgagagggagggggaaaaaggcccacagttagggttgctctccttctttcctctttctcgttcttatcctgttataactacgcn

SEQ ID NO: 527275 - DNA, 513 bp, Homo sapiens
aatcccccccgcccgctggagagtgtatataataaataacacagagaacttttcttttttagttaaccctctctccacattattccctctcgaataaaaccccacactccaccccctctcttttgtgcactcctcccccataagagaacaccccccggggcccttcttctcacccctctctccggctgctctctattcctctagcgcccgcggggcggagaataacacacatttttcaccccgcgcgaaacacacctcatattgccccatctcatgggccctcttatatgggggacacacacatcatatataaaacaacacttgtgttcccacacaaaacaccgcgcgctggtccgcgctccccggatatatcccgcgcggatatatatttttgccccccgcgctcccgcgcggggagagagataagcggggggagcaaaaagagagagagagaggggggcgccactcttttgtgcgggtggtttttttataaaaaatggggaaaccccccca

SEQ ID NO: 527276 - DNA, 736 bp, Homo sapiens
  misc_feature (736)..(736): n is a, c, g, or t
agcggtgccccgcctgctgcggtggcaccagccaggaggctggagtggaatgtggcctgtggggcgggtatgggactagctggctgtgtgctgccctgagactgctcagcgtggctatatactcgtctggtgtgtggcctggctggtcatgtcttgctgtgcatgctgtgcaggcaagactggttgcatgttgaatggacgatgtgtggctgtcgttggctgtgtggtcctgcatgctttcaggcaggagcctgcttgcagccagtggccccagatcaatggttgggaagagtgccagtccacatgacatgtgtgatgtgttgttttgacagtgtggatgcgcatgtggcaagcagagtgtgaacccctgtgacagaggcttgtttcagaggtgcagacgaatgtgtgtgtagccttgtctcttggcaggtttccttgtgtgtgccattccacacaccatgggatcggttccagatgaccagcagcacttgaccaggggctatttgtctgtggaggcaatgttgcttgatgtgcatctgaaatgtggccaatgtgtgagtgtccacgtgctgggattgtgcacttgttctagagggtgattacagtgagtgcccctttatgagatgagcatgtggctgacggttgtgtgtggccggcagaccccagcaatttggccgtgaaaggtggcacacgtggtttctggggcatcaccgtgggccttgagattccccaaccn

SEQ ID NO: 527277 - DNA, 599 bp, Homo sapiens
  misc_feature (599)..(599): n is a, c, g, or t
atttccttactgcctcttgccttcacgtgggactgggagtctattaatccatgttcttatgtagaccgtgcctgcggatgccttctgggaggcggatgtgtctgccctacagtcttgggagccttatgcttgggactcatgtttgtggctgatcaagtactgatgactcctgtaggactacagtgccttatggctggtataatgctgcatcctgtgctgcctcgtgcactgtgccctggaactcttgatcatctggcatgctagcaacgtgaccgaacactgaactcctgggccacaggcatgaagtccaccttccagggcgatattgtgtgggcttcacgtcctccgagacactgtatcaagccagacctatccgctccccttacttgcagtgacctacggttgcagtgctacaggtgatgagtggatgaatgatcagactgtgaactacgcaagatgaactggtaggatgatcaacatatgtgcgactctgacttgatgaatactagcacttgcagactcatcagaggctatcgcattgacaatgccaatagagtgctgccgaggactgcagaatatactgacgtcatgagcttcan

SEQ ID NO: 527278 - DNA, 258 bp, Homo sapiens
ggtgtgtatgtgtagtgtgtatagtgtgtgtagtcatgtgatgtgtgtgatatgtaataccatgatgtccatgtgtgtggtgtgtggtgtatacgtgtgcatggtgtgtatgtggtgtacgtaagtagtaacatgtgtatagtatatgtgtgggagatgtatgtggcatatagtgtgtagtgtatgactgatttgtaccgtgtgtatgtagtgtgtacatgctgtatgtgtatcaccgaatgttgtatgtacctggtg

SEQ ID NO: 527279 - DNA, 340 bp, Homo sapiens
cccgtgcagggtactggtaatggacatccgggaatatggagaagtaattcagctacagagttgaccaacggcaagaacatatgccagtgcctcgtagagatgggacgggctaaggacgatcagctgaaggttcaggggtttaaagtgctggtggctcactgaagcttaagtgaggatttcctggcaatggagtagaatttcccttctctccctggtcacaggtttaaaaacctcacagctggtttaatggtaaccattgggggtccgctggtaactgggactagtggtacctgccttcatgagttactcttcagcagagtcaccggcaggggttccgagc

SEQ ID NO: 527280 - DNA, 232 bp, Homo sapiens
tgactagcgttccctgtattggtggagctctcggggtatcgcgtacccgtcggggcttccggctaggccgagaacgtgtcgtgggcagccagttcgctttacgccgatgactctgctagtgcaatggatttcggcgtcggtttggtctcgggtgtagcctgagactaggggaaatcagtgcctgaagcctcctatgctggcaactacagatcctatagcataggcacataat

SEQ ID NO: 527281 - DNA, 142 bp, Homo sapiens
ggaggacaaaacagacaaattccttgattctagtaaaaggagagaaatgcaagcaatgacgtgtgtgtccagggaggtgctgccagaaagccggttaaaggcccaggagtgagggagaagctctcggaggcagcacggtcag

SEQ ID NO: 527282 - DNA, 217 bp, Homo sapiens
tgaatacacagcgattgtaaatgcatatagcaccgtctagggcagggtggaaatggtagatgggaaataaaagctgggggcctttataatttggaaggttttttaacttttggatgtttgaactaatccgaaagttatatgtgtctagagtgttaaatatattttaaaacgctggtttataaactcattaacaaagattatttatggtaaacagcac

SEQ ID NO: 527283 - DNA, 269 bp, Homo sapiens
ctctgaggatcccctctgctcctcttcgaggatgaggacgatgaggatgacgaagatgatgaggattacgatgacgatgaggaagattactccgaaagaaagaagctatggagactacaccaaggcaaggaaagaaagcttgcaaagtttgttcctgtgaaagcccagaacgttgcttagggataagataagaagaggatgatgaggacgaagattacgacgacgacgaagatgatgaagatgatgatgaagattattaaggaggagga

SEQ ID NO: 527284 - DNA, 998 bp, Homo sapiens
  misc_feature (204)..(204): n is a, c, g, or t
  misc_feature (458)..(458): n is a, c, g, or t
gatatatggtccgcatgctcctgttacttgactcaccgttgttcgatctcggccgaggcaataagtcgtttcacgaatgcccgagcgcaagagtcatggcttgtaaggcgataccggaaatacaccctgtgccagccggaatgtggctattcactcgcaatacgtacatcacactaactaagccgactgtacatactacccttnggacacaagtgctgcttgctgctgacagttgaataatgagcgtcgcatcaatcacagcagacatcttccaaactggaataggcacccatctatctgatatgtcctaatctagagcatctttgcatacatcacttacaaggaagaaacactaccttgatggtagaaggtcctcatagcacgatgaggatctgtaatcccatcatgcagtaattccaccacatgcgatgtcattcgatttgcacagtcctctctgnagcataggttcacatcccacgatttgacgtgctccatctaatctattcgaagccgagggacgtctagagtggttgggacagtcaactctaattgctacgagtcgcattaaagtcaaacttagttgacaagtacaaatttggatggaccgagtcgtgaaagagaaggcttactcaaaataaaacaagaaccaaaccatccacacgattcttatacctataacacttcaatcttgcccttcaattattgcaagccctaagcagcactccaacctctctaatttcttgcaacgaaacgggatcaaaaccaagccccctagtgaatcacctcccattccgataaaatcaccttccacccttactacacaatcaaagaccgccctcggcttactttctcttccttctctccttaatgacattaaccactattctcaccaagaacctcctaggcgacccagaaaattatacccctaccaacccgttaaaacccttccaacgataaagcccaatatatttcctattccctacaaattctcccaatcc

SEQ ID NO: 527285 - DNA, 347 bp, Homo sapiens
cgggaaggctgccagtgcatgttcaggacaggtccagtgccagtgcaagaccaggctaggacagggtagcacagtgtccaagacagtgtctatgatgggaccaaagcagtgacagggcctagagtccaggtaacagtagggcaggtacagggcaaggcagggcagtaaagggccagatccatggcaggggcagggcaaagacaggcccattgccaatgcaccagccctccctacaaagctcctacggcctggccaccgctgcagcccatccatcgctgtaagcctgacccccaaccctggctgcagccgcctgccctcctagcacagccgctctcctaccgctctgg

SEQ ID NO: 527286 - DNA, 100 bp, Homo sapiens
ctctggatgcaaagtgtcacaagacgcagaactagaaattttagggtgataaagaaggaatgaaagtaggccacagtgtctcacacctgtaatcccagca

SEQ ID NO: 527287 - DNA, 1340 bp, Homo sapiens
  misc_feature (1)..(1): n is a, c, g, or t
  misc_feature (718)..(718): n is a, c, g, or t
  misc_feature (752)..(752): n is a, c, g, or t
  misc_feature (853)..(853): n is a, c, g, or t
nattattttgctatttcgcttgttgtgtttcttttctttataatcgtctgttgtcgttctcttatgctttgctactgggcagcctaccgttcagtgtgttacccttagtttttcgtcatggcgggttgtacatgcacggggctttttctccttcctggtggttggttagtatatgtcccctctgtcttgtgcgcgccgcgtctcccttgtccccgctccgggctcccctgcgggttttttcctccgcgctcctcttagtgggtgccctctttcttcccctctggggccctagggggggccataaagttccccctctggagatacggttctctcgggggtactcccctctctggggagataaggaagtaattttaaaaatggaatctaaccgggttcgcaacaagaatcattctggggtcctccgtgtctcaattttgggggattttccccattaaacgagtgttctttgggaattaccaggaatttctcccctgatcaatccacggagttccggagccctttacgtttcacgcaatttacccttcccgatttgattgagggaatgaaattattgggtgggcacacctggggagtctccacccgagagagaaagggttttatatgagccgtcgtctgtggccctctggttcacatggtcacatttggagtcacttctttgtaacacctccgccactccccttaattgacctcgaatggntgtaacacggcttccccaggtggctcccctaatnccacgttcccacaggagccctctcttgagttaccacgccaccacggagaacttgagttcgcttggggagaacaccccacgcgccccttgggagacacttgngagaagacacccgtggtgtttccctgggccccccgagatccacgtggttttggggccactaccaagtggtgtttcttcgcacaagggtgttgtgacacctggaaacattttgttaaaaacccaccccaccctttggggaacgaccatattcttgaatattatcccatctcccccacccatttctttccttggaaaacccatcccagttcaccagcgtattatttgccccagtggagcctgtccatttaatttgaagccacctctggattccagatggacaccattaaattgtcttcctcgattcttccctcgggtgtagagagatttttaaacatatccaatggccatttcaagatttttttggaaaccagcataggcctgtataagtgcgtggtccatagccccagtgacatagccagcatctaataaagagtttcccttgtagaaagttttcaccaaaccttgaataaatccaatctttaaattg

SEQ ID NO: 527288 - DNA, 327 bp, Homo sapiens
ctggagctgatgagctagtatcctctacttgatgaattacgccaagagtctgcctgagtgggcattatcgccgtcaacacctttgctaaggactgtgaggtaccccaaccctcctcatcctgatgccctggcagtgcggaccatgggctgcatccgcgttgacaagatcacagagttcctgtgcgagccactccggaagtgcctgaatgacgaggggccatatctgcgcaagacagcagctgtgtgcgtggccaatctccacgacttcaacgcccagcttgtggaggaccaggacttcctggacacccttaattgacctcatctccg

SEQ ID NO: 527289 - DNA, 206 bp, Homo sapiens
gctgatccgcttagcttaaacaggcattaacgctatctttaaatctgcaagtggcaggttaagcttgtctggtcaacattccagtgtggcaaacaataattaaaaccaatcttattctcttaaattctttggcgcaaccaaaaactcattagtcactcagctatttggggcaccagcacaaacatcacgctttccatctcatacat

SEQ ID NO: 527290 - DNA, 928 bp, Homo sapiens
gggcgcgtcggatcctcctcatgatgatgactgcgccctatcttccctacgctgtcctgtaccaagtgctgaacatcagcttcggaatcactgaggacattcgcacgttccacaatgcatgagttccatgcttgcagtctctgtcgatccatccaacttcgactcttacttattgggagcacaatggcggtatccatggagtcggaaagtgactagcactagtagcgacatagatgcaaggcagtggatgatatcacgctgttaccatagcatgatagaaagtcgcatagtcacgccacctatcgatgaacccatgcatggctgcagcacatggggactgcatgattatgtcaacagcgttgctgcctctgaattcccatgtgaatcgacccaaaatgcactcgacctattgttgcgctcgaaaggccaactagaaaaggagacttctcgtgacccttatggtcgcccgtagagcctccaacagtttacagagaaaaccattgcatacgaggctgttgcttggggctccaagcctagcttgctctcgcgatgtaacccgggagatctggtgggcccccattagaacatatctctctgggatgataactggtgcagggtacttcccaatactcccacctaggaagggctgccttagctctgccgtttaacctaatcccggcagcgtgcctaagacgcacggttacagggtcgggtggctgccgctagcggacacaccctttgacccaaacttcggggggacctttctccctcctagatctccactgggttccgactttagatccagagggctttgatagacctcctcaaggcccagatcagttacaatgcctccttgacatcccctgtgacattggttcctcaacaagaccaaatggtcccaggccccccgcaccaggcacacatggcg

SEQ ID NO: 527291 - DNA, 395 bp, Homo sapiens
ttggatgattagtgacttatcaagacacaggacttgcaaatggcaagtgggaggattgtttgagcccaggaatctgagaccagcctgagcaacatgatgagaccccatctctacaaaaaattaaaacattagctgggtgtggtggcgcatacctgtggttccagctacttgggaggctcaggcaggaggattgcttgagcccagtaggtcgaggctgcagtgagctgtgattgtgccactgcactccagcctgggccacagaacgagacttcatctcagaaaaaaaaaaaaaggttcacccagggcagacaatttgtccgggaagggcagagttaaatttccctgtgactgcagggttggggcgcttttgtcctctgtccggaaagaaggcggcc

SEQ ID NO: 527292 - DNA, 242 bp, Homo sapiens
agtggcggctgcgtgacagcctgcgtacggctctcatcaactccactggggaagaagtgggcatgctgcagctggtgcgctcagtgactgtggttgaggacgactagcattaggatggagattacctgctccatcaccaccacgttatgtcgtagccgccgctgaggccgagcctgcactgtggccacccagccaggtcttggggtgtcagcctctcccacagccatccccgttggttggag

SEQ ID NO: 527293 - DNA, 1074 bp, Homo sapiens
cctgtacaagtcaatgttggggggcaggcacaagctgtgacaggctccatccagccccatcagtgctcaggccagatctgtaacacagcagtagtaatagacccaggaagaccagctcttctactcgcttttctttacgacaacggtataccacttctagcagctgtccgccttcgggatctctgtgccaaacctagactacttgcagactgaacctgacggaacacaaactctggacctgctttgcaattctccataattcagtgtcctgaacttatgatggacagacatctggaccagttcattaatgtgtgccatatatgtgatggcaaaggtcaccacaagaagcatcacgtccttccagcaacattcatgcgtaagcatcaggactcagccgcaggaccggagcccaggtgtatagcacagtgtaaagataaaaggggcacaacgcaaccgagaagcaaatactaggcagaagggcatcagcagaagccgatcaggaatgctcccaacagcaagtaaaaaaaagatcagaaccgagcacgagagtccaggtcccagtcatgagggtccaagcacgcacacttgccaagataccaaaagacccagcaaggggatacatacacaacagcataactcggcacacaggtgccaaaagacgaccatgggaaagaagaggagagaggggcgaacacaaacagaccacacaagaaagagtctaggagtaaaccagcatcacgaacataggccaagaaagtacgcacaaggcacacacgcgcggcaccaccaaagcaaaccacatccaccggaaccaccaggacccacagacaaaaacgagacacaaaacaaacggacaaaatagcaccaaatacacctggacacaaggcaccaccagagaacaaaggatgtgaaacacaaccagaaaacaacccaacaggaagcagcacccctcaaggaaaccacagccacgagcaaccaaccacaccaaacagacaacaccccccacaaagaagcaacacaacacaacccacacacaaccgacacgaacacacaaaaacacagaacaacgccagc

SEQ ID NO: 527294 - DNA, 606 bp, Homo sapiens
  misc_feature (365)..(365): n is a, c, g, or t
  misc_feature (448)..(448): n is a, c, g, or t
  misc_feature (478)..(478): n is a, c, g, or t
tgaaataacatagaccaggagggcgtgggtttaaaagtcacagatggggcaccctcgggccatccagcccaggttttctttagcccctatgatgttcattttgtgttatatcccattaggtgcccatatttaaaaatgggagatttcacataaaattaaaaggtctgcattttcttttttcttttctttttttgttttttgggagaacacgagtctcactcgggtcaccgaggctagaaggtgcaggtggccacgaactctcgggctcgacgtggaacctcgggcctcccgaggttcaaggtaattcgtccgtggcctcagccttcccaagttagcgtgggactacgaggcacggtgccaccacngccacagcataatttgtgggttattttataggcaagagcagtggggttttcaccaacattgtggccaggagtgattctcgaantctcaaccttcgtggatccacccaccttgngtctcccaaaggggcggggattacgggcggtgagccaccgggccaagccaaggtcggcatttttctttagaactcagaagacccaatagtcctagcgccccatcctcgcatgtggagcaagctaaata

SEQ ID NO: 527295 - DNA, 1161 bp, Homo sapiens
tgtgtctcatcaaagatatggtattccgtctcttctaatggtgtcgctttgagcgcgcttttttattttggtctttcgcgtggacacccgtcttgttgtgagtggtagaacccttttcgccaacttgcgtcggatgttgactgtggatctatagactgggttgggggcctctttttgtttcatgcgcctcttgccctgtgaaacattaccactttccagtctgctgtaacccagttgttatactaggtgttctgttgctttagataatctctctgttttgtgtttttaattggtgttgttcttgtgtgaatgtgtcatctttgatttggtgtagcgtacctctgatgtgggattacagttgtccaactcctcattctcggttggttcggtgtttcctcacagggggtcgtttcctccactgtagtgcatatctcactcttatcaaaggtccctatttcacttgtcctttttctgttgattacttttagtgtatagtcattcttaaggttttcgtcatcgccaagtattgtctctatcgagttacactgggggctatgttgtacgcaattctctgagtaagtctccttcccgtgtgtgataccattttctccttcgttataaatatgctcatttttgacaatcacttccggcctttttttgttataacatccttggggtaatggagagcgctggtttttattgacggtcctagttagttagacttggaagtgtctatactcttaaggtacttgctaaataactaccctcagatgctttagagggagcatgttttgctatacattactatattagttaatctctgttatgtgaactgtacctaaattcttacactgcctgtatagctttagtatgacgctgatacactgaaatgaaagatttgatactgtatattgtgttgcgtatgaaaatgagttgtgaaagttgttcgagtacgatattagcgtttagtcacttgtgttgaactaagaaactatgttgtaaagaaatttactagtatatatatgcctttttcctagcctgtttcgttcctgataatgtagtattgttcactgtgttggtgcaatagaacatgggaaaatgcaaagttctgtgtttaaatttcttcaaaaactgatataataaagtgcctggatctatagc

SEQ ID NO: 527296 - DNA, 173 bp, Homo sapiens
acttcgtccttacacctaagcaggtgtctcctctatcttagggcccatcaatctgatcacaacaattatttgatatcagaccccctgtgcataacccaataccgaacgcccctcttcgtctgatccgtcctaatcacagcagtcctacttctcctatctctcccagtgcttca

SEQ ID NO: 527297 - DNA, 400 bp, Homo sapiens
cggtcgaaggtcacgcggaaggtcttgtgatgccggagccgaagatgtcgtcggtgtcgaatggcgtggtcgtgccctgcgagagccgttgtttctcctcgtgctcgaagacgagcgccggcaccttgcccgtcgtctcgtgaatgcgcccgttggcgaattcgtcgcgccaggtgagcgcctgtcggttgagatcgaacagatcacgaaaccgccggccgggccagaaacgctcgcgcacgaagccgattccgcgctcgacgttgggctttccggtggggcgcgccgggcgacacgcggtgatcgcgaagccgcgtaccgaggcgtactggacgaagcgtggatggaacaccggggttgcccggtgctcgaggacgacggtcttcatgttgtcgagcac

SEQ ID NO: 527298 - DNA, 1231 bp, Homo sapiens
  misc_feature (380)..(380): n is a, c, g, or t
aacatatgactaagtcaaatcttaatcgtcaaaacaatataattaagcattatcgctaacatctaaagtgtacgataccctggattcatcttatacatatcatatcctgttaatcattgtaaaattgtccacaaaataacactcctcgatatttccataccgtacactcaaatttacaccaaatcctaccacgaagcatatcatagtataagccgtaggctaataggtgcagatccctcttaatagacgctgggcgacaggtgaatgtagtaaggcgtgtgcagcgtctataggacttaaaggaatgccctttagcagagcttctataccgaccaaggttcacgaccgtagaatctcattaatcccgcgaatagcagagnttgaattgagtccgaaatactctagttcgagatctacttcattacaagggcaaaattaggcccatgggccgaattggtccctatacccgggttaaaccattttgaccttgccaatagacgcgagccacttaacatccaattgctcgaacccattacactttgtgtacacgcccgccccagcgcacattaattaccataaatatgtgcaaaactccacatttaacgctccatttacaccgcatagttatgagcttttacctctaagtcagtgtccaccccatatatattccgtaaatgttttcgcttatacaataggaagaccttagttccccgttcatgggaaaaaagttaccgcctttggacttcccgaccctttatttaccatgtcccccaaaaaggaccccttataaccgcagtttaatattcttaacacaaccattgttccttaaggggtttataaaaggcccgcttctataatagcaccatggtgccaacggtataccacaaatattaataacaatcccaaaaggagaattactttaacgacagtttaaacaatgaaaagcgcacaacattccttgtgaagcacaggaacaaagccgcacaacgtattattatcgcagggggcgcaacctgcgcaccatggagttgtcgctgtgttcctccgcgcaggtttagagttgacaagacctttgttgtcatgggaaagatggacacaggcggcaacgagttcgaccgagatggagtggggagtgactcgtagaggaactggcacaagacatacaagagtgtttgaataacaacatgggggccacacccgacggtggagtcgtcattgggatgctcacaaa

SEQ ID NO: 527299 - DNA, 424 bp, Homo sapiens
caccggcaggtgtactcaagctgctgggcacaagggatcctctgactcagcctcccaaacagctgggattacaggcacatgctacagcaccagttgaggggttctacttttatttgtttatttatttttatttaaactgattttatttatttatttattttgagacaagctcttgctgtgtttcccaggctggtgtgaagtaaggcaatctgggttcactgcagcttggacctcctgggctcaaggggtctgcccacctcagcttcctgagtagcagggatggcaggcacatgccaccacacctggctaatgtttggtgttttttttttggtagagacaggatttggtcatgtggctcaggctagtctttaactcctgagctcagacgatccaccggcgggggcctcccgaagtgcggggatta

SEQ ID NO: 527300 - DNA, 680 bp, Homo sapiens
ctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctatggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaaccccttcaattttattattttgaattataatcaagtccaaggagacttggcctattattaacaactttgtatgaagtatttttttcaaccgaattcatatcatcttgaataagaacaag

SEQ ID NO: 527301 - DNA, 849 bp, Homo sapiens
gatatgggatgtatgtattaaatgattggtagtagaagtatgatatgactatatgaatgtatagtacaaagtgaggtgagttcatgagtgtaggaatgattgagtgcaggaccgtatcggtgtgtgtttgaattagtgaatgttggtcatgactaagtaatgattgagatgatcaattgggattagtacttgtgagatgaatgcattgaggttgacgtctttgagagtgcgatggaatgcacgtgtaggtgaacgtaggtttgaatgagtgactgggtgagaccgttaatggtggactttgtgtttgcagtaggattgagtggaaagtggtgagcagacattaaattagtcttggcggtagatgtgcaatgatcttgagcttgatttgcatcagtttggtaattggccctgtgcattagtagtaaggtccgactggaaatcatatttccggttgattccaaatcccaaggcatatattcgagggttgagcaggattttatatcctatctagcatgggggcgggggtcgagacgtaggggtttagtacgactgatatatgtggcaccatgattcgtagatgtcctctgagttgatttgactcagtaaatagtgtgtggtatttgaacattgtgcaatggcgatacagttggtgttgtcttatactattggttatgtgtggtgtttgccatgatatctggggcaagtaggcaagaggaacttgggtgaatgcaatgatacccaactcgagagctgagaggtattgtacttaactggaaaaagctttcgtcttaagatattgcgggtaccatggtaaaaattacctcggtgttaggaattaaagtccactgg

SEQ ID NO: 527302 - DNA, 255 bp, Homo sapiens
gtgcgcatgcagtaggggacgggagcctactcaggtgtcagcactcaggcaagtctgtgcctgcgttcaggcgttctggctggttgcctccatcgggtgatgatagccacggtggggctcagtgtggtttcgaagaagctatcacctatgattagttctgtggctgtgaatgttctcattccggcagctttgtagggcagcacagtcatcgcgaggtccagtttttttccgtgatagtggttcactgcacaacgg

SEQ ID NO: 527303 - DNA, 1012 bp, Homo sapiens
ctcgatattaaaatagaattactctcaactcaccagcaattacaatttctatatctagcatattcaacactattagctcatatacaattataagcaacacaattttcaaaggcatctggttctcaatctctctggcatcatgaacatgcaatttgcccctttctgcccttttcttcaagtactattcttgtaactatattgccactaactatatccaaaacacattctgagcatcactgtgagtaacagccttccagttcgtacccttatgattcacagcatggccctactagttccattaacgcaggtggcataacttcaacgctcacaaactgcctcttaactccgactatcacatccacagcttctaaacttcgcattcaacaggacaaatgagacatctacaactacggtccctgtcgtttcacactataatcggtcaacaaacacatattccctagtaggcatcctatcatcagcacgcatcaaataccaaagtcagcaaccttgggtacgcccaactaacttacggctcatcaattattccgaaacgggctgctgtaaccatgtcaactgataactctctcctccaatgcgaccaggccatgctactcatctaataacagaaacattgctaacattagtccaaacttcaactccagtatccaccatatgcagatatcacgccacacgaatcgataaccatctggctccaatttcacccggaacttttcatcactgtgcgcccgtacgtaacatcattcgcacttcataacataccccgtgtggattacacccctccatgattccgtaaaaattaaaaaggccagtagcaggaaagcgccgtatacacgtaagcaaccttccgcgaaccatgctataaaggacaacacgtcctaagccaccagttaacgtgactcgccccacgctcacacaaccccacaatgcctagacaaaatacccattctctgaacacacatcgacaccagcacagtcacctaaagcagcgcac

SEQ ID NO: 527304 - DNA, 128 bp, Homo sapiens
ggcgatctacgatccttcccgtacgccaatgctgagcgacaaagtaaaggtgaaaagaacacttcccaatcattcagctacaaccagactagaagctccccaaggactggctattctaaccaacacag

SEQ ID NO: 527305 - DNA, 1751 bp, Homo sapiens
  misc_feature (836)..(836): n is a, c, g, or t
  misc_feature (924)..(924): n is a, c, g, or t
tttactgtcgcttcgtgggatgagtatagatagtcctcgtatctatttctttatctgttcttcttgtatagcgtacttgatctgctatcctgctctgttgttgttccttcctcccttttttggagtagttggtctcgcccgtccccctcctcctctgatttcggttcgtccggatattcctccgtgttgggtttctcacaccaacatcatctcttgcgcgccccaaagaggggtgggtgccgccgccgccccccccgaaggagatgttttctgtcgccaccttcccctccctcgtggggtttctttcttcgaaggagtggggggccgccctcccgcccgccacctactctttcgaattacgcttctgcgctcccccccctcggggatggttgtctgttctcgacccccccttctgggtggggggccgcccttttttttgttttgtttcatactcgcccccctcgttcttgctttcttagtgacgcccgcgtgtgttgtgttgagccacacccaccggtgggggcccacaaccacgacggggggttgctcgttgttttaggtcatttagactcacgtcgttgtttgtgggaaggcccccccgtccccgctgacatgtgtttgatgattgctgtgggcggcgcctcttctttttggaaggaagaaggcagcacctcgttgttgtgtgcgccggcccacgcagcaagatgtaccaccctgctggtcgttggttctcatccccccgcaccacgaggtgcttccttcctacctacttggagtcagaggcacgcagaaagaggcggcggaggacacacacacaagctagccctgtctgtatngaggagaatactacgtcgttggaagaagtggatgaatagccctcctcgtcccacagagggattcctccctactaccagaagaggaggnttgtcgcccgcgccgaggaaaattcttctttcctcctctcttcacgcggagatatttctcccagcagagatacacctcacgcagccctctgtcttgatattgaagcatctcgcgcgagagagcagccggcggcgcgcgtgtagatatgcccacacatcgggagagagtgtggccgcaccacatacacacattgtgtgagaaaaaaacaatagtgtgagaactcacacctctacacatattctctgtgagacactcttgcgacacacacacactctggtcgcacacctgacgacacacacaatagtgagacgctcccaacactgtgtgtgtgtgtgagacatctctctctgtgagagacgacacacactctttctctctctgagatagtgagacgacacacgggtgatatatacgcgcactctctcacaagataattgtgtgggtgacgacacacaccggggacgccacacaccttgtcgtccacacagaattggagagagcgcgccccgagaatcttgtgccttgtgcggagaataattttctttgagacacacagcacacaccccctcgggagagacacacagctgagatatatatagtagaatagtctatatagccactccgcggggtataatatttctcccacatatagcccgcgtcggggtggagactcttccctcggtgcacccacacgcgcacgtggcacagacactggttgggtggtttctctcttacctcttttcgtataaattgtaccccaacactccaccttaagttttttgaatttgtacccttcccttccaaataaaggaaatttgggaccccca

SEQ ID NO: 527306 - DNA, 270 bp, Homo sapiens
cccccgggggggggggggggggggggcccccagggtcccttttttttttttcccccccccttttaaggggggggttttcggggggcccccccaattttggggccccccccccccccttttttttagggggggcccccccccgggggggccgggggggggggccggggttttttttttctttttggcgggggggggggggtttttttttgttgttttttcccccccccctttcgggccccccccccattaacccttttttttgggggggga

SEQ ID NO: 527307 - DNA, 1090 bp, Homo sapiens
gcttggtttcaggtgcatcggatgctcatgttcaccacaactgtcctcacctgcattgcttttgttatgccgtttatacacaggagctagtgatatggatgacttataccatacctcggggtagtgatgacttgtgacttcgaggctctctgcgcacggacatcgtttaccagtgagacccgaacgaaggccagactgtgtacactggagatcagtctgcaggctatgccaacaaggcatgctacacactaatatgccgggcgacgcgaatgcttccagcgaggtgggtcatcaacaggactgaaatctgtccctgattcatagtgtagcaccctattgccattgacccaggactacgacagccatcgacatgattcgacgactgattgttgcactgctcgatacatgcctatgatcgcgattctctcgcgaacacgcatgaacagattggattgatgtgccggtaaatctaaagatccatctcatatccaagaacctgcagtgtacaaacacgatgaggacttcgcacataccaaatagggacacggagataggcacacaaaatagttgaggggacacatgattaatagataatcattcataatcacaatactgcaatcaggggccatcctattcacaaaagtaaaacaccatgggcgtccaacacggacaagtgaccacagcatatcaaaaacaaaagaggaccggtaagccatgtcctggactgcctaggcataagaactctggtgaaacctacccagacctcctcgcggcaatctatactgctagcaatcgtccatatcggtcccagcacacctacaccactggtgtatgaccgaaatgacaacattcaaccaatcatatacccccatatgagattactgtaacattcagaagtgattgctcttagacacagccctcacattgctgccaatcgcaaagacgtcataaacattacagcgccgaccaacatgccctgcaccaactccaaatcacctacacataccagatctcaattcaccatatccgttaacttagatcacatccacacctcaacccatatctcgtcacaacacacaacgtctcacag

SEQ ID NO: 527308 - DNA, 880 bp, Homo sapiens
ccccctcgagcgcgagcgagcgagcgacgtgacgggcgaaggagagcccacctgttgcacttttactatcttcccgcgatggttccctcgtaatcattcgcttaacactttgtccgcaaacttttggtgtctaaaaccttttgtcttaaaagggttttctaaaatctctcgctgcttacggtcctggcgtaattacacctggcttctaaaacttaacccgccttgggggataacttacgcccactgtgaatagggcgcccacccgtgggtgaatgcttccaccaacaaacatggctgtgattagaactttccccccccctggaacttcttttaacaggcccgttggtagtttttacaaagcggcccccgcccactttcttttcccgaccctttttgcaattgcgccacctccccataagctccagaaactttgcgcccacagcccacgtgtcgtgtgtccaagctacccgcaaatcccatattgtcagtccccatgggacgcttgtaaaatctcaccttcatagccttatttagttttgctaatgaaaatcttctttttcagaggccccccccccttatcatttctttcccacatacacactcttaccgcgtttttctagattacttagttctttcaaagagattctcaagataaagagagttaatgtcataaacctacctggcccttttggcctatcagatgaacacacatttggagaaagtaggacaactccagaatggattttacgaaccctgtagaagaaagtctactctggtggatatttcgtgcaatttttaccccccaatactgtttttcggggacccttattaattttttccgttttccttttggaaaaatacacaaaaacccaaaaagaca

SEQ ID NO: 527309 - DNA, 478 bp, Homo sapiens
ggggagccccatggggtaaggggatccccttccgggaaaaactgttttttttaaaacaggggtgggccccaattaaaagggggtttctgccaacccccccaaaggttgggatttagcccatcccctaaaaggcccttattattcaagaaaacccatttttttcccctgggggcgggggactttttttgagggatggggtttttcaaccaagggggggccttttcccgggaagggggaaaatttggggcccccttttcagggtttggaaaaaaatgggttttttccagggggaaaggggcaaagggttttatttttggtttaaaaaatcaaaaacggtcccaaaaaaaaaaggaaaaattttttggtttaaaaaaaaaaaaggggaaccccatgggaaattttttttttttatttattttccggaaggtgggccgaagataaaatggtaaaaaccaagattaaaaaggcctggttctga

SEQ ID NO: 527310 - DNA, 1133 bp, Homo sapiens
cggagagtgtgaccacacatgacaccgtcctcgactcctcttcttcctcctctgtgcttacccccagggatagtcaggcccggaggaactctctaggtggtagcaaggtggtagagagcggagaatagacgcctgttgcatgctaggtgccatccaagggggaaccctactacgtatggccctcgaggtcatggcagtctagagcctgggtctcagtggagtcacccagactataaaatcgctcttcgttataaacatcagtccatgtgtgggcttgtcccagggtccttaggagtacattcccgacagttggatgtgctcaccatggaccgattcctggtcctttttcgattcctgtccacactgtttctcccttctcaactggaattgtgcgtggcgctttcgtaccgtattggtcctacgcctcgggggggccctccaccagcgtcgtacgtaacgtggcctcgtgccaagctcttcgtgcattgcgtagccacgatccacatcgtcgcgcatgggcgccaggctgcggtggacgcattgtatccccgtgttgggtaactcgtctctttggcggaccataaggttgggtccctaggggtcttggtcgtgggcgtcgagagggagacctatgagtaccttcaaggcacgagggcccccctaggctactccccctatacacggttaatagggctttcaattgggacgccccccccaagaggcgttgtgtcattgctagtcgcgaagcgccaacacaagataccggccctcgttgccaagtagttcttcgagcgaagggtggggcacgtaatgcgccgtcctcggttgggtacgtgcgcccaatacggtaggggagggatcgaggttccctctgagaaaaccctagataagctcttctatcccagaacgcaggggcaaacactttcatactctatggtgcttcgcgcccttggggttccctcaacaagttaactcgggtgacattgatccgtctgggttggaagtgggattataaccgacgccacattgaagaattacctgggatcgttagcccacgagggggatcgcccgccgccttccatgacaccttggggaaaaaccccacattagggttggtcacactccacacataa

SEQ ID NO: 527311 - DNA, 151 bp, Homo sapiens
  misc_feature (58)..(59): n is a, c, g, or t
  misc_feature (104)..(105): n is a, c, g, or t
  misc_feature (146)..(147): n is a, c, g, or t
aatggaaggaccgtcctttaggaggatgactttaggaactatgaatgcgagactaagnnatcgatgatgcatactctagtcagaagtagtcatagccagaattnnggaatccagaaaggaacaaataaaatttagactctgacttnnggat

SEQ ID NO: 527312 - DNA, 481 bp, Homo sapiens
  misc_feature (157)..(157): n is a, c, g, or t
  misc_feature (367)..(367): n is a, c, g, or t
  misc_feature (418)..(418): n is a, c, g, or t
  misc_feature (480)..(480): n is a, c, g, or t
aaataaatattgtaaatttttaatagtgactttaggaagcaacataataaatttgcttcataacattgcaatatgagagcacatactcatttgggttaagaaatttaggaaaagtaaagtttcctagcataaattcttctttttaaaaaaataatanttttatttgcctttgacagagttttttatggtgctgtcctgtcttaaacctattatgctgagctcaatttgaaccttattttttttttgaatacagaaacatcattatgaatacaaattgttggactttgctactatacatgagccctcagaaattgcagaggtgtatacagtattttaccactaaatagcccaggattgggccattttngtatctttctgtgtacccgcatttgctgccgctttggaatttgttgtgggngaatcctttggccgcatttttacatttcactcgttgaagtgtgagcctcagggtgtttccant

SEQ ID NO: 527313 - DNA, 145 bp, Homo sapiens
accgcaagaggcccttggcttatggaaaagcagcccgcactatggggtggagagggtcaaacgtgtggcagtggcttactggggttaagaagcaacagtcccaggggctcagaggctggggcggcctggtatggccagtagtggg

SEQ ID NO: 527314 - DNA, 112 bp, Homo sapiens
  misc_feature (1)..(1): n is a, c, g, or t
nacaccgaactagttcgaggttgccggttgcactgtccggtggttggactcttgcctctcggcctgcggccagctctccccggcacgcgccccaaaggctgctcagaccgcc

SEQ ID NO: 527315 - DNA, 416 bp, Homo sapiens
gacagtgcctaagacagaaattcgggaaaaactagcccaaatggaccagacccccccggatgtcatctttgtatttggattcagaactccttttggtggtggccaaaccactggctttggcatgatttatgattccctgggttatgccaagaaaaatgaaccccaacatagccttgccagacatggcctgtattaaaaaaaaaagacctccagaaagccacgaaagggacgccagaaccgaattaaaaaagtccggggggctgccaaggcccatgttggggctggccaaaaaaagtgagctggagattgggtccccccccaaggagtaaaggggctgccattatgttagctgtggcccctgtgggttttttgccagaacctttataaactaccaccttcctgtggaaaaaaaaaaa

SEQ ID NO: 527316 - DNA, 276 bp, Homo sapiens
ctttcaggctcgtgctatgctagcgccgtcctcgtcatcccttcagtcgccatcatgattatcgtaccgggactcatcaggcacgatgagatgttcgtccgacatctactagatccgggagatcgcggacgggtcgtgactggaagtggccgggcggatggtcagtaggacagaaggtcacattgatgactcgctcattggtggaaatgcctccgctgaaggccccgagggcgaaggtaccgaaagcacagtaatcactggtgtcgatattgtcat

SEQ ID NO: 527317 - DNA, 166 bp, Homo sapiens
agaggattacttaagcactgcaatgtcctgctaagtaggtgagcggtgggccccatggctggcccccgtcgtcgacaaggtcatacgggcataaactcgacccggacctagataggtgacggtgtctagggtgactataccttccccgaccagtaggccgtgaggt

SEQ ID NO: 527318 - DNA, 402 bp, Homo sapiens
gcttttgaagctctctttttagacaaagcagcttcttcagtaatatcctcttcttctaagtatacactcagtcttacagggaattcagaacttactatgaaactatcccctgccaatttgatatcacattcgttatcttcaagatgtgtggcatcctcatcctctgctgttgactcctcaataggagaaatggatccatcatcatccaaaaatttgtatctacgactgtgaaaatctttatttttttagtcttcacctactttcatttggttcaatgatactttacaggggcgatcatacttaagttttttattagagtcaaaaaaatccacttggggcagtttgctcaaacgttaaaatttttctccaaggtccggtgttttaatactttgatttctaaaa

SEQ ID NO: 527319 - DNA, 170 bp, Homo sapiens
  misc_feature (122)..(122): n is a, c, g, or t
accgggcagagagcgagactccacctcaaaaaaaaaaagggggtaatcaacacgcagggctcacgtcatggttgcacacgaaggccccagcaagtggtagttcctggggggtggagctccgngcgacccccgcggttcctgggacaggctccggctttcctcctggactg

SEQ ID NO: 527320 - DNA, 315 bp, Homo sapiens
gaagctctattcattttttaaaaaataaactctttttttggaataattttagactttcagaaaagttgcagaatacagagaatttccatacaccattcccccaacctcttctaatgttaatatcctacacaacaatggtacatttgtccatactaagaaattcacattggtatgttttaattacctaaaccacaaactttatttggatatcaccagtttttccactagtgtcctttttctgttccagagttcaatccagaataccacattgcatttagtattaactcattttttctgctgtatggattacactac

SEQ ID NO: 527321 - DNA, 267 bp, Homo sapiens
accgtcttagaagaggcaattttagcgcagaagaagggctctgtataactgccccagatgggaacgaaatgccttgggggtctgatttcagcgaggccaattttagtgcagaagaagggctctgtaataactgccccagatgggaatgaaatgccttgggggtcctgatttcagcgaggccaattttagcgcagaagaagggctctgtaataactgccccagatttgagtgaaatgccttgggggtcctgtcttgggaccaagactg

SEQ ID NO: 527322 - DNA, 256 bp, Homo sapiens
ggatcccccaccagttgcacctgtcggtcatgccaattcacagtccttcagcagcaaagccaggcggagtaccatcagccccagtcaggcgctcaaacagcacggtatatataccacggcgggtagtgttgtaagtggcctgacgcagcaggccagccgacagcccagtgtaaatgcccctcaggccttctgccttcaggcactactgcctgacggcgatggttcatctgcctgtttgtactctcgagctcttggc

SEQ ID NO: 527323 - DNA, 314 bp, Homo sapiens
taaaaaaaaaaagggaattttgacaaaagggggattcccttaggtggttgggggattggattgaatgaagtctgcggcttaaggaatacttgaggattcctgccaacccatcgaagcttgggagagggaggatggaacaactccctcgggagcctccaagaggaaccaaccccactgatgctttgatttgggatttccggcctgaactgtaggaaaataaatttctgttcttttaagccatttttaccagtttgtggtaacttgttacagcagctgcaggaaattaataaattccaaatgttgaaaatttaaaa

SEQ ID NO: 527324 - DNA, 448 bp, Homo sapiens
agaacccaaacatagggacattacttgaacagttacctcgtggaagatcgagctcgctgggttgtatatggaatacttgactgaaggctcctagacagatatggtgacagaaacttgcatggatgaagagccaaattgcagctgtgtgccgtgcgtgtctgcaggctctggagtacttgcattcgaaccaggtcattcacagagacatcaagagtgacaatattctgtaggaaatggatggctctgtcaagctaactgactttggattctgtgcacagataaccccagagcagagcaaacggagcaccatagataggaaccccatactggatggcaccagaggttgtgacacgaaaggcctatgggcccaaggttgacatctgatccctgagcatcatggccatcgaaatgattgaaggggagcctccatacctcaatgaaaaccctc

SEQ ID NO: 527325 - DNA, 841 bp, Homo sapiens
  misc_feature (343)..(343): n is a, c, g, or t
tcaaccaaacaagttttttacttggagcgcctactatgtgccaggcccggttctaaccccccccagaaaaaaaaaacaaaaaccaaaatagaggcagcaaacaacaattctcatgagggaagaggaaagggggacagattagaagttacaaacgggactaaggagaactgaaaacgccagtgaggatgagtgggggcctcgtgccttttaggccctcctctctttcagggccctcctctcacccagaaactcctctcctctccctcttatcatgcgaggtaggctctcctgtgtgactcacgtggcgtgacatcctctccagacagacacgaagagtctcgtntccaagtgtgtgtgccctcctcgagcaccctctgcggtgtgaacactctcccaatccctgcgtctcacatgtgcctctactcgacctgtgtgtgttcacacaagtgtggtgagagggaagagagaccctatctcgctggggagagcaacaaatgtggcgcgaaagagatgaaaactgtggctcatccaagaagaatgtggcgcgcctatgtgcaaaaggagtcacccactgtgggaatgtgcgctgaggtggaagcctaatatttgtggccacaaaaatttaagcataagtggtgttgagactcatgcggcacaaattacatctatagaaaggcggccccaactacaatggggatgtggagacgtatttggtcacacacacagaacaggagggatttgtgaacataatggagaacattatgtagtgtgtgagggagaactcccccattacacccaaacaaaaaattgtcaactccataaattgaagtacacataaggg

SEQ ID NO: 527326 - DNA, 460 bp, Homo sapiens
  misc_feature (1)..(1): n is a, c, g, or t
ntgcaggatattttaaacttttttagggaaacacagagtcatctgtcagaatactaatacgtggtttgaccctaactaaataaaaggaattcttggccgggcacggtggctcacgcctgtaatcccagcactttgggaggccggggcgagtggatcacctgaggtcaggagttcgagaccagcctggccaacatgatgaaaccccgtatctaccaaaaatacaaaaatgggctggacatggtggcgggcacctgtaatcccaactactagggaggctgaggtaggagaatcacttgaacccgggaggcggaggttgcagtgagccaagatcgtgccactgcactccagccggggcaacaagagcaaaactccgtctcaaaaaaaaaaggaaaaaaatttgaaaagaaatcctggagtattgctttggcccggggtcacagtcccaggagagggtaccgag

SEQ ID NO: 527327 - DNA, 996 bp, Homo sapiens
gaagcgcccactcgggccgggactttcggaactcaacttgagggaatatctctatcatcggccagtgggctgtgcaccggcccttgaaaacccggccccacggcaattcgcgatagggccaggacttcaggatgtgagacctcaacacgccaccggggatgggcatgcccgagccgggcctatcagtcacggtggccaccaccatgaccaggcgccaacaaaggagctcacattcctgctacttctcacggcgccgcacccgcctgcggcagcaccgtggagagggggccgcggatactggagtggaagagcccccctccatgcgcctgaaggcccgacccgagcagccctaggcttttccgtgcttactgcagcgccttctccttcgtaccctccggagctgcaacttcggttcctgcggaatgggctggccgatggcaccggccagggtgacttcggccccaacagtgacggatccttccacgcctctgtcgtcactaacagtacaaaagtggcgatagagcaccactactgctcgcattgtgcagacacgtggggctggcgcagccctctcaagggtggagctggaatctccagccaagtcctccgtgcttcgtgatgggaatcgtcatcggtgtcttgctactcactgcagcggctgtaggaggagctctgttgtggagaaggatgaggagtgggctgccagccccttggatctcccttcgtggagacgacaccggggtcctcctgcccacgccaggggaggcccaggatgctgatttgaaggaatgtaaatgtgattccagccaccgaccactgagccatcacgccattcacgacggtgcctaaaagacgaatgtagttcaggcccctttcagtgactgggagacgtacttggaacacctggcatttgctgagcctagagaaggggattatgggctgtagttgtccttccctctggagccccgtcgtagtgatacgccgcagtttccccac

SEQ ID NO: 527328 - DNA, 136 bp, Homo sapiens
gctcgatcagtctggcccccacatctgcgacgggcactttgacacagtggccatgcttcgcggggcgatgttcgtgttcaagggccgctggttctggcgagtccggcacatccgcgtcctggacaactatcccctg

SEQ ID NO: 527329 - DNA, 595 bp, Homo sapiens
cactatcgccaggtggaagtggaggtatggcacttgaagagtgcttgtagtcttgcctgtagaagtttgtctgttcggcctcccccgcatcagtctgcgcgatgtcagaactgacacagggaatgagcttgccaaaagccttcagtaacaaagatgtttgccgcaataccaaccaccaacccaagcaccatgcgaatgagcattgtcatatcatacggaccgttcagcttgtcgccggcggatagaacatgcgaaatccccagcaacccgttgagctctgatgggtacccaaacacgcagattataaaaatgccccagaatgcgaggaggccgagccattttcttgcttttgacatgaacggaggaaaagtcactttgtttctccaatgaggacgaattgctttcgacgacccggatgattgctgatcgaaccgtcgatcggattgaagctctacctgccaccggtaattgtgagcgctccctgggtaacgccagcccgaacctacgatcaacgtgacgccttcgcttgtgtcctcgtacacacgacacgacagttccgctacgtcaccacctggttgagagatcgcagttcctt

SEQ ID NO: 527330 - DNA, 994 bp, Homo sapiens
tgcccctcatttacataaatattatagctatgccagtttaccatctcactttctaggaatactagttatatcgctcatcatcctcatactcctccctactattggcctagaagtgaactaatagctactcgcctggttcatctatacgtccatctctcattaatcccttcaatcatgccgactcgcctcttagccgaatattggtgccttaattgcctatactgactcattttaccgatctagctacccaaactgcgtgcgccatatgcctcttactcagtctctaatctccaaacactataatggcctaagactaactgtagctatcaacgctaaaacctacttccaacttgctaacataccttaagttcgctcccaatcaacttactcagttactactcatcgtgatcattgaccttttcctaaagacaacatcattaatctggaactcaggcacagaccagccacacagccactaattattgagcagtcactcctcgccatacttaatctttatcttaacgctagaatcgacacgaactaacacttatcttagcactgttcccccaaaagacatttcgtcccctccagtacaccctcgcgtagtcacgacccccctctcactaactaagctaacacatcagctagcagctcgctttaggccactacaacaagtccattgcgccaaaggcccccctatgccgcacattctattcacctagtcgcataggcatctcatcaaccgaacaaacacagaacttcctcaaatctttctctctgacattaaccttacaacattctgccccactaacatcacaacattctacccttatgaaattgtaacttgcaaaccattgttccaggcattggcactaccaaggaacacctaacatcgtgcccacatgcatttcatcctacttaagtaacctcgtacatctcccgggaaaacacacacgctatcgtctgattgccccccccaagcccttgtgcttag

SEQ ID NO: 527331 - DNA, 83 bp, Homo sapiens
  misc_feature (81)..(81): n is a, c, g, or t
aagctgtggtttggggaaagctgtcttttttttcttcctttatactacagctttggtgggggagaagggggtgggtgctgntt

SEQ ID NO: 527332 - DNA, 407 bp, Homo sapiens
  misc_feature (15)..(15): n is a, c, g, or t
  misc_feature (77)..(77): n is a, c, g, or t
  misc_feature (87)..(87): n is a, c, g, or t
  misc_feature (150)..(150): n is a, c, g, or t
  misc_feature (158)..(158): n is a, c, g, or t
  misc_feature (182)..(182): n is a, c, g, or t
  misc_feature (202)..(202): n is a, c, g, or t
  misc_feature (288)..(288): n is a, c, g, or t
  misc_feature (290)..(290): n is a, c, g, or t
  misc_feature (304)..(304): n is a, c, g, or t
  misc_feature (316)..(316): n is a, c, g, or t
  misc_feature (320)..(320): n is a, c, g, or t
  misc_feature (327)..(327): n is a, c, g, or t
  misc_feature (329)..(329): n is a, c, g, or t
  misc_feature (338)..(338): n is a, c, g, or t
  misc_feature (397)..(397): n is a, c, g, or t
ttaagagtctttccntgatttttattaaactatgcgagcctcacctgtgctgctctagaggttcctcatatgcaaancacgaaatanggggcattcccctggctggtccccatgttgttaagtgttctccccccccccaccctacccccngcttcttnatgaagcaggcctccatcctcctntcttgggaggttgtgaatcnttcgcagcgagatgtctgtcttctagcaccacccctcgtatttcctctacataacaggtcttcacgctggcattctaggaaccccntntcctactgagctgngaatctatgctnagcntataagncnatgactganagggaaaaaaatttttttaattacagctcatttcgtttggtgcatttcaaggtgcaatncttttctctc

SEQ ID NO: 527333 - DNA, 272 bp, Homo sapiens
gcgaacagtcgcggatagctgattataaatgcgccagtagaaattactggggatgccccgatataaccgagagtacagagcagtcatggcccagtaggcaatgcagatgacgcggcggacaacggtgaccagtggctagaacatggtagacatcatctgtcccacagccctgacagggagacaaagctgttaaccggcaccggcccatctgtccatcttctcaaggggctgaccccggccgagcgcagtggctcacgcctgtaatcccagca

SEQ ID NO: 527334 - DNA, 256 bp, Homo sapiens
ttaaagtgagtagcccctgtagtataggtggcgcaaaccagtagagcgagtctcgggcggcatgttgactctgtcgtagtagatgtagcgcagagtggactcgaaggcctgcttgtgggaccatctccccgatgagatgttcacctgcccatcttcgggcatgaaggacccggaactatggcttcaaatgtacgctggagcggactggcatggaatagcctatgttgggcttggcctgtggaatgccctttttaat

SEQ ID NO: 527335 - DNA, 820 bp, Homo sapiens
ggtggtgtgtgtttctccaccatgaagggtagatttccatctactttggggtatccctgagctgaggacataccgcagaaggggggagaaaatctagcgagaacacatgtgctatgggaagtgtgcaagatgcttcggacattctctggtggggttggccatcctgtgcatccgcggctaatatttggcttgactttcccaatggtgaagaaaagtatgcctccgaaaacatctcgaggcgttcgagtggttctcatactggctatccgtaggaggtggcctgttgatgctgctgccagcattttgtcttcatggggctgggagacagtgatgactgctgtgatgatgtgtggcatgacaaactgtggcaaactgatgtgccagatgctttctttcatgtatcggctgcgtctcattggaattgcaggatctcggctagtgtgtcatggtgggagcccttggttagcaagaagggaccactatgtcttgatcccctcgggcagtggaactagacctttgcatgaagagagggtccaggtacgcttctggataaccttgcacgattggtactgaagttggttgggaccgaaagcacatttgggggtagtggaatggtatctctggtaatctattggtacttggtcctgtggtgggaatttgaatccatcttgcgtggtattcaagtaataaatggcagtgttggaaggcatatgtgggtgaggagggccacacaccaggaatatgatggtaaagaaaacgcggggggggaggcaaattttcttttcctggacttaattttactgtttcttggacattttag

SEQ ID NO: 527336 - DNA, 124 bp, Homo sapiens
cacttatacattcatttgactattctgacacctgtaataatttcacagagaactgccagatcctgtgaactgctgggggccatcaagcttcattgatccaaactcgcagcaaggaagggaggag

SEQ ID NO: 527337 - DNA, 100 bp, Homo sapiens
aggtgattatctgaaccatccaggccaaataagcgccggtatgcccctgtattggataatcacctaagcagtgaagccagctgaagaaaagagtgcttgg

SEQ ID NO: 527338 - DNA, 432 bp, Homo sapiens
aggcaataagaattagaataatagcgggtaggattgttcaaattgtttctacttcttgggcatccattgtgctagtgtgtgtcagttttgttgttagtataagtgaaatgatatataacactaaagagctgattaagaatacaattattaaggtgtgatcgtgaaagtgtaggagttcttctatgatgggtgaagtggcgtcttggaagcctagttggaaagggtaagccatagaggcatatagggctttcacctataatataacttcgacaaagttatgtaatattttactaatacctcgattatcgagaaagacatagtggttatgacgttggcttgaaaccagtgggagagggttcgattccttcctttcttatgcttattttaggttgatatatgtgggtcataaagggtgcgtgcgtaatccgggtt

SEQ ID NO: 527339 - DNA, 143 bp, Homo sapiens
cgggcttctgggctcacaagcatcctagcgtgattatgctttcctagtagaacagagactgatttgtgagatgaagatggggacaccagattgatttcatcaccttcaaaacaagactacaagatggaagtttagaagtaatg

SEQ ID NO: 527340 - DNA, 627 bp, Homo sapiens
cagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttgg

SEQ ID NO: 527341 - DNA, 1040 bp, Homo sapiens
agcgactggaggtggagggtgggaagagaagggagtcagctctgacagcttacaaactgggaagttctgtgcatctccagggattccagagttgaagatctggttgttggaagctgggcgcccagtgctttttttttttttttttttaagcccaaatgccgtcaggaacccacgtgaacaagggtgaactcgggtgggtggtctcggtgtggccaaggctgagtttgaacgcctcaggccaaaccccaagtttgaaggggagcattgggtggctttatataatctccaagtgatgcaatgatgatcccagcttacaggagttctcagcagggtgcttttatatatacctgatgaagagctaaggcctcactttgtggaaatagaataatattattattaatttaaagtgcattataagtggtggtgtttaaataagtgatacgtttatattcttctccccgcgggtgtgacgtggtggcattactttattaaaaacagaagtttaaagaaattttcaagaacaatctcaatagtgttccccattaagagcgcagctatttttacactttatttcccaacattttaacagaggggctgttaagagccagtgggccagaattgagcgtctttatatttctctcaaagagtgcgcgtgttcctttaacactcaaaaattaagcggcgctttacctatttaaaagaaacaaaaaaaaaaagaacacaaaaacaacaaaaaaaaaaaaaacaaaacacaaaacacagaacatcaccagagacgagaaagacacaaaaaagacaacaacaacttctcacggaacaggggagagctgagaaccgcgacgcaaaagaggacgggccagagacaccacacgaaagggggggggggggcaggggaagaaacaaagtatgtggggccccccaaataagagggggggggaaaacaccacacaggaagaggggggggaagaaaaagcgggacgaaaagagagtgtacccccgcgtgaagaaaaagtgtttgcgcgcggacagaatctccccaa

SEQ ID NO: 527342 - DNA, 908 bp, Homo sapiens
gatctttctcgcgcccacattggcggtctcctccatcttccccgtagttgcctccttctctggctgcctgggtggacgcacatgggccggaagcggctcatcactgattcctacccggttgtgaagaggagggaggggccgttgggcacagaagggggagctggcacccgagctaggggaggagccccagccccgcgacaaggaggaagcggatctggagctgctgaggcagtttgacctgggctggcagtacgggccctgcaccgggatcacgcggttgctagccgctggtgtcggtgccaagcagatgtggcttgaggtagacctccccctagaggtgtggcacggtgctgaagactctacccggagacctcacgcattccgaggtggtcagtcttctggcatctctatcccctatgaggcacgcacgtaaagacctcctggccttagctctctgtgtctcacgcaaccaagaaccatcagtgacgagaagctgagagcccattgctcctgcttcagctcagcccgggctgcggaggaacccttggcaggcagaggctgcacggtgtctacgaggccgttcaactctgtccgatctaaccagtggctccagtagtccccggaggagctgcgcgtgctgagagcgtgagtgtctggctggattggaccagtggtcactgcgggactacggccctggtgcatcgcttttcctattgcctgctgcctgtcttccctggaccctatgattctgggcacggttcgggcccgctccgctgtgggcggcgttgtccctcgcgggggcaggatgcgcgttccccctgcgggccgggcatcttggcaccccggctgggcgtgcgcccacacgcccagggggtcccctctctggttctttcctgccgactttggcg

SEQ ID NO: 527343 - DNA, 2135 bp, Homo sapiens
  misc_feature (973)..(973): n is a, c, g, or t
  misc_feature (1876)..(1876): n is a, c, g, or t
  misc_feature (1908)..(1908): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527344 - DNA, 348 bp, Homo sapiens
gatctttctcgcgcccacattggcggtctcctccatcttccccgtagttgcctccttctctggctgcctgggtggacgcacatgggccggaagcggctcatcactgattcctacccggttgtgaagaggagggaggggccctctggggcctaggggtgacctctggcatgggcggtgctgtaagagctggggaagacctggatgacctactggataatttgaatgatgcccaatatatgcggactgagctggtccagcaggctcacacagctgtcgatcgtgctgactgttatcttgacaaattatacgatatggcttataaagactcgacatggaaccatgcaaaca

SEQ ID NO: 527345 - DNA, 936 bp, Homo sapiens
tccatattggggggaaacgggggtagaaacgaggctgggacacagaataggtacccaataaatctttaggggaatgaacagccgaagcgagagttctaaatgggcagatggcccatttcattctgtccccccacctcaaaaacctttacatcctcacggggttggggaggccagagaacagggtggttggccttgggggtgataaggaaaggctaatttcatacaaacggaagcaaatcgggctctcaacttggacccccaaagtgccctcaaaagggatcacgtgagccagggaaggctgagaaaggagggagcatcgtgcccattcctccgtggccagaagagaattgaatgtgctcagagcagcttcagtgggcagggcgggaaggctgcagttcagggacgggtaagacagactaggaggacttgatggaggcacgtggggaaggactaggggccgtgggaagaaagcagtaaagatacccccggaaacccacacaccccgaaaagggggggagggacaacaaccacaaagagaccacgcgaccagaaacaaaggccgacggcaatcaagaacaccaaaagacggaagcctagttcctaacacacaaggcaccaaggaaggcaaacagtgggggacactcaagcacccgccgagcggaagttcacagaatcgtgaagaacaacgccaaggtcctcactcctgccacgcgcgggataagaaagaggtgacaaggaggagacggcgccgccccagggcgggaaacacgcgccaccccagagcggaaaagcaatgcggggcgggaacaagggacgagccgaggaaaacattcaccccacaggtgccccaaagacgggaagacacagctagaaggccccgactaacaaccgaaacaccgaacacggacacagacaaccgaacgcgcgaagaaagac

SEQ ID NO: 527346 - DNA, 2192 bp, Homo sapiens
  misc_feature (973)..(973): n is a, c, g, or t
  misc_feature (1933)..(1933): n is a, c, g, or t
  misc_feature (1965)..(1965): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527347 - DNA, 980 bp, Homo sapiens
  misc_feature (7)..(7): n is a, c, g, or t
  misc_feature (254)..(255): n is a, c, g, or t
  misc_feature (288)..(289): n is a, c, g, or t
  misc_feature (299)..(299): n is a, c, g, or t
  misc_feature (311)..(311): n is a, c, g, or t
  misc_feature (322)..(322): n is a, c, g, or t
  misc_feature (326)..(327): n is a, c, g, or t
  misc_feature (338)..(338): n is a, c, g, or t
  misc_feature (390)..(390): n is a, c, g, or t
  misc_feature (412)..(412): n is a, c, g, or t
  misc_feature (471)..(471): n is a, c, g, or t
  misc_feature (473)..(473): n is a, c, g, or t
  misc_feature (537)..(537): n is a, c, g, or t
  misc_feature (546)..(546): n is a, c, g, or t
  misc_feature (576)..(576): n is a, c, g, or t
  misc_feature (595)..(596): n is a, c, g, or t
agcggcntgacaaggttcagactgagtccctgtaaccaaggactgtgttttcatctgtctacctacctcatctgtaaaatgtcagtaacaacataagattgttgaaggattttttttttttttttttgggagacagagtcttgctgtgtcgcccaggctggagtgcaggggcacaatctcccggctcactgcaagctccgcctccgggttcacaccattctcctgcctcagcctcctgagtagctgggactacnnggcacccgccattacgcccggctaatttttggnnattttaaggntttcaccggcgnttagccaggantggnngtcgatctccntgacctcgtgatccgcccaattcggcctcccaaagtgctgggattacaggcntgagccaccacgccgggccaanggatttaatgaattaagggatgtacaggtgcgtggggcgtgtaatcctagggccgtgcntngagactcacatttggccatcaaaagccttttaaaagggggaggttgcggtgagctgacttgggngccactggnactccggcctgagtgacagagtgagactcngtctcacaaaaaaaataanngccctttaaataaggaataatagtgatggaaaagtgtcatttctgggaccattgaaaattggagaattaggttataattgagaattattattagctacccttaggtaagctccattggtgcggaaagttgtgaccagtgatgaagttcccatttctggaaatcgtggaacattttcggtcagggactccagggtacagttagccgtaaaggcttcccgtggtggtggaaagggccttggaagttaagtcgctcaccaggggttcagaagaccgggattggagataggggaaatatttgaggggagaaatgcccgccagaacttggttagaagaaatgggccctgaaagagtgcgcccggaaaatgcggcaagaggcctataccg

SEQ ID NO: 527348 - DNA, 1021 bp, Homo sapiens
gtgatttcagaatgtctgggcgacccaggattccccctccccttcccaaataaagatgagggtactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaacaaaaaaagaaaagaaaaacaaacgaaggaggtggcgcgcgcccgccccgcccacagaagagagacaccaaaacacacctgggtgtgggcggccgccccaccaagcccatttagaagcggaagcgaagagagacgagagatccatcacagaagcagctgtgcgctgcgaaaatagggagaggtagtcacacactccaaacaaaataagactgacgcgcgcgcgcgagcacaacagtgagttagataacacaaccagcagggatggtcgccagcacgcacgatagagggcgagcttatacataaaacaagacagacagacccgaacagacgagcgcccaaatataaaaaaacacccccccccccgcgccggggggcgtaaacaaccagaaacacaaaagaaacaacagacgaagaaaagcaacacgagcagacaaacccagacagatgaacagaaatagatagagatcaaaagaaaaaagaacaaagaaacagaacagagacagacaacaccaacagacagaaatgaaccgagagcaaagaagtcaggagcacacggagagagagaacacacacacgagaagaagacaacgaccgcaatcagagcagtcaacagcagagatacgaagaacagtacagaatgagcgccgacgataaaagactacggcaggtgaacgacataatgacacgacaaaagaacatagtaacaaacgcaacaaaagacaagcgaaaaatacaaaacaagaagaaaaaaatcaacatatagacaacaaactagagaaccgcatcattaagaagataagcgggaagcacgtggtgaccaagaaccgagggaccgaaaatgtataaa

SEQ ID NO: 527349 - DNA, 2167 bp, Homo sapiens
  misc_feature (973)..(973): n is a, c, g, or t
  misc_feature (1908)..(1908): n is a, c, g, or t
  misc_feature (1940)..(1940): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527350 - DNA, 96 bp, Homo sapiens
  misc_feature (23)..(23): n is a, c, g, or t
  misc_feature (40)..(40): n is a, c, g, or t
gatcaattcgacagacagatggngtgtatgcccctcccangtttgacttcacacacactcataactttccaaatgaagccccacagtatagcgcat

SEQ ID NO: 527351 - DNA, 2274 bp, Homo sapiens
  misc_feature (973)..(973): n is a, c, g, or t
  misc_feature (2015)..(2015): n is a, c, g, or t
  misc_feature (2047)..(2047): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttgcggtcatttttgtttttctttgtaggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527352 - DNA, 1153 bp, Homo sapiens
  misc_feature (894)..(894): n is a, c, g, or t
  misc_feature (926)..(926): n is a, c, g, or t
cgaaagtaattacagtgcggtcaccggtttggtatttcagtgagagggacgggggtttcattctagattattggtcctgtggcagtcatttcacacacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527353 - DNA, 1831 bp, Homo sapiens
  misc_feature (1572)..(1572): n is a, c, g, or t
  misc_feature (1604)..(1604): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgagagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527354 - DNA, 180 bp, Homo sapiens
ggcgattatataaatcatgtgagaatgcctcaaagttaccatttgtttgccatattttacaagctattccctaaacaagatatgtctctgtgtactgtatttcctattagactatgaataaaaactatttgggcttacgataaaaatcactgagttaggcgtggtggctcatgtcataca

SEQ ID NO: 527355 - DNA, 2296 bp, Homo sapiens
  misc_feature (973)..(973): n is a, c, g, or t
  misc_feature (2037)..(2037): n is a, c, g, or t
  misc_feature (2069)..(2069): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttattttcttaatgacgctgcacagcggtcatttttgtttttctttgtaggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527356 - DNA, 1211 bp, Homo sapiens
tggatctttcttacaactgggatttatgtctccagtgatcttcggtgcaaattagctatatctccagggaatgtggacagccaccctataattcgtgggctctcctgtggcaccaaaggcctccagtatattggggctccagggtctttgaaccttcagggccgtggaagctttcaggggtggcggccccttcggaggagacgttggctgtggaatgtgcgcctttctctccacattctgtgttagagtgggcttctcaggaaaggggctataacgtggtagagtgtgggtggggtgagaagaggggcccccaatagcgccaagaatttattccatcaatattctctcttctctgtggttctgtgggagagacacaaaaacacgccaacaatagtttttccccaacagagactctcctctcacacagagagagcggggtataagaggcgtgtgtgtcgcgtgtggagacgcagaggggctcctgtgtcttcacaaagagaggcttttgagagagacagaaaacaatttttacacacacacacacacacacacgaaagatgttgggcggctcctagtgggccacaacttttgagagagggcgccctgtgagaaacacccacacttttctccacagaggagaaaggggatcattgggaaacgagcgacagaagggggggggctccaatgatgcgcttttagtccctccacccaaggttttccttttgagcgaataattgtggcgcgtaggacactacccgtagagagaggaggcattattccttagacacaaagccgggacaaatggggcgtgcggagtctacaaaagaagggcgcgcgcaattgaaaggaggcctcctatcttttcttcacacaatatcttacaaggaagaagcactacaggggggcaacaaggcggaggtttttttatcgccccccagaagtttaccactattatccccacgagagccgatgaaatgttacacccaacagcttttgaacaagaacgccccttttacccgtgggggagttggagaagagacgcctttacccccccagaaggttgccgctgtggttgacaaaccagagggtcttcacaaggttctccagggggcggacagacttgtgcgtctccaccacaacaaacgggggggcaggggggtcaccacacgacattggggggagaaggcccttttttagttaaaccctctata

SEQ ID NO: 527357 - DNA, 1038 bp, Homo sapiens
  misc_feature (779)..(779): n is a, c, g, or t
  misc_feature (811)..(811): n is a, c, g, or t
tggaacgatacagagaagattagcatggccccgcgcaggatgacacgcaaattcgtgaagcgtccatatttttaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527358 - DNA, 163 bp, Homo sapiens
tcggtactcctgactcagtacccacccgctcggcctcccaaagtgctgggattacaggagtgagccaccgtgcccagcctgagactactttttagatggagcccactcaaggggatgaggaggtttaagccaccgtgcccaggtgcccccccagagagagcgt

SEQ ID NO: 527359 - DNA, 943 bp, Homo sapiens
  misc_feature (684)..(684): n is a, c, g, or t
  misc_feature (716)..(716): n is a, c, g, or t
ggagagccggagttgccgagcaagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 527360 - DNA, 293 bp, Homo sapiens
cggacacacgctgactcttccggcttcaatgtcctccctatcaccactaaacattaatgcttatttttgccagataaaatataaaagggggccgggcatggtggctcaggcctgtaatcccagcactgtgggaggccgaggcaagtggatcattttgagatcaggagtttgagaccagcctgggcaacatggcaaaaccccatctctaccaaaaattacaaaaattagcaggacatggtggcgcacacctgtagtcccagctactcaggaggccgaggctggagaattgctta

SEQ ID NO: 527361 - DNA, 220 bp, Homo sapiens
ctacgaaaccatcgaagacaacggccgcgcaagaggataagcgaagggccgacagcaccaacacaaggcgcagagagagcaaatacgaggaaagaggcgcaagagacgagtaaccaagagatgcagaaaacgattcaacaacagcagggaggaactccgacaagacagaagaggcaagcggccagggctagcggcaacgagagaaactctgtctctctct

SEQ ID NO: 527362 - DNA, 387 bp, Homo sapiens
cgcggtggctcacgtctgtaatcccagcactttgggaggctgagggaggcagatcatgaggtcaggagatggagaccatcctggctaacatggtgaaaccctgtctctactaaaaatacaaaaaaaaaaaaaaaattagccaggcacagtggcgggcgcctgtagtcccagctactcgggaggctgaggcaggagaatggcgtgacctgggaggcagaactgcactccagcctgggcgacaagcaagacttcgtctcaaaaaaaaaagtaaattataaaatttttctgtaaatatgcctttcaagttacataatttacattccttttaataatactgtatgaataaaatttgatagaggcactgagttttaacattatctattaaaa

SEQ ID NO: 527363 - DNA, 309 bp, Homo sapiens
ttccagctactctggaggctgatgtgggaggatcacttgagcctgggaagtggaggttacagtgaggcgagattgcgccactgcactccagcctgggtgatagagtgagaccttgtctcagaaaaaaaaaaaaaaactatattgagtggtgctgtggagaaacaggtacattgttgatgtttctgtgagttcatttagtctttctgtacagtcttgcaggaagcaatagcagccctaatgtatgtaaaaccttggactccatggtcctattaaatatgccctaataaaatgaatattttgcttctttaa

SEQ ID NO: 527364 - DNA, 104 bp, Homo sapiens
  misc_feature (69)..(69): n is a, c, g, or t
taaaaattctttttttttcccaattttaagacaacccaaatctaagattctgactttttctaacttctnaaagacatgccaatgctggcaaaaagaagtgcttt

SEQ ID NO: 527365 - DNA, 157 bp, Homo sapiens
  misc_feature (90)..(90): n is a, c, g, or t
  misc_feature (107)..(107): n is a, c, g, or t
  misc_feature (123)..(123): n is a, c, g, or t
gtatcactaaagctcgctttctttgctgtccaatttctattaaaggttcctttgttccctaagtcccaactaattaaactggggggatanttatggaaggggccttngagcatctgggattcntgccctaattaaaaaaacatttatttttcaattg

SEQ ID NO: 527366 - DNA, 86 bp, Homo sapiens
  misc_feature (62)..(62): n is a, c, g, or t
  misc_feature (72)..(72): n is a, c, g, or t
gtgtgctggggccgggcccctgcgtgtggggtggtggtggcggtggctgtgcccggctctgnctgttgctgngtctggggctggct

SEQ ID NO: 527367 - DNA, 909 bp, Homo sapiens
  misc_feature (20)..(20): n is a, c, g, or t
  misc_feature (495)..(495): n is a, c, g, or t
gagagagagcactagtctcngagtctatttattttttttttggtaaaaatggggcttggtcatgtgacccagccgggtcgggaactccggggctcacgcaattctcccaccttggcctcccaaatgggtggggggattacagggcggtgacgtcaccatgcccagcctaggatgagttatagtaaaggattgggtaatgctgggggaagatggagaaaagccaggttaggggcacagcaggttggaggaacggggtctagtggggtgtggcgatgggatacgccatggcgcaggcaagaaaggagacgcctctgagacaggagaaagacagtctgggaaacaacccagaggagacggaaccgcggatccacgagccacggggacgaccactgtgtgcgaacactggcgcctctcagaagcgcccacgagacggagcctccaagagaagagaacacaaggggcagagaaaaccagaagacgccgggcgctcccaancggcgatagagacggtgagaaagcgcaccggatagacaacgacaaattgacgccaacagacgacgagtctcaagacgcgagagacgagagagcaccattcgcaaggcccccagaaggaaaggaccacccgcatccaacactgcggaggacacactacttccctacccccgagaatcagaggccctatgacctttttttttcacagagaataactgctacgagaacaacattgcttgtgtggatcttgccgaaaacggtcaccgcgtgtctataccacgaaaggcgttcttactgacaaagggcgggtctacaaggtataataactccatatggggatgaacccaccaaacaaacgagttttttcttacccccaaagagacatactttctatcaaacaaaactctatttcagcaa

SEQ ID NO: 527368 - DNA, 407 bp, Homo sapiens
catagtatcatccgcaacccatggatgacttttaagtcttcttatttaagaaacacatttcatcacatttcataagactgtagctgccatacatagtgattcctctgatggatctgggcaaaatcaatggaaaactttctggacagtattcaccattctaaatgcgattcagaatattcatgattcatgggaggagataaaaatatcagcattaacagaagtttggaagaagttgattccaaccctcatggatgattttgaagggttcaagacttcagtggaagaaataactatttcatgataaaagtttaacaatgaggagtcgcatcttatggatgagcaaagaaagtggttccttgagatggaacctaattctagtgaagatgatgtaaaaaaggatttagaat

SEQ ID NO: 527369 - DNA, 1489 bp, Homo sapiens
  misc_feature (771)..(771): n is a, c, g, or t
tgttgttgtcgtttttctgtttgtcgtttgtgtcttttcggtttgctttgctgtgtgcttgtttgtttcgtgttggatcgcggctgtgtgggtggggagaggcgcgcagcggcagagagggacgggaacgaggaggcgacagggcaagcaggcagacgacaaacacagagtcgtgtagtaagcacaaatcataataacttccgtcctgtcactgttgcccttacttgctcttgattgtgcagcgaggtcaccagctgcaagctacctttgtctgtgtgatgatcactcttccactaggctagagcacctcttgtcctcactacaaagagataatgatgtctctcccctccctggaataacattaacactgtggtgcgcaggcccttacttatttatttcgcgaagagcgcaaagtttggtctccccagcagcgcgctctgtttattaacactcggcctctgcttgtcccctcccgctgaatttattgaagaaccccgctggccacacgttgtgggaaggttggtttgtaaaacaaccgctgcgcaatggtcgccccttctttcccctaggccccccgtccgctggtgtgaagaatggcctcattattaactccccggtggggggaacgacaacgcaataatttggtccgcaccgctcttcgtcggcgggtaaccccctccggtgtgttcccacccgcggtcttcccgcccggtcgtgtttgtcgctcgcgctcccccgtggggcgtctcctcttccccacgggtgtgatgngtccattaaatgtttggtcgggagacgcgcttggttataccgccccgcgcgcttttatgccgcgcggaagaagtgtgttgcgaaccgttgaagagagactttgtctgcgagaaggacattcttctttgtgtgccctcgtccccgcgcagccctttggggtctccccccgcgccccccacttggccggtctgtgggtgaccccacgcctctgttcctgttggcaagaagcgaccctcccacgttcacatctcggtcacgacacgagggtgtaactcatttcacgcagggaccacgcgtgcccacacattacatgggggtgccacctccgcgggcacacgtctccactcgcgctctctccgcaagagggcccctcccggtccgcccccctttgttccgctcaccacgaattggacacccacatctctcttcttgtcctctctgtattcttttctagatacttttatagacacacgcacaagataacacaaagagaaccacagtctttctgcatttggagacaagcatcttcccattcaccaagaactaattggggtgggagagaatacaagaaataatcggtgagtacacagaggtggtatttctcaagcatttcttccgccgccgcttcaaggtggcgcgcgctctatgaagaacaaggatacaagatatacaaacaagatttgtcacacgcctctgctcccgcccaacaaatagcaaa

SEQ ID NO: 527370 - DNA, 641 bp, Homo sapiens
actgacacaggcagcacccttttgcagaagtagatgtgcgtagctgagaaagttgtctggctaagattcctggtatactattgcagcaaccaggatgtgtttctaacacagggaaagagtgagctgtaaaaacctctctaggattcaagaaagcgtgagaagtcatatggaacaatacgggtgaggagcacgggactattctctcatgttgaatgtggagaacctttatagatacaagtcggaggagagcaatctacaccaaggatgttggaggacagcatgtacatggtaaggacatacacagaaatagaacagtggcccagactcagaagatgcccctgggaccctctggtgccaaattaccatacgatttatcctttacatctccaagattaattgtgacactctatggatggggatatgataaatgacagaaacgtacctctcagacagatgattggatgtgaatcacattagccaatgaagataagaggctgtagaaaaacgatgtgataatgacatatcctgaaattgcgagtccacaattacaaaagtggatatgtcagtaacgcattgagctttactcacaatataataacaagacataataatagagtacggctcaaattagtaattacaga

SEQ ID NO: 527371 - DNA, 297 bp, Homo sapiens
  misc_feature (7)..(7): n is a, c, g, or t
  misc_feature (95)..(95): n is a, c, g, or t
  misc_feature (161)..(161): n is a, c, g, or t
  misc_feature (244)..(244): n is a, c, g, or t
ggttttnattcattctcttctattaacctctctaaaggaaattgggcacctgtaatcccagcactttgggaggctgaggtgggtgggtcactttnaggtcaggagttcaagaccaacctggccagcatggtgaaaacccatctctactaaaaatacaaaanttagccaggctggtggtgttcgcctgtaatcccagctactcaggaggctgaggcaggagaattgtttgaacctgggaggcggnggttgcagtgagctgagatcgtgccactgcattccagcccagggtgacagagt

SEQ ID NO: 527372 - DNA, 922 bp, Homo sapiens
ttgaggtttgtttccgtatctatgacatggataagatggctatatttccaatggggaactcttccaggtacttgaagatgatggtggggaacaatctgcaaagatacacagtctacaggcccacattgttagacaaaaccataataaactgcagcataacgcgactggacatggaaaccaactatccttctgaagaacttctgtgcctgctctgtgcgtggcctagatactccacagcaagcatggtggctagatgtgtgacgtcttatcacgagagtaccacccagcacttttgctttctctctccactcctctgcaaggatctgctccaagcacgctccagcccctgcctcctcctgctgctctttaccatgcgcccctccctctcctcctcctgctggaagcccaccacctttctctcccacaccacctgcacgccgcgtacgatccacgccgcccccgtagccgctgtccgctctgacacctgccacactccatgcctcacattacacctcagcctgctacgccaccctcttctccacgcctcctgccacggctccgcccccccctgaccctgcgccacttctcccctgccccggctgcgccgaaccgcgcccaccgcggctccgcgcctatctctccgacctgccagttgtccgttcatgctttgtacgtacagcgaaggaacagcttatcctagtagtatacgagtagtgctaaggttagtttagtccttctcgcgactcctctgtcaccgccttccccaacactacctgccagcctcccgcctcgccccctcacccccccgtacccgctatcaccttcacagaaccgccgccacggcttctcccccgcgtgccgacatggcaccgcgacgcgtccctacactcacaccccacgccctgcatatcgcacacggccc

SEQ ID NO: 527373 - DNA, 224 bp, Homo sapiens
tctgaggatcccgtgctcacttcatcgcgttgtctaaagactgattagatgggggcgggcacctgtaatcccacctactcaggaggctgaggcttgaacccagtgagctgagattatgccactgcaatgcagcttgggcaacagagcaaaactgtgtctcaaaaaaaacacaaaaattgaaaaaaaaaaagtggccgggcgtggtggcttatacttgtaatccc

SEQ ID NO: 527374 - DNA, 1034 bp, Homo sapiens
  misc_feature (799)..(799): n is a, c, g, or t
ctgagtggggacgtccggcttcgcatctgcagagttgtatcgtagtgtccactcgcactcactaagagatatgacctatgcgcttgatggcttgacaaaatcggcatcgcaatgatttgcatgcatgaagatgttccccatgtgcccacaacccgctagataagcggaggctattgcgcaatgattggccacaatatatctcaccatggcgcatcgtttggtcaggaagtacttggtggatggccacctgtgaataattcattactacttgtacgtctaattataacctatggatctctaatctggacgttaagaggattccatatgtaatgtccagtcatttggcatcaatcccacagaaagtacattcttatgatatagaaatgatcttcgtcggcatttgagaagaagggctgaaatgggcatgcacattcacatcacgtcttattctcgagaagagcacggtacctaacgttgtagtacgtacttgggtcacctgccttgattttattatcgaagagatcatgtctcatgacttttctatgtgtaccatccttttatatagatctaatacactcagatattcatcatcattgatatgctttggcccatgaatatttcgtgcgtcagtcctgctttccaccctaatgtctgctctgtgggtttaatgagatatgttcgagactttggaatttcaaatacgtaacttccaaattcagtaaattggtacttaactgttgtaaccccttttcataagatctcattttgactttccggtagtcacttgttcacctttttncaccaacgattggtgggtgcctcttaaacctaactgggagattgggttacatacttgagacttcagttaccggggggtggaaatttttcacatactggggagatgggcccggttgaacacagcggatcaccgggttagagaccgggcacgggcttaaagaaggggagaaaagggcacggtattgggaacacaaataaacggcggaaagagaatacaggaggggtaaaaacacacg

SEQ ID NO: 527375 - DNA, 115 bp, Homo sapiens
ctcctctcataatagtagcatcctttctgaggtgtcattgcaccagtgcacctaagtgagtgctccagatatccccagagcagttaaagacatcccaagcatggtacatgctaat

SEQ ID NO: 527376 - DNA, 796 bp, Homo sapiens
  misc_feature (51)..(51): n is a, c, g, or t
  misc_feature (62)..(62): n is a, c, g, or t
  misc_feature (74)..(77): n is a, c, g, or t
  misc_feature (80)..(82): n is a, c, g, or t
  misc_feature (97)..(97): n is a, c, g, or t
  misc_feature (99)..(99): n is a, c, g, or t
  misc_feature (126)..(127): n is a, c, g, or t
  misc_feature (129)..(129): n is a, c, g, or t
  misc_feature (232)..(232): n is a, c, g, or t
  misc_feature (273)..(273): n is a, c, g, or t
  misc_feature (285)..(285): n is a, c, g, or t
  misc_feature (296)..(296): n is a, c, g, or t
  misc_feature (333)..(333): n is a, c, g, or t
  misc_feature (348)..(348): n is a, c, g, or t
  misc_feature (350)..(350): n is a, c, g, or t
  misc_feature (362)..(362): n is a, c, g, or t
  misc_feature (366)..(366): n is a, c, g, or t
  misc_feature (371)..(371): n is a, c, g, or t
  misc_feature (391)..(391): n is a, c, g, or t
  misc_feature (396)..(396): n is a, c, g, or t
  misc_feature (405)..(405): n is a, c, g, or t
  misc_feature (410)..(410): n is a, c, g, or t
  misc_feature (557)..(557): n is a, c, g, or t
  misc_feature (716)..(716): n is a, c, g, or t
  misc_feature (726)..(726): n is a, c, g, or t
  misc_feature (744)..(744): n is a, c, g, or t
tggaagacttgctggcccagaaaatcccacttgtttcaccgaacactcatnttttcagtgantttacatttcannnnaannnacggggtcacccacncncacccgggctggcggacagtgatgtgnncncaggccactgcagcctcaaactcctgtgctcaagtgagccacccacgtcagcctcccaaggaactgggacgcacaggcatgcatcaccacgccgcgagctgantttttaaaaatgtttttgtagagagggggtctccctgtgtngcccagcctggncccaaactccnggtctcaagtgatgctcccacctcagtctcccaaagngccgagattacaggngngagcactgtgcntggncattntaattttttaaatgcctgtnttggnctcagaggntgagnaaccagcctcagagttattgagccattatctgggcaggaacgggggtcgagtttgcatatgcgatatacacatcctcagacagagcactgaaagcatctgaggtggctgtagcctattttatccagcagcttctgcctgcattcttnccatccaactcattggcctttcaggactttccatcaaatatctgatcatggggatctcagcccagactgactatgccctggaggtagggtgagtgagtacaagtacagttatttaaaaacatttaagccaggcgtggtggttcatgcctgttaacccancactttgggnaggccaaggcaggtgggntcactgaggcccaggcattcgagaccagcctggccaacatggtgaaacgtgt

SEQ ID NO: 527377 - DNA, 207 bp, Homo sapiens
ctagagggccacctcggtgtatgccttctcggtgcgcccgcgtggccgccggggtgcctgttagttggcgctccctgcgtggcgaacgtacgtacttatcgagagtgtggcgtctcgtattcggcatcatggtcctggacttctccctagtatgaacgagctgcagcggcgcctcggaccccggggcctggtggtgctcggcttccc

SEQ ID NO: 527378 - DNA, 999 bp, Homo sapiens
  misc_feature (269)..(269): n is a, c, g, or t
agtgttcggtgcccgcagacattgttttcagcagggtcccgcctggcccggcccacgccgaggttgtgggggtgtccccggtgttttgaaaagtggtataataccggccatagtctgttggacgccgcttggcgtgaaacttctcggtgaaggtgtgcccacccagacacggcgtattgcgccccctcggaccgccggcgttgttaacccctgaggcggacgagttttcaactgtgggcggtattcctctggttggcgcccgcccgcgnaaaagttagttgtcctctcaaaattaaagaggtatttttccagagttgttgtattaccaaagggcccgatctctatactgatacaagcgtgcccctcgccggccccctccccccctttttggaccgtgggccgccttccttttatgaaaaaggtttttcgctacttatgaaaaggagccccctcaactgatggaaaatgaatggttgtgtgtgggcgccacgttttccaccacaagctggtgtaaagaaattatatccgttctgcgcacgcggtacccccttttttcttctctgggagaaaccaaaaggggtcgctttctctcgccgggcgccgcacatgtgacagacaacgacgccggagaggcttgtgaaaacccgcaacacggggtggtttgtctcgcccgtgttgaaaatattgtgtattgctgcccctgcccccgaggatgagtgaaccttccgaatccgaaggccgtagtactcgagctgagaggaacaccccaactctctcgggtgtttctcgagaagtatgttgagctctggagattgtggcattctctggggtgtttaaaagaaaaggtgaccaccaacttcacgtagacgtcctggccaacgctttttccccccgggaattatggggtcccagacaaaaccttaatgaggggttttaaaccacccactggaaaatgaccaccccccttaaaaaaaattggggtttttccaaaaaaaaaaa

SEQ ID NO: 527379 - DNA, 257 bp, Homo sapiens
tagcctcgagggtgatgacacctgcacagacctgtacccccctgagttattcacctgaacggaccttggacgcacggagggtgtggattccaatgatgagggcaggagagagacgaccgtgtaccgagggatgtcctagaagcgcgggaagaagccgttgggctcgttgaaaatgaagttcaagattcttctccgcaaacccaagagcttcagctcctgtaaacagcgcaggttaataaaagcactattccgtgaca

SEQ ID NO: 527380 - DNA, 184 bp, Homo sapiens
  misc_feature (7)..(7): n is a, c, g, or t
  misc_feature (85)..(85): n is a, c, g, or t
  misc_feature (134)..(134): n is a, c, g, or t
  misc_feature (154)..(154): n is a, c, g, or t
aaatttnacaacatgagcacttgccactaaggggtgtagaatatatctaattggttacctaagacacttgaaagaactagtaggntctctctttaattcccatgttagggtagaagctcccctaaaatcagganacatgtgtaatgacttcctntggggggtgcatggcaacatattcaagcta

SEQ ID NO: 527381 - DNA, 257 bp, Homo sapiens
tagcatctttattgtttcactggtgcaagaaataaatcataattgtgatgcttttcctgctacattttacaatgaaggtgatacatataggttgatatataatcacaagtttcctttatatactatttaaaacccaattcatattgataaatatgtccataggacaacatgggttcttattggatggctgagtccaaatatgtcaaaatatagcttctggttttgaccatggtgctattgaaagttctaaaactagg

SEQ ID NO: 527382 - DNA, 109 bp, Homo sapiens
cgatacgactttttttgccatttctggttaattcctgcttctcaagtaacagctcggaagtatctccctgctaagatcccagtaatgtttgcccttctgtcgtcttctc

SEQ ID NO: 527383 - DNA, 1510 bp, Homo sapiens
cgtcgggattgtttattgcctgtgtgaccctgctgttgtcaatagccgcgactcccctgtgtttttacgcggggggtcatttttctcgatgagcttttatcccattgcttgtgtgggcccaaggcacactttctcaaagacgcgtgtctcccctgccgtcttccgctgttttgtgaccacgtccctgggtgtatgctcccaggccgcccccccttttgtgtgtgtttttgatatcgttctcagaagtactcctgtttctggtccgaaatttgccgggacttgagatcctctaatgtttgttggggaccaaaccctctgcatggtttttccccactgttactcctgtgctggcccccccccttcagtcctgtgttgcaaccttataagtccccggatctctgcgggtgtacccctcctttgtgttagggggcgcttgttttttgaggagagtgtttggggactcccgagattttgtccgcccaggtgttgtgggccccgtgtcccttgcggggtggccacccttctctcctgtgttattctcggcggggtaaccacatccatcggtgcctttgataaaataattggtatttctggtgtgtccaccgctattttcccccctcatgcgtgctctttggggcccgccctgtttctttctgtgtgtgaaaatggtaggtgagtctctttagacacacttaggacatacgcgcgttttctacaaactctccgagagaatatcatcacaccacatgttttcagaggatatatatatgtggccctgtgataaacaacgggaggcgcgatatatatcatatatcgtggtcaccacacgggattatctacacactgttttgttcccaacatagtagagagttttctcagggagaaatgtagataacttaatgctttccaagagttattttcttaaaatattagtacccatatatatttcgaaaatcatgggaaaagcgatattttttcccccagagataattattacaatacaaaaaatgcgcgcattactatccccccataacgcaaaatagtttttctcatactctcacctctcttttattgttacacagaaatataattttagaacattatgtgatgtgccccacaggagagccccctacagatatccgctccgcaggcaccttgagaagaagagatattggcctcatgtgtagaaaaacccacacggcagcccgacagagagttttatgtatccacgtctctccatatctttgtgagaacccacacaccggaggggcacccacacacaagggggtgcgacgtttctccaaacccccaccctcactgaggagaagacaactgcgtgcttattttacatctacgcccccttcacttttttccccgcgccccacagcagagggggcccacattctgtggtaggggccatgggtcccccattggccccccctggagagaatagtacagagcatgccacacccatatttttttttaaattaaatttggtgtttcccaaaca

SEQ ID NO: 527384 - DNA, 519 bp, Homo sapiens
  misc_feature (19)..(19): n is a, c, g, or t
  misc_feature (41)..(41): n is a, c, g, or t
  misc_feature (79)..(79): n is a, c, g, or t
  misc_feature (86)..(86): n is a, c, g, or t
  misc_feature (107)..(107): n is a, c, g, or t
  misc_feature (147)..(147): n is a, c, g, or t
  misc_feature (201)..(201): n is a, c, g, or t
aaaaactttaatgcctgcncccaaaaaaaaggttccaaaangttgttttcctaaaaaccctgggttccttgaagggaanggaaaangtctttgtcaacctttcctancccctcatgtagagtgcaagtgtttaaaaaagcccacccntggcagtgggtacatggtgaatcattaatgaacaaaggagggataactgtaacncccaggagttgaagggcttggtatatggaggcttacctgtcccaacccctgctcccctggctctgttcccccatcgcaggggctcctgtttcaatctcccatctttgtcccagtgctgcagaaccacattggagtcagattgaatggacaggaggcatctccagtcacacatctaggcttctaacctagaattgtattgagactgtatacaccttgtttagtttttgtttcacctcttttaataccaaatactagaagaacttataagcagtctagtatgtgaaatcataagtcttattcaacaacatggaaaaaaaa

SEQ ID NO: 527385 - DNA, 355 bp, Homo sapiens
catgtacatcctgccgaggagccggggatggtcagaaacgtcagtgcagccgctttgccctcatgcccattgcacgccacggggccctcacctacgtggtggggcgctctttccacgtgtccctcctggtccatttgcccacccagtgaggcaggctcatccccttatttcctgacatttgtgtggttggtgcttttagagaactctccttgtggactctgttctgcaccattgtcacagcccagagaggggggaatgttagtcccaaagaggagaggggacttccctaggaccatccagggggtgggaagcagagtgggtctcgaaccttctccgattcgggaaatcgccttct

SEQ ID NO: 527386 - DNA, 227 bp, Homo sapiens
  misc_feature (17)..(17): n is a, c, g, or t
  misc_feature (185)..(185): n is a, c, g, or t
agcacttggtcaggatngcagacagcagagatcacattgtgatgtgacactcgaataagttgattgtgtttatctttaaccacagatcattccttctgtagctcaggagagcaccctcccacccatttgtcgcagtatcctagaatctttgtgctctcgctgcagttccctttggttccatgtgntccttgttccctcccatggctagctggattgcactccgcttg

SEQ ID NO: 527387 - DNA, 424 bp, Homo sapiens
  misc_feature (93)..(93): n is a, c, g, or t
  misc_feature (188)..(188): n is a, c, g, or t
acaacccgaagtgctttgaatcacagaggaactttgcatcttggccttctgaagggggcccgcaatgttgccagtgttggtctgcagattggntacccaattgttgcatcagcaccccattttatcatcaacgggtacaaacgagtcctggccttgtctgtggagacggattaccccttcccccttgntgaaaaggtcaaggcctttttgggtgatccatttgcctttgtgggtggtgcccctgtgggtgctgcccccccagctgctcctgttgttgttgcagccccagctaaggttgaagccaaggaaaagtcggaggagtcggacgaggaaatgggatttggtttttttgactaatccccaaaaagcaccccacttagccagttttatttgcaaaacaaggaaataaaggcttactttttta

SEQ ID NO: 527388 - DNA, 315 bp, Homo sapiens
  misc_feature (49)..(49): n is a, c, g, or t
  misc_feature (55)..(55): n is a, c, g, or t
  misc_feature (67)..(67): n is a, c, g, or t
  misc_feature (90)..(90): n is a, c, g, or t
  misc_feature (97)..(97): n is a, c, g, or t
  misc_feature (275)..(276): n is a, c, g, or t
gagacagaacccagcaggacatgctcagcacagctcccaccgcaagttngagatngacgcaacgaangaaactcggggagcgactcatcngaaatgncctgcgcctacgaaaatccagcgcctcagagaccagactccaagagcaagagcaggtcacagggttccacaccctcgctggagttcggcttccttccctctccaactccgagggtacgacttagaggtgaagaccaactgaccccctcttggtgaagccatctccagccacacgccannaagaaacacagcatggtctgttccccaaagcccaggacc

SEQ ID NO: 527389 - DNA, 1316 bp, Homo sapiens
ccgtggaccctccccctcgacttctcgttctactgccccaggagcccggcgggtcacgggacatccacgtccgtgccggatgcgggcgccggcatgatggcatgatgtggaggaccagggacggactcactgggaccctatatctcctatccatgcatgctagtgcatgctagcatggatgacgctggagcaccggatcaatgcactgccatcctcaccggacagaccatcgttcgaatcatacatgcgacgtcattcagacatttgagaccggatgacccatcatttgacacgggaccccgtgacaggatgctcacagccaccgtggcaccgcatatatcatgcacatacgacaccacacgatggacggcacgcccacgcacggcgcaccagaagaacccacgcataggacacggccaatatccggcacggccagacatcaagacatgtgcagcgagacgaagagctgatgtagcagtctggcacatttagcagttttaccgttcatggcacggtggcattcccgtagtctttcaattgcaacggcatgacaccacaagatgagcatcagggcacgcactggcatcgcgtgccacttggtgtagcatcccgtcgtcagcactctggcaccactttggggcacacccaccataaccaggcaacacgctgggcacttcccgttggccgcggcccacacaccccgaccaggcactcccgacggcacattggcaacagacccgctaggacatgccaccacacacgaaatgcccacagtgaacaccgcgtaaaccgggggccaccggccactgatagaccacgacacgatggccgcatacaacacgcgcaagtacagaccggtccacaccaaacagcgtaaacgactcaggcacatggattcgcccacagggggcacgcaagggacacacacacacaccggggaccataccacgtcggcagggccgccatacaccagccacccgaccttggctcaatcgatcgcgcgcacactccgcccgagccaacaccacgggaagttcacaagccacaacaaggatggagtggcgaaacagggccaacacagcgaccacataggcgccaccgcaccaaaggagcagccccgcaagccacacacacctggaacgcaccacacacaccggccaacaagacgccaatggtaccactcgaccgcagcacctgtacaacccacaccaccggaaagcacttgcgaaacaccaccccagagcccgaacgacagcgggacgccacggaggcaaccacccacccggcccacatgagaccacacagccccgcggcca

SEQ ID NO: 527390 - DNA, 203 bp, Homo sapiens
ggggggggttcccccccctttccccccccccgggggggaaaggggggggggggaatttttttccaaaaccgggtttgggggggaaacctttttttgggggtttttggtttggttttggggggttggtttttggttttgggggggccaaaccccccgggggtgaaaaaaaggtttgccctttatttaacccgggttttccccca

SEQ ID NO: 527391 - DNA, 347 bp, Homo sapiens
  misc_feature (88)..(88): n is a, c, g, or t
  misc_feature (107)..(107): n is a, c, g, or t
  misc_feature (121)..(121): n is a, c, g, or t
  misc_feature (186)..(186): n is a, c, g, or t
  misc_feature (188)..(188): n is a, c, g, or t
  misc_feature (262)..(262): n is a, c, g, or t
  misc_feature (322)..(322): n is a, c, g, or t
ggagttctggggacgcagtgccccaactgggaaaagggcgggatcgggccctggttcctccttgtccccccttttttgggggcttgcnactttttgttttttattgngtggctttttgagnatttgaaccccagtcctgtgtccccttcctttttccttttatgtcccctctttgcgggggggcgntnaggttaagggggaattgggttttggtagggcttcccccttttccccatcccggtttccaaaaacccagtttttnaaaaacagggtgtgggcatttccatgcccctataaagggggcctggggtttttttggggntggggaggaataacccatgtatata

SEQ ID NO: 527392 - DNA, 186 bp, Homo sapiens
tctagcaggatccccgagcccagaacgatgaagttattccttggacagtgatatgacatttcagcttgtgtcacatacagcggcttgattcagcatgccactacagttgtaaaccaggatttcaggacatcatcggatggtatctatctctctgaaaaaggaatctgttcagctacgctgattaac

SEQ ID NO: 527393 - DNA, 1049 bp, Homo sapiens
ggatccatagcatgtgaacgattctctgtgcagtcagactcccgtagtagcttgatattaaacggtctgggactcacgacgactcacagtaatactatttccctgatgactgatacacagagcgagaactgcaaggaacatgtctcaaacatagcatgtgtccagctcctgtgaactctgaagaaaaagcttgaagaccccaagaaggatggcaagctttctcatataaataatcaagttgggagatgaatgtatccctggtgatctggaatttgccctcttgagtcgagacaaggtatgagcacaagggcactatctcatagcaaggtaaatggcatcgtcgtgtcccctgtgtcgcgaccttcttccattcttgatcgaacagagcagctagtgatgtgccaacttggatctcggataagatgagtgttaattacagacgtatttatggttggtgtcggattggcaggagaagaggcgatttgatctcagaatagaatttggggcctgctcctggaattttgaagcatcgaagacttgaatacgacattgtcgtagagaacgcaaatgaactatgggggaaacccctttatgaccgaaaagagaaacaactaggtcaataggtgttgtgcttgagttgtcgcccttagaaccatcagatagagaggaagaccccattgaaatcggtacggagtagagtgacgatcccacctagggtacatgagggcatctataccctggagtagtaagccgtcttccaggtgcctcaacaagatggacattccgtcaccatggcgagagatacccacgatcaggtcaggttcaactcctacgtcaatatgaagcccacgagaatggtgttacagtattttaccctcttgcacagagtgtggaattgccacatgggaaacatttaaaaggaccaacattatatcatgatgcgctggacggacaacttaattcgttcttcacccagaatcctatgcatatcgtagaaaaataatatcaatcattagaaaaaaaaaagaataagaaaatagaacaaataa

SEQ ID NO: 527394 - DNA, 177 bp, Homo sapiens
gttagttttaccctactgatgatgtgttgttgccaaagtcaaaactatagaagagttgcctcctgtctctcgaatcttccagagatatcacttaattgttaacagcttttgtgttaatccccctcaggccctaggtctcttaatctcaccaacgcttgagagagtgatatcctcagg

SEQ ID NO: 527395 - DNA, 129 bp, Homo sapiens
  misc_feature (49)..(49): n is a, c, g, or t
  misc_feature (67)..(67): n is a, c, g, or t
  misc_feature (99)..(99): n is a, c, g, or t
  misc_feature (118)..(118): n is a, c, g, or t
gatcaaatgtgggcccgtttttggccgccgccgccctgccccgtccctncggccaccacctaattanttgccgtgcttcctgctgctgtaactgctttnttacctttccaataaagantttcttggttt

SEQ ID NO: 527396 - DNA, 479 bp, Homo sapiens
tacatcaaccaaaggaaaggactaagggtcaagaggagagagaagaaatgctgtcagacacatagaaagtcatgagcacaacggcactattaagtccttccctatctgtacactacttcaaatataactggcttacaacacctacaaaacgcaccagcataggcagaatggattcaaaataaacaggcatcgcgagcccgggcatgcggtggttcactgccttgtactcctggcactttgcagcagtctgaggcaggtggcatcacctgcaagtcagcagtacagagcacatgcttggacaacatgcacagacccccgtctctcataaaaatacaaaacattcagctgggcatggtggagggccccctgtaatcccagttactcgggaggctgaggcaggcacatcacttgatcccagagaggcggaggttgcagtgagctgagatcgtgccactgcgctctacgctggtcgaccagcg

SEQ ID NO: 527397 - DNA, 152 bp, Homo sapiens
cagatcgactgacaacatattcgttataaaatcttgtgccaaaagttttttttgggtttgaagaaaataaaattgatagaacttttggaattccagaagactttgactacatagactaaaatattccatggaggggagggagacatccctgt

SEQ ID NO: 527398 - DNA, 312 bp, Homo sapiens
  misc_feature (231)..(231): n is a, c, g, or t
tgcgtacagctactattgtggggtcaagtaggttcctgcggcacagcataggagcagcatcagcccgagtagactggtctgtctgtcatactcaggtctccggagaggggaggatattatttctaaagttgcacttattgtgaggatctcaggattgttgggggctactgaaaagaggaatgtgttgaatgtcgcgtttgctgtccactcgtcctagaagtatagtgtttntgtcactgtcgtgtttctgtgggcagagctggttctggagggtgtgtcagtgcacccgaggctcagagcatccatccaccc

SEQ ID NO: 527399 - DNA, 194 bp, Homo sapiens
cactccttacgtctcagttcacatcccaactctatatttacaataacgaattcaggatgaggaagtaaaaacaggtcatctattcacaaaagtgaaatacttcattaaccccagctcaaactatacaaactgcttacagcatttgctgacaattgtctccaattctggctcatcaacattcatttaggttttcc

SEQ ID NO: 527400 - DNA, 642 bp, Homo sapiens
  misc_feature (57)..(58): n is a, c, g, or t
  misc_feature (199)..(199): n is a, c, g, or t
  misc_feature (201)..(201): n is a, c, g, or t
  misc_feature (546)..(546): n is a, c, g, or t
ggaaatattataaggaccattaagaagtgaagcaaaggtaaagccactgaacttagnngggagatggaggtttctctggaaataatcagttaatataaaaaatccaattctttcctcctgttttcctccctccctccctttattcctccttctcctgcttcctccatcttccctccctctctcttttcttctttccttntntctttcctttcttctctactttcttggttctttccttttttcctccaataaacaagttgaaacaattatctgattcttatttctagacaaaaaaaatcaaaagtgattattttccaggattaacaaaactgtgcattaagaggaaattctttagatcagatgattttaaattttagaaccgtgatcacacaagtcatattagagtatttttttttgcaaaatttctctcttaagccccaaattcttaccgtttacgtgacagtatccttgaaactttataaattggccttttacattcaagtctgtctgtactgaacctaattgtcatatcatggagatatgttncttgcatctaattctcatttggattatgcttcctcacagggaccctgaccactgaacaataaagcaattatcgccatgatgatatgcaatattgag

SEQ ID NO: 527401 - DNA, 483 bp, Homo sapiens
acccgccaagctcataccacgtgttctcactgtataagtgggagttaaatgatagagaacacatgtacacttatgagcagaacagacactggcgcctattgacagggtggcagggtggcgggggagcagcacacaaaataactatcgggtactagcctgggtgatgaaatactttatacaacaaaccacagatgacacaagttaacccaaagaacaaaccggcacatgtgcccttaaacctaaaagtacgtctacttgagagagagtctcgcactgacacccaggctggagtgcaatggtgcaatcttggctcgctgcaaactccacctcctgggtacaagcgactcttctgcctcagcctcccgagtagctgggattacaggagcacaacaccacacccggctaatttatagtcgttctagtagagacaggggttacactatgtaagccagactggtcttgaaattctgacctcgtgatctg

SEQ ID NO: 527402 - DNA, 288 bp, Homo sapiens
  misc_feature (220)..(220): n is a, c, g, or t
  misc_feature (226)..(226): n is a, c, g, or t
  misc_feature (265)..(265): n is a, c, g, or t
ttctccccacctcagcctcctgagtagctgggactacaagtgtgcacccaccatgccctggctaattttttgaatttttgtagtgatgggatctcgctctgttgcccagggtggtctcgaactccctggcctcaagcgatcctcccacctcgacctcccaaagtgctgggattacaggtgtgagccacctcgcctgggcccccttctccatatgcctccnaaaacntgtccctggagagtagcctgctcccacactgtcactggntgtcatggggccaataaaatctc

SEQ ID NO: 527403 - DNA, 698 bp, Homo sapiens
tccagttagttctgatttcaggtcatccaaaaaaccccgtgccaaacagagtcttaaaagctgcaaaaattccctggcgctgagctaattacttcgggattgttcaacagaagctcaggattgcctcctcctctcattcgtgtgtccccaagccttttcaatagccttctccgaagaagttttcgtgcatctcagcccgctctcattcaaatctccagggaaaagtctcagtctcacgagtgtgcctctctgtgagaacacctgtgtgtgcccgagtgggcgacacttactctcgaggtctcgaggggagaagagtggtgacacagacagaggacaaccgagacagtgtgtgtggggacacccaaaagtgtgcccgcgaaacacccgcgggaagaagacgggaggaagaaagcccgggacgaagcggttcacgcggggtacacagcggccgaaagatattgcagaaacgccacacaacaaagcaaacaggcaagaggagggtatcgaaggggggaaaaaaacccattgtgggaacacccccccgagatattagcaggctcttgttcatctttatagaacctaactattctgcggcctgaagacaggaccaagtttcttctcaagtctgcccaaagttcgcagaaatcttggaaaaagcgcctggacagatctggaaaacgctgaacgtggtgaacagg

SEQ ID NO: 527404 - DNA, 712 bp, Homo sapiens
  misc_feature (390)..(390): n is a, c, g, or t
  misc_feature (416)..(416): n is a, c, g, or t
  misc_feature (557)..(557): n is a, c, g, or t
  misc_feature (613)..(613): n is a, c, g, or t
  misc_feature (676)..(676): n is a, c, g, or t
  misc_feature (696)..(696): n is a, c, g, or t
  misc_feature (706)..(706): n is a, c, g, or t
gggggctccttctagtgagcaagggccctgagcttctacagcccttcgtatttattaggtagaaagagcagggagggagaggtagcagttggtcagttgcttgatttatcacaggtatacataattgctttctttgtacaacaggcttcagatgttcctatagataatcacaaggaacactgtgcttggggtgtgactgccctcagcaacccttctggcagcagacacagttgttagttttccaacatcctgctttcatgagaacagttttctatttgctcatatagcctccagtggtatactgagttggtcacgaccctcattctttcggcctgtaacaggctcatgcctgtaatgccagcacttttggaggccggggcaggaggatancttgagctcaggagttggagaccagnctgggcaacacggtgaaaccccatctctgcaaaaattagcctggtgtggtggggtgcgcctgtggtctcagctgcttgtggggctgaggcgggagaatggcttgagctccgggggtcgaggctgcagtgagccataatggngctgctgcattccagcctgggtgacaaagtgagactattctcaaaaaaaaaaaacngctggttgataaaaatgaagacaaaccacatttgcagggatataaaatcttaaccccatttantgggggtataaggctctggnggcaaaattncatctg

SEQ ID NO: 527405 - DNA, 184 bp, Homo sapiens
gctattttatacaggaaaactgcctctggaagttctcactataatgatgagcgattttatgtgtagttaacacaccttccagtaaaacctgtatattattattatttttgagacaggatctctctctgtcacccaggctggagagccgtggtacaatctcggctcactgcaacgtccgtctcca

SEQ ID NO: 527406 - DNA, 783 bp, Homo sapiens
tataaaatttattagttataaaaggggaaataggtaggagtagcggggtaagggcgataagtggtggggaggaagggggggggtttggttattgtccaactctggtctctttttattttaactgttggtaaaaaatatgggggatgtagtggtggatgttagaagaagaagtggagagaagaagggctatacgtattatgtggaggggaaaaaatttgggtatatagattggaaatggggggctatgtttatgggtcatggtgaaaaagaagcaggccggattgtcacaaggggtcgcctaggggtaaacctcgggggactcaaaagtggaaagggggctaatccctaagtttaattggccaattacccatataaggattaatctaatggactgaagttattgattggggaagtaatcggggttatgggttccattggtccggagagtcatattggtgtggaaagaggatacctattaaaaaggatatcatgggattagccggtaggctgagcgtagagcgaacatccctggaagggcaccctacccgggggacccgagggtcaatattccggggtgaaacaccgggacataacaacgcctacccggtcgcaatctcctagggcctaaccccggggaaaaaatcccggggcgagctaaagccccggggaaaaatggggcctgcacaaattgggcaataaaccaagaccgagcccaccaaacccggactacgcggcaaacgaaccacggaacccaaacccggcaccccccaaagccggaacaac

SEQ ID NO: 527407 - DNA, 377 bp, Homo sapiens
gtagtttttcactaagtatactctttaaaatcaacccagtaagagacagaacatttaaatgcagatagctatcaggtagacatacagtagaccgggcccctatacttgagtaagttagaaagtagcagaactatacatgcatataatacaagaggcatagtggcaatattgctcctgagttcccatagtgggaatcatgggaaatatgccttgctgtaagaaaaacctataattttgcattcccagatatctaatttagactatccactctaaacatttaattatcagcagctgtaacctctaaaaatgtgtagagtgatgtatggcttaaacagaaataaaaactagctttcaccagagcataaagaaaaacaaaa

SEQ ID NO: 527408 - DNA, 8017 bp, Homo sapiens
cagttttagttgtttttaatgagctttctgagcttggaaaacatgtcaaaattgtgtgtagttaaaagcctctgaggaaagagtctaaacattaaaccttcccgactgtggttcacagcaaaaatgtccagtgtttaggagcactagctcagactcaaactgccccttcttagcagtttgatcttaagcaaccttaatttgatctcaggcaaattacatttctctgggcctccatttactcatttttaagaagaggatatcaataacctaccacattgggttgttgtgaggattaaatacacattgaaatattaagaaaatgcctagcacacagtaagctctcagtaaatacttgctattattttatattgacctaaatatgccctttcatcaatcagttatattcttgggcaaggtattttaacaaatcactggccacttggaagtggaggcaacttgcagaaaattgtgagcataccatggagttcctggagttgtgcagcacagtgctggctggcctctgctaactttgtcttaataacctcaatgctaaatccatcctaagtaaatttaaatcacatccttagacacactgtccattctcaaaccgaatgaaaaaaaaattccacaagaaacaatgaaatacacattaacattttccctctatgtcccttgaatgtaagttctcttaaaattttctgtatactgattttatatcaagaacacttggatgataaataaacattaaggtaaaatgtaataggcacttcttttggggggaaaaactatgaaaggaacaactttttatattgaaattgcatcagaatccagggtagcaaagttataacttcttgaagttatcaaattaaccacagtccaaagaatggctgttagtatcctttggctgaacagattactgtgttaattagaacacagttattagtggttcttaaattcaaagtcatataaattttagtttatgcttgcacttaactcactcagttaattttcaaacataaggttcgactcctgttattagcgacttgacacgttctgctgaagctctcacttttcttctaattctgaaagtacttttatacattctgaaatggcatttcagcagatggaaaaatgaaggtggcaaatcaggaccaatttcttatttcaaggttaaattaatactaaaccagactattaatgaaaacatcttcatcaaaattaactagagagttggtagttctctgaaactttgtataaattttatttattactgtaaatactaaaatcacattgaaaacaccttaaagttaagtcccaacccgattattagagaaaatcacttgggcatccagtccccttgatcgaacctgggtaacaaaagaggcaaaagacatgatttgtgatgaaacttactattcaaatgctaaatgttttcaagctttaataaggtatatatcaattccaagtaccaagcataatataaaaattcaaattcatgggtttactcttaataagcatcaaaagcaaattttgcgcactgaatcctatcttactcttgattggcacaatgcattcagagatgagttataattaggaaaaaagagtgtccactgaatgcatcatgtgtaaaaatgcaattaacatttcaaaaccacattaaaagggaaaatacctaaaaagttaactcttaataaaattatttgaaacaatattatcctgcagataaaaatacatttcttgtatatacatgtagatttctacatgaaagaaaagattcagctccaaatagaaaagggctgacccttgataaagacatcttagattgccaaactgatgtgattaccactgtaagaactaaaaacagaaggataaaaagattaagttaaaggaaggataaaagtttagtcaactgctcctgaacagtggcagagttgggtgagaagtgggagatgaaggcagaaataagacaaagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaagaaagctcacagaaacttcatgcagaggtacagcattaaagttctttgtttcctaattaatgttgtatgcagaagtattctgtaaactaaattttcctgacagaaaagttcccacatcctcaacagatgagaatgattgcattatttgggatccttgatcaatacgaaccacatactgtcccttctcaaagactaagttccttatttttcacccaaatcctatatattgaaagacaaccaaggtgctaaatgttaaccactagtcaagttaggaatgtctgaagaaaatatattaaccttgacataaagaagatgtttttggtcaaatttcagacatgtattattataaattaataactggctccatccaccaggttaaagatgaagggagggcctaagatgtctctagagtttatatacacacaagtgagtgtcactgttttgttttgtttttgacctagttttattaaatattgcttccttggggtgtgtttataacaactcccagaacatttcatgtaaggattcaaagcggtcatattaaaatacagcttcaatataaagtttatcacagttttacagtattcaaaaatgacagacctgccttaaaaaacaaaacaaaaaccaaaaaaggactattacacccaaaacataagaaaacaattaaataaacaagtttggcattttcataactttatagtataaaacagaatattaaatttattactggcaaacggacactgatttatttcctttgaaatgtgtcccatttaaacacactatacaagttcattatacaaaagatggatgatcattttgatgaaagaagtgcaccctgaaaatttttgccagtttagaatatttagctcttaaagtttaaaaaaaaagtccttttccttttttaaactgaaggctgaattcagattttttttgttgtctcatctgtcagccttcctggtttaaaaacaatagtgtctatggacgcccaccagggggcagtgtaagattagccattaaatcacgaacagctgcaaatattgtgcattcaccttgtcgtggtggattcatctctgcaaacctcttcagaatgttgctgaccatcatgggagcagcaacagaagagttctgctgtctgggaatgtctgcctgctgggttgtacctgaagccatgtcataaatgattggaactataatactaacaggttcttggggagggaccgatgttttctgagttagttgaagaaaaaatagcattttggatttcagcaccacagcaggcgtcccaggaggtgcaatcggcggcgcgctgggagggatcgtcaggcaaaactgaacattccattttagctgtgttgcttggtcagggaacagctccagcttcataatgtgcacacaatccctgaggatgtgtgtaggagctcctaatagcttggtgaaggctattaacgtattagctttaaatggtggtcctgcaactcttgtttcaaagaatttctccaaaacttgaagttcatcaggtttccactgtcctgcattttcaggtgtcacttttagctgaagcgtttggttggttttgggactaagagctactctgcatttcagtgcatcagtcttaaacatgatcactccgggttcattagaatttatcagctgcagcgtttcttgttgaataattctttgaagatgtcgtctcatgatgactgatccaaggaatctctcaagtggagaacaaaggtaactacctgccaggccgggcacaaggcctggagttggagagggcagcagtaaaatgttcaaggcactgtgagtgaggatggtaggtatggatgccgcccaagagcgctgaggtagtttacgaggtggaggcatgtttgttggcattgtttgagaacttgttccagctcgaggggaatgagaagcatctggaaccggagaatgtagtgaggggttggctggtgacattccaggcatgcgtgctgctggtgaggggccagacacttgaggagatcctggccagttccctgctcgtccacttggtgacaccatagtgtatggggaactagggtcaagagttccatgtggactagcaaaactggcccctggtcctattgagattccatgcgaggatgggggaggagttggaacaaatgacgctggtgatggggctctcaaagccccactgggggagctggcagcatgcagatttcctggagactgtgtgtgcatcattgagggagactgattgactgtgctatgataagatgtagggggtgaagtaagaggataagcacctgatgttcctggctgctttggaaatggctgttgctggggtggtggctggagctgcgatattaaagaatccatcatatctcctcctataggagaagggggattatcgtcctcatttacagaccttcttcgagcatcctgattgctgtcaacaaacatattcaggaacgtctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctgtaataactgaaccacatttggtgttttgttgaacatttcttgaagctgatggagaatggtattgtgacagttactgcaacctgagtttgggccaacagttcccaaagaaatgtggaatttttgatggatcgaattccattggatactaattgagcttcccttggtggttccataacacaagataagttttcggtaattataaacacgaacttctgagaaaatatttagatgagcaggtatgtctggtagagaacgtgcaaattccaacacacactcatataatcgtgcaatgctattccagtcattaagaaacatttcaaccacctttctaccaccaacaggctcagacaacagattttcatatgtcaggtaaacgtgccgggatggtccttgctccctagtagaagtgccattaagtggacaatttgcaaacactaactctgctacccaagtgcggttatttctaccttgtaatcggaaagtgcaatcaagaagagagcggtccagagccttttgggtttcctcagttatacccttacagggaggaatttttaataagcgaattgcatggctgaagccatcaccttccacttgcactccttgatgtggaatctccagattggacaactccaaccgaagtcctacaaatggcatatttgtatcacacatagcgacgaagtgggctaaaactttattgaaggcacacatttctcctgctcgttttgttttcttggattctactggacatggatcatcagacaacttgcgcttggcattggttctggtctgtttcccggtttttgtacgaaaaaccaagtcctgaatgttttccttgaactgctgcagcagcaatgccattgcagggctgtcttcacgatctgcagcattcacagacataaagtagtacttgtacgacagttgtgtgggtttattgggaacctccaacatctccacaacaatgtagtattgtggaaggcgggtaagtttaatgaacagtttattcttagaaaggtttccaataggatgagttgagtaattggaaagctgcaatgtttcactgcttatcgtaggcagatgttttatagactgcttgcaacgctgttgtccaagccaaaacttaagttgctgaatccagggtatgattcgtttcatatcatcattcacagacttctccatgtcatccagagtggcctggtcaagtccataaagcatcaattgaaacattccagaatgtaaatctacaaaaatgtgcagacactctgaattaccacagggctccaagatgggaacaacaagagctgggagtgcagtctctatggaagagttttcattggcattgaagcctctaagaatggccttcagttcttggagcttctgatgagctcttgcatggacactgtcaatcaggagtttttctattgataagtggtcgatcttcatggctctttctactaatttggaatcagaagctggcaaaggaggatcgtgaaaaatctgtaaaggcttggagacatcattctcatcaattttaattgtaactttgtgaacagatgctgttccagtttttctcccaagaacctgttgattccaaactgaaagggagaggcactttccagcatgatacctttccacctgcacaaggtctccccaccgttctcggattaacattagagtttgggaatgtaacacttctaactgaagtgataaacagaaagaatgtaggcagttgtacatatcctgaagaggtttctcatcagcaaagagcctagactgcaccagttgatggatgaagctgatttgcatgctatgaaccaaagctcgcccatctcctgtttccttatcctcaactagaatttctagcttgagaagacgccatggaacatcagggtcatctcccatcacagtcaaggtggcttcaaattctccttcaacacgaaacttcacccggccatttgcaactgtaagatttgctaactgaggaggaagatctgtggttacaagccgatgtctaagaatctgattcagctgatggagtgtggcttgtttttcaattttggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatcgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 527409 - DNA, 246 bp, Homo sapiens
cctcacaactgcgcccggagagaagtcagctgcgctggctgctacagagttacagtggaaagtcacatgaggcttgtagcaccactgagccacaatgcaaaagtaaaaatcagctgccctggaagcctatggggactaatgattagtctcagaacagaccgagacacaaccgttctgccacaaccgggttcagggctcaaggttcgtcctctaggtcctcgctctttcctgtgtgcaaaagctgtg

SEQ ID NO: 527410 - DNA, 670 bp, Homo sapiens
  misc_feature (17)..(17): n is a, c, g, or t
tatcgattcgactcgtnccgacgagttgtccgagttataattaggaaaaaagagtgtccactgaatgcatcatgtgtaaaaatgcaattaacatttcaaaaccacattaaaagggaaaatacctaaaaagttaactcttaataaaattatttgaaacaatattatcctgcagataaaaatacatttcttgtatatacatgtagatttctacatgaaagaaaagattcagctccaaatagaaaagggctgacccttgataaagacatcttagattgccaaactgatgtgattaccactgtaagaactaaaaacagaaggataaaaagattaagttaaaggaaggataaaagtttagtcaactgctcctgaacagtggcagagttgggtgagaagtgggagatgaaggcagaaataagacaaagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggacaactcgtcggggatcctctaggtcacccagcac

SEQ ID NO: 527411 - DNA, 791 bp, Homo sapiens
attctaaggaatagcacgaatataaactaacaattttccccctttagttccagtctcatatttaaagtctcctcacgtaatgatgtctccagctatctcctcttctttctgatcaggtgtccataaacaaatactaagtttctgcagaaatatacattatcattcagaaatatgattattcacatgtcactcaaatcagcagggataagttaaagctaaaatgtaaaactatgtctatcataacattcgaaaagttattttatacaaagtaaaataaaaagtttaactcaccgcacatttttccactttgccagcattattagcccatttcactaaagctaataatcgaacgaagagttggcgtgtccggctagcaaactgcactatttctattttcctttccacatcagatttccttggcagtaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccggcaaccctcggccgattaaaccagcctcgtactagcta

SEQ ID NO: 527412 - DNA, 351 bp, Homo sapiens
  misc_feature (1)..(1): n is a, c, g, or t
  misc_feature (5)..(5): n is a, c, g, or t
ngtanctcccaggctcaagcgattctcctgtctcagcctcccaaatagctggggattacacacaccgggctcagccaatttttgtacctttactagagatggggttcaccatgcatttccaggctggtcttgaacttctgacctcagatgattcacccgccttgagctcccaaagtgctgggattacaggcatgagccactccacccagccgacatgcatattataaatgatagtcaatcaactcttggcgagaaataagtgtgcaccaggccctgttccaaatatatgtattaaattatttaatcttgatgtgtgccttatgagatacatattatcatacatatattaga

SEQ ID NO: 527413 - DNA, 1026 bp, Homo sapiens
  misc_feature (6)..(7): n is a, c, g, or t
  misc_feature (788)..(788): n is a, c, g, or t
  misc_feature (828)..(828): n is a, c, g, or t
  misc_feature (853)..(853): n is a, c, g, or t
  misc_feature (862)..(862): n is a, c, g, or t
  misc_feature (974)..(974): n is a, c, g, or t
  misc_feature (986)..(986): n is a, c, g, or t
  misc_feature (992)..(992): n is a, c, g, or t
  misc_feature (995)..(995): n is a, c, g, or t
  misc_feature (997)..(998): n is a, c, g, or t
tggatnnccgggctgcaggaattcggcacgaggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgctaaaacactgactgacaattacagcccatattacatcaaccacaggcattataccctactgcaaccacacagcatgctatanggaaggtaaaaaaaaaaaaactgagggggcccgaccaatnggctatatgagcgatacaatactgncgcgtttanacgtctgactggaaacctgcgtaccaactaatgctgagaaatcccctttgcagtgcgaataaaaaagccgaccatgcttcaacattgcaactatggaaggaattagcgtaanttgtaaatccgnaatttnaanannctttaacaagcaatggaaacttaattaa

SEQ ID NO: 527414 - DNA, 1733 bp, Homo sapiens
agctgcatgcttatcgagataccagggaagtgagagtgagataccacgatgttatggctcctgcgtatggtccctatcgtacattcagtgcgaagatctagtgcgctctattgagtccatgtaatattcccaccttgtatcatagaaatgagttgactttgcgtctagggctcaagtgggatattgggattcaggcctaatattcagagagtcgaccacgaaatagtgattgtcatggcgctagacacatcgagaggtcgttgcataacttactggtatgatccaaggccattagcctcgatcaggacgatcttgatatggattatacatcgtaaatcacatgcttgaacgagtgtctaaggaataacttggatacactaacatgtgccttgtgctgatgagtcgtttctgaatttctatcatcgtaattatgactagcagatatagctgcccagaatcctgtttgttacatgtgaatatagcgtattctacgtagatcatatcattcgaaacgcctagggaagaagaaccgcgtagcacattgtgtggatcaatggtgttacatcctacactcgaactagggtcgcgattctcaagcttgtatctctatttacttaatgtgttcgaactacacgtcatcttgaggggagtgtgaagccaatgacttcgcagcgttgggaagggcaaactttactctccatgagtagaattgttcactggggagctttttaaattaagggcagtggggggttaaaacaactttaactccaaccgtggggcccttatgagcgctaaaggtacggggaaacgttggacacacacgaattcacatttccaacccaacaaaacaaatggcaattttaacattccacgcattacggaacaggtttccttacagtctccaaaccgcaagcggggcacttattttcggctctggaaacggcttttaaccccttccctttgttttaaggcctcttaagcattacccatcttggcgatttttccttttttccaacaaatcccacagcgacacacggaccttttcggaacaacagggtaaatcccccaagaaagtagacgccctttttataccaaggtgggttgcaaacttcttttcaactaccggtacttttggcacacaccttgtcgtgcactgatcaaagtcgccggccggacttgtgctccacctctggcgcgtctaactcggcgacatgctttgacaatggcacacgcgtttcctgtgtgactatgttcaaaacaaccttgtacagaacggccatgcactgcgacaagtgcgggcacagaacgagacacactcccacacctgtgtgtgcgcacggcaggcatgatttcacgggacagaattgatttagcagttcatccagcgggctatttagtagacaaccctcgcgttcttgctgtctccaaggagtccccgggtggaccaaacattggccggcgcagcacgacggcgccgacgactcacgttgatgtgcaccatcatagtcacacacatcccatccacgcctcgatcacctgtctatcacaccgccgagcggtcagaaacaaaaacaggaggctggatcccaccctccgcgccgcctgccacgtctcgagcctgccagaatgcgtcactgaccgactcgcccagtagttccgttgatgcagacacgtcactaatctaacacatcatcaccacactcgcatcactgacgcttaggggggaggggagg

SEQ ID NO: 527415 - DNA, 744 bp, Homo sapiens
  misc_feature (548)..(548): n is a, c, g, or t
  misc_feature (554)..(554): n is a, c, g, or t
  misc_feature (556)..(556): n is a, c, g, or t
  misc_feature (628)..(628): n is a, c, g, or t
  misc_feature (686)..(686): n is a, c, g, or t
  misc_feature (694)..(694): n is a, c, g, or t
  misc_feature (701)..(701): n is a, c, g, or t
  misc_feature (710)..(710): n is a, c, g, or t
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctatacctctgcatactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaggtcaanacccantncctaaaaaatcccaaacatataactgaactcctcacacccaattggaccaatctatcaccctttttggaagncctaatgttaggaatagggaaccatggaaaccattccccctcccgggataagccctgnggtcaggnttaaaancccctggancctggccaatttaaacgggccccaatttttttcc

SEQ ID NO: 527416 - DNA, 858 bp, Homo sapiens
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaatgccccagctagatactaccgtatggtccaccataattacccccatactccttactactgattcctcatcatccaaataaaaatattaaacacaaaattagcactacctccctcatcaaagcccatacaaagtataacaattataacaaaccctgagaaccaaagtgaactgaaaatcttgtcgcttcattcatttgcccgcacaatccttaggactaaccgcgaagtactgatcattctattttccccctctatggatccccagctccaaatatctcatcaatgaaccgattaatcagcaaccaagaattgacttatcaaactaacggaaac

SEQ ID NO: 527417 - DNA, 628 bp, Homo sapiens
  misc_feature (5)..(5): n is a, c, g, or t
  misc_feature (11)..(11): n is a, c, g, or t
tagcncgaacncactctacattactatcagacaaccttagacaaaccatatacccacataaagtatatgcgatagaaattgagacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaatttgcccacagaaccctctaaatccccttgtaaatttaactgttagtccaaagaggaacagctctttggacactaggaaaaaaccttgtagagagagtaaaaaatttaacacccatagtaggcctttaaagcggcacccattagaaagcgtcaagcttaacaccactactaaaaatcccaaactttaactggattctaaaaccaaggaccaattattacctcttgagaactaagtgtggtaaggacctggaaaaattttctcgcatccgggtt

SEQ ID NO: 527418 - DNA, 769 bp, Homo sapiens
actttgtaggaagccagaagcgtctcctttgttgaacagtgccaaaatagcagctctgctttggtatcaggatgacgctggcttcataaaatgagttagggaggattccctctttttctattgattggaatagtttcagaaggaatggtaccagctcctccttgtacctctggtagaattcggctgtgaatccatcaggtcctggactttttttggttggtcttcgattagatattacttcttctgaacaatcttccttgatgacccagctactttacatctctggatggaatcctcctctttgctctaatgagtctgtggctgtgtgttgaaatagcagagccatgagatgagatccttggattactgtatggaagagagccacctagtaaagacactcaactcacattgaagtttgtatgagtgagaaaatctctgttgtggcaaagaacatataattttaagctaaatccaatcctgatttattactacaccaattaccagagagctttgcaggctcctggcatatatgccaaacacagggtaccccatggctccttgtcagtgttcacttgaggatgaactaaaatggccagtcgttgttataccatgttaaaactacaagtgcaattttgccacaaaaacaattgacattgttacctcttgcaagggaagcatcatcctgtccataacggcttgtggccaaaatcgtcgttaaagggggataaccgtgaagagccttcataggaaaggatttttaaccatctag

SEQ ID NO: 527419 - DNA, 571 bp, Homo sapiens
  misc_feature (571)..(571): n is a, c, g, or t
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctatacctctgcattgaattaactagaaataactttgcaaggagagccaaagctaagacccccgaaaccagacgagctacctaagaacagcctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagttaacacccactaccggaataaaataaaggataagctgcatcttgcggccgan

SEQ ID NO: 527420 - DNA, 350 bp, Homo sapiens
actagaggatccgtggatgttatcccaacacaatgccacgagtgccacagacaagcccaggcacagaccacagtctctgtgagctctgacataggggctggaatctcaggctcccagtgtttcagaagaggctgggtccaggcccagtgctccaccttgcagtcataaatctcatcagcagaagggaggaaggtgaggtaactgatcttgaagaaggaatgatcactcttggagaggaagctggtttcagaaacaccttctgtgactgcgtgcccattgctcagccatgtgatgttgaccacaggaggaaagatgttgtccacaagacagatgagggtgttgggcgataa

SEQ ID NO: 527421 - DNA, 886 bp, Homo sapiens
ctaaacctaggcacaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaccaagccaacgaccactatctaacaaatcgcaaacatataactgaactcctcacaccaatagggacatctaacaccctatgaaaactaaggtggatagtacatgaaacattctctcgataaccagcgtcaataaaccctgatgcaatcacgccaaattacgcaccacagcataacctaaggaccaacaggtgccacgaggtacacaaaccaccaggggcggcccacgaagagagaaccgcggaacgcaggacacggccatcgtgacccccaggaaaacgacccagccagaaagaacattcgccccatagggactgccgcccgaagagccacgtcaccgaacagcacagcagaccacgagcacgggcg

SEQ ID NO: 527422 - DNA, 941 bp, Homo sapiens
  misc_feature (5)..(5): n is a, c, g, or t
  misc_feature (11)..(11): n is a, c, g, or t
  misc_feature (518)..(518): n is a, c, g, or t
  misc_feature (768)..(768): n is a, c, g, or t
  misc_feature (777)..(777): n is a, c, g, or t
  misc_feature (889)..(889): n is a, c, g, or t
  misc_feature (901)..(901): n is a, c, g, or t
  misc_feature (907)..(907): n is a, c, g, or t
  misc_feature (910)..(910): n is a, c, g, or t
  misc_feature (912)..(913): n is a, c, g, or t
tagcncgaacncactctacattactatcagacaaccttagacaaaccatatacccacataaagtatatgcgatagaaattgagacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagtctatgtagcaaaatagtgggaagatttataggtagaggcgacaaacctaccgagcctggtgatagctggttgtccaagatagaatcttagttcaactttaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaanacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaacgatacaatactgncgcgtttanacgtctgactggaaacctgcgtaccaactaatgctgagaaatcccctttgcagtgcgaataaaaaagccgaccatgcttcaacattgcaactatggaaggaattagcgtaanttgtaaatccgnaatttnaanannctttaacaagcaatggaaacttaattaa

SEQ ID NO: 527423 - DNA, 405 bp, Homo sapiens
  misc_feature (51)..(51): n is a, c, g, or t
  misc_feature (308)..(308): n is a, c, g, or t
acccactatagctactccagcctgggcaataagagctagactctgtctcanatacaaaaacaaaaaaaaaaggataaaaagtttttcccacccttcccaggttgcctctgcacgggggcaattccttcattgtccggcaggttgtccaaggttataacctcagccttaatttctcgttccaatgaagcctaaggatgacccaaaggttgaaagtttgagggcctcctcaggtgtgtttctgagccccttttctagccccaggggtgtgtgcttggggcttcgtggattcccacagcatgaacaggagncttcccaacagccctttagaaccttcattgtagcctctttccccacgcctcttccttcctaggacttatctgttcagctcttatggcccaggctgaa

SEQ ID NO: 527424 - DNA, 130 bp, Homo sapiens
tagaatcgagccggtaccgtaggtctcgatcgttatttcttcaagtataacaccatctacgggactaaaagatgtccaagagaatagtgtgcaactatgtaaattcctttttttttctttttttttggag

SEQ ID NO: 527425 - DNA, 190 bp, Homo sapiens
gactattaaggagcagaaggcaagcagaagtaagccgcgggcgtctttgattgtgtagtaagggtggacggtgattttatcggaacgggatctagacaaccccctaggtaatcacgcatcccattccgcataaaatccacctttccaaccatttacttacaccaatcgaagcaccggggattccttctta

SEQ ID NO: 527426 - DNA, 147 bp, Homo sapiens
tagattctttccattttttataattagaagcacagaggaaaaggggcaaaatgattaaagaaatttatgttttttaacagggggttggctttacccccaccgaaaaaggaacaacccgggtggaaaaacgcttttgaccctctcact

SEQ ID NO: 527427 - DNA, 1182 bp, Homo sapiens
aaaagcttctagtctccataacccccaaagtactgcttatttgtttgaagaatccagccatcgtagtgctttcaggtcactatcgtcaaacattccatgcatagggcaaggcattttaacacaccacggcattcttgccttctgtagtcatcacaggtgcaacagcaagcatccgtacacgaacccactcacagaggcatctatgatttggtagtccatgccgtcgttacaaagcaccaaggaagttgcaacgatgctatccagatgcattatgtctccggtaatgaccttcttccgttatatttggacactattcctcttacatttcatggtagccgtgtcaaagtatctttgacattatgatcaaaagcttcgcaaactactacgagacacaagccacaatatactggctggctgacctggagccttctgcaacgacttagccagtagtccagaacagcccttatgcgctctactgatatgtagataacacctatacaggcccatgttagccatttatccacgagaacagaagagacttattactcactttacagcgggcgaccatcacaaggcgtacagccatcccatcattggggccttatttctagacacaagaccaaacatatacagagatagagtagttacaaaaacgtggtcagccattatcaagttataaccccttcaaacgcggagaaagccccgtggccacttcattcaagcagctattctcagttacaaaagcatatacggaatgtgccaaagacgccgtatacgcccttggaaccggctatgatatcctatagcctggctggttaacagttaccacgctatacaagcgtccatggtcacctatatcgatataaattgaggaaattggaaacatcgcaccctatgctggcgaggcggtacacttgccacggcttgtggtccacatatccccacattgggtgccagaaaaggcaaccatatctatccaccattgccaaattttactgccgtacgcagcgagagaacacacagggcaacactgacaacaaggcattgcaaatatggcgaaccaagattatttaccccatcaaagcattataaccagtacgtcatgtacacactgacatctagaaaggtatcccaccacccagtattgttggtttacccccaaaaccaatttcgcgcatttaa

SEQ ID NO: 527428 - DNA, 550 bp, Homo sapiens
  misc_feature (34)..(34): n is a, c, g, or t
atttaccgaacagttagttttgcaggtcgaagangcccgctgtcgacgctcgcgataggaacagcgcgatcttgcgaactcttgaacactccgccagcgtaaggcgctgcgccgggccgggtagcggccagttgcgcggcgacaatgtcatccttgcctttgctgtccaggtcaagatcatatttggtatagacgtatttgagcttcggcgtaataaagccatagctccagttcattgggtactcgacagcgggagcttacgttcaagcgtgttccgtttgcacgggtcaggccgtttacgtaggtgtccaggcgtcgttcacctatagtgccatcaggattgaacggcccgccgtcttcgttaaccacattaccgtttcgaaggtctcggtcagatcttacggcttcagtctcgtaggagaagttgagcccccccggatggtacggcaactgaccattgaaggtgatctgcggcaaacggtcatacggagtgatctgcgaaatcgtcgccagttgatatgactgcaggtccggatcccatttgcggggg

SEQ ID NO: 527429 - DNA, 743 bp, Homo sapiens
  misc_feature (632)..(632): n is a, c, g, or t
agccgttccagcacggtgcttgtgtttgtgaaacagagaaaggggacccccgaggaccccagacaggcccttacgactctcatatcttacttgtttttctccatctggtggctctttgcgtctctggtttgcttctaccttttcatggccccagaatccatattgcaagttaagaggaactcttcctgggagatacatatttaaagtcctccgtaattcaagaacagataggaataaaagaataaatacacacagacatcctgaaatagcaccaaagaatagagggtgcgtgcgccgagctgctcagagagatccctcagcgggggcctccagcctctagagctcccccctgttctctcgaccagggggcgccccgcccacatcgcgaggtgaccccttctgtttcagagaaagcccacatggtcgcagggggacccgttgctatgtcaaaaaaccttctacagggcaagggcgcgaaaagaaagccccgagtactggcttcgcgtggccttgcttggcgcgtcacaagagagtaaccactgtattgttccatgggggcgcctggggggaccacccagaattgggggcactcttttgccacccaaaagcgttagaactccttgagagacccnttcccttgacataggggacacatacgtgttgacctaccattaatgtctatcacatacagcgcgttgtgtaaggaaagtgtcgtcgctattccccaaggacattcgtctggt

SEQ ID NO: 527430 - DNA, 435 bp, Homo sapiens
tatgacattctctataacacactagggctttacagatttgagagagtggtaattctctatgacatttgtacagaaagaagagccaggatattctttgttttcctaagcgtagctgtgagcaacattatctctcctactggcttctttgaggtatgagagtcatcattacatcctggtgctttgtcaagttatatgtcacaattccacctgtgggtagagaacaagcacaagagtcacatcaactgtgtgctgggccagggttatgtcacaatcttccctgagagcatgcaccaggcagaagagtcacatcacagggttctcaaccagagatgttacaatcctctcctgaaagcaggacacaggaaaaagagtaagatcacctgcatgctgggctcagatatatgtcacaagaatcactgtggggcggggatcctc

SEQ ID NO: 527431 - DNA, 449 bp, Homo sapiens
  misc_feature (5)..(5): n is a, c, g, or t
  misc_feature (77)..(77): n is a, c, g, or t
  misc_feature (90)..(90): n is a, c, g, or t
  misc_feature (125)..(125): n is a, c, g, or t
  misc_feature (138)..(138): n is a, c, g, or t
  misc_feature (144)..(144): n is a, c, g, or t
  misc_feature (156)..(156): n is a, c, g, or t
  misc_feature (166)..(166): n is a, c, g, or t
  misc_feature (168)..(168): n is a, c, g, or t
  misc_feature (202)..(202): n is a, c, g, or t
  misc_feature (213)..(213): n is a, c, g, or t
  misc_feature (239)..(242): n is a, c, g, or t
  misc_feature (249)..(250): n is a, c, g, or t
  misc_feature (256)..(256): n is a, c, g, or t
  misc_feature (260)..(261): n is a, c, g, or t
  misc_feature (271)..(271): n is a, c, g, or t
  misc_feature (274)..(274): n is a, c, g, or t
  misc_feature (291)..(291): n is a, c, g, or t
  misc_feature (306)..(306): n is a, c, g, or t
  misc_feature (319)..(319): n is a, c, g, or t
  misc_feature (354)..(354): n is a, c, g, or t
  misc_feature (409)..(409): n is a, c, g, or t
ctggnctgggccagcgctaacaggtgagcccaggagtcttttgaacccactctctcttgcctagaatagagacaggncaggctttatgtnccccattcctccctcccaactccagggacattganagggtcctttgtncccgcncgctggatattngggggctggntnggagggatctgatattttatgtttggtatctatnttttatacttngtgtggggggggtggcaggaagattnnnncccaganngctttntttnntcctaccccnccnaatatggggggggatgncgtccctctcccctnttgataagccccnttttttttttgttttttttttttttttgtgttttnggggggggacagggagagtggagtgctggttggaggggccccccagatcggggantcaccccccaaatttactctcttttgggtggattttggtt

SEQ ID NO: 527432 - DNA, 227 bp, Homo sapiens
gacacacagtactcctatatacttagagaggtgtcatattctgcatattaagcgtttgatctgtgaaattaatttatggataattcagttctactttttatttcctttgctgcccctaccgggccttctcaataacttacaataacatattgttttaagcagttacttatgatcatattcccgagacttttctgcaatttgacgatgacttccactcacaggaagac

SEQ ID NO: 527433 - DNA, 154 bp, Homo sapiens
caggcagtatcctaaatgtaattttagtgcatacatgcattatgtaaaacaacaacaacaccacacaacaaaaacacaaagaggctagagatatcaccgtttctacccccaaaataacgcttgctatccagactttggagggggatgggggaac

SEQ ID NO: 527434 - DNA, 1050 bp, Homo sapiens
agaaatagaaacctggcgcaatagatatagtaccgcaagggaaagatgaaaaattataacgcaagcataatatagcaaggactaacctccgtataccttctgcataactgaagttaactagaaagtaatctttgcagggagagccaaggctaagagccccgaataccagacgagctaccttaagaacagctaataaaagcacacccgtctatgtagcaaaatagtgggaagatttataggtagaggcgacaaacctaccgagcctgggtgatgagctcggttgtccaagatagaatcttagtgtacaactttagaatttgcccacagaactcctctgagagatcgcccttgtgaaatttaactgttagtccaaagaggaacagctcttaggacactaggaaataaaccttgtagagagagtaaaaaacttaacagccatagtaggcctaaaagcaggcaccaattaagaaagcgttcaagctcaacagccagtagctaagaagatcccaaacatagtaactgaactccgtcagatgccaatgggaccagtctatcacccgatagaagaactaatgtgagtataagtaacatgagagacattctcctccgcataagcctgggtcagattaaggaccactgaactggacaattaacaggccaagtatctacaatcaaacaaacaaagaaacacggcaccaccgacgttacggcccattaaggaacattgacggaacagcatccacggaacacacagacaaagaggcaccggacaacaaggaaccgggaacacggcgacaagagaagacgaagaaagaccgggcgcaacgaaaacacggacacataagacacaacgacagggacacagaccagcagcaaacacaaaccagcacaaccaagagaacaggaaagaaaacaaaccaggacaaaagactcaccgaccaaaccagagcaaccacagaaaaacaacaacacagagcacagacgaatcacaaacaacgcagcatagaaccacacacaccaaaaaacgcagcagagacataccacgaagac

SEQ ID NO: 527435 - DNA, 401 bp, Homo sapiens
gacgctgaagcaggataatcggctagaacccatgaggacagagcgttgcaatcgacgctgagattgccactgaactcaagcctgtatgacaagagcgcagggctgagactcatcacaaacaaatcaaacaataaatgcactatagattatttaaatgtaagcctgtctcctatcgtcgaagcctaatccctttcaggctgcttgcatgttccactgatctttatattccctgcgttccacaccttgtcatagagggagctcaagtatttgtctcctggtcttgttaaattagaatgctttgacccctgggggcctttcctgtgagcttatttgtgctttgcttgtccaaggaatgtggttgagagtttgtcctagtgtaaattagggctctctttctgacg

SEQ ID NO: 527436 - DNA, 713 bp, Homo sapiens
atgtaaaaatacatatatttctaactatttttctttatagtatctcaattttgtcccatttaagaagccctttagcatcaaagttttgtattagtatttttatatttattttaacttatttttaattttttttacaacttaatccttgaatgacatggggataatgtaggcttgcatcttttttttacaatcaactatatttaatgatttgttaagaaaaaaatatgatttctgagtgaatatatctcatcttaagactttattttcccaccaaaatgttgcactggaggccttgttagcatccctttctcacttggaatggcaaaatagtgtgtagagactcacactgcaaacttttttctaagaagcaacacaggaacttaacagcaaaacagaaagaaatcacaagtcctttgaaataagtgacagcctgcagcccacatggtgagccaggtggaaaactctaaatcctcagagtgtgagagggaaagaagactggcctttcaggatgtacttctctccactggagagcgtggcaatccaggccaggggaaaggcttaactgtacccatttctggaagatttatttagtgagcggtggggagtaaaatcaccaaggagtggtatgaaagtccatgcctttgtgtgtatctcccagaaccgtattaaggacagacgggaagccatttctcatcctaccttcttaagtgact

SEQ ID NO: 527437 - DNA, 205 bp, Homo sapiens
ctctagaggacgcgtaatcagagtcgacatgctcatatgggagcttggttgctggtggcaccatcagttccagcctaccatcgatatgcatgccatatccttctctaagagagaaatttcctttccttgaagctgagctgggcttgctgatctgcagttggtgcaagtgatgtcctctggatttatgatggctgtcgtaaggaag

SEQ ID NO: 527438 - DNA, 410 bp, Homo sapiens
agaggaaagagctgtgagcatgaatactgattgcctgccctttgataaacggcacgagacaggtatgccctttatcaccacttctattcaacatagtgttggaagttctggccaggtcaatcaggcaggagaaggaaataaagggtattcaattacgaaaagaggaaatcaaattgtccctgtttgcagatgacatgattgtacatctagaaaaccccattgtctcagcccaaaatctccttaagctgatagacaatttcagcaaagtctcaggatacaaaatcaatgtgcaaaaatcacaagcattcttatacaccaataacagacaaacagagagccaaatcatgagtgaactcccattcacaattgcttcagagagaataaaatacctaggaatacaactttacagg

SEQ ID NO: 527439 - DNA, 1155 bp, Homo sapiens
aggcggtattggtataatacgcctcacactcattctcaacccccgtgacaaaacacgatagcctaacccttccttgttactatcccttatgaggcataattcataaggaaaaaaaacaaaagcacagaaaagaagagagcaaagacacacattttggggggaggacatgggcaccatagacaacaagaattctccaaaaaacacaaacacggtgacgagcgcagcacggggagcacaacaaagaatggtacaggcgacacacaggagcacacaacaacagcgtgtgaaaacacaagagcagaacaccatacgggacccaagcgacaacacacagcgagcatgcggacatcacaacaacaccacacagaaaacaaaaaaccgagcgaagagggagaaaaaaccaacaggacgataccaaagacaaacaaacaatcaccacacgaccctagaggagaaaagagaagagacacaaacaagaggggagaacaacaaacgacaaccaaggagaaaggacacaaaaacaaagaacaaaaaaaacacaagaaaaaaaaagacaccgaccaccagtgggaacaacaaaacaacaaaacaaaacgaaaaaaaaaaaaaagagaaaaaagagagacaaggaaaaacgcacacacacagaaacgaagaagaacaagccaaaccacaacaaacagaagacaaacaaacaaaagaaacaaacagtacacaaaaaagaagaaaaaaaaaaagccaaagagaaaaaaaaaaaaaaagaaagaaacaagcagaaaaaaaaacgaaaggaaacaaagaaaaacaaaagaacaaaaaacaaccaaaaaagaaaaagaaacaagaagcagacagggagaaaaaagcaaaaaaaagaaagacgaagagaccggagagagacgaaacagagaaggcaggaacagaaagcagaaggcgaacgcaaagggcgagggggcaagaagggacgagacgggagagagggccgcgagcaaagagaaggacaagaaagagaaaggacaagcaagataggacagagaaagcaacgaagagagcacaaacagagcgaaaaccgaagagagggacgagcggcgggcaaaggaggggggagagaaaagagaagaaaggagaagaagagaaagcagccaacaggaacga

SEQ ID NO: 527440 - DNA, 169 bp, Homo sapiens
tccagtgacatcacagaagtgtcacaacaagattaactattagatcagtctcaaacattatagacagatattcccgaatcatttttagcttgtcttctcctcccttgtcctcctcttaccactgtttgctgaatgccacaaggtcctggctccagccacattctatgct

SEQ ID NO: 527441 - DNA, 133 bp, Homo sapiens
ccccgcgcggagcacgcgcgcggagcgggctgcgcgccgcgctcgcacacctcccacaccgcgcgtggtggcgcaccgcgcgcgcggagcactccctctctcacacacacagacaaatagacaagacaaacac

SEQ ID NO: 527442 - DNA, 966 bp, Homo sapiens
  misc_feature (7)..(7): n is a, c, g, or t
  misc_feature (64)..(64): n is a, c, g, or t
  misc_feature (69)..(69): n is a, c, g, or t
  misc_feature (95)..(95): n is a, c, g, or t
  misc_feature (98)..(98): n is a, c, g, or t
  misc_feature (151)..(151): n is a, c, g, or t
  misc_feature (158)..(159): n is a, c, g, or t
  misc_feature (163)..(163): n is a, c, g, or t
  misc_feature (168)..(168): n is a, c, g, or t
  misc_feature (195)..(195): n is a, c, g, or t
  misc_feature (199)..(199): n is a, c, g, or t
  misc_feature (204)..(204): n is a, c, g, or t
  misc_feature (213)..(213): n is a, c, g, or t
  misc_feature (218)..(218): n is a, c, g, or t
  misc_feature (238)..(238): n is a, c, g, or t
  misc_feature (244)..(244): n is a, c, g, or t
  misc_feature (250)..(250): n is a, c, g, or t
  misc_feature (261)..(261): n is a, c, g, or t
  misc_feature (287)..(287): n is a, c, g, or t
  misc_feature (312)..(312): n is a, c, g, or t
  misc_feature (314)..(314): n is a, c, g, or t
  misc_feature (334)..(334): n is a, c, g, or t
  misc_feature (347)..(347): n is a, c, g, or t
  misc_feature (359)..(359): n is a, c, g, or t
  misc_feature (369)..(369): n is a, c, g, or t
  misc_feature (389)..(389): n is a, c, g, or t
  misc_feature (414)..(414): n is a, c, g, or t
  misc_feature (424)..(424): n is a, c, g, or t
  misc_feature (462)..(462): n is a, c, g, or t
  misc_feature (474)..(474): n is a, c, g, or t
  misc_feature (504)..(504): n is a, c, g, or t
  misc_feature (506)..(506): n is a, c, g, or t
  misc_feature (519)..(519): n is a, c, g, or t
  misc_feature (569)..(569): n is a, c, g, or t
  misc_feature (579)..(579): n is a, c, g, or t
  misc_feature (885)..(886): n is a, c, g, or t
  misc_feature (962)..(962): n is a, c, g, or t
cccagcngcccttgtggcccgccccccttaccttgcccatggccagacccaggtgctgcctccnacgtngtcatcagtcagaggccctcctattntcnccgggccctgcgcctcctggcgtggcaagagccttcgcggttccgaagatccngccttcnntccngggcngccccctccttcccgttgaatattccntccngatcnctgtcagcnttccnggctcccagacggtcctccntgaccngccccnggtaattggcngccgatccggtctcagccgccgaccntcccgcctggcccgccgaacccgcncngagatgagttgggtagatcngaacctccctganacccccgacgcncctccctgcnatatggatgtcattcctgangatccccgattggcgagcccccccnctcctctgcnagatgacatggatggctctcaagacagccctatctttntgtctgcccctnagttccagttcctgccccccccgccttatncngaggtggatcccngcctcctcaacaacaatgtgcagtgagcctgtggcagacaagaagccgcnttacctcacntgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaannttttcaaggttttttggaggctttttgttaattgtgataggaactttgggaccttgaacttacgtttcatggtggngaga

SEQ ID NO: 527443 - DNA, 508 bp, Homo sapiens
  misc_feature (5)..(5): n is a, c, g, or t
  misc_feature (155)..(155): n is a, c, g, or t
ggctnacgggctgagtaaccttcttggaaagactgtcctttccaacctctatcccaatttattattaaattaacaggcaagcggcccgccttttccctgggtctcgggagagccttctactgccccccttacctacgtttccatcttcacccctnctgcgtgtcccacccatcctgtatccactaacttgagttctcatgttgctgctccatctccaagccgcctcatcttcccgagcccctgccacgcatcgaagggttttggggaaagctctgggtttagggatctccgtccctcagctcccctgacccttgcccacctcttcctcagagccccactgcaggtgccatggtcctataagggctgtggagaaagtggactagttccaattctttgtcccttcccccacccatcacagaaacactttcctttacccttctctgcctttataaaaactaatgatttgtgcaacttgtaactaggtgtttatggaataaaggagaatgga

SEQ ID NO: 527444 - DNA, 443 bp, Homo sapiens
tggaaatggagtctggcttggccacccaggcaaaaaagcaggggcgctgcaattccagctcacggcagcctccgcttcttaggtccaagcaatcctctcgcctcagtctccgaattagctggaactacgggtgtttgccatcatgccgggctgacctttggttttttaagatagagatggggtccaccatgtcgaccaggcgggttctgaactccgtgacctcaggtgatccgctgtgcctaggcctcccaaagtgctaggataacgggcgtgagcataccgaaccatagccgaggtttgtgattctcaccttcacacaaaaaaaaagaccaatttgcctccagggctttggtcccatttatcggcccaccagcatggtgtgaggggcttggggggcccactttctgtcaacattgaaagccatcaggtctcctcatggcaac

SEQ ID NO: 527445 - DNA, 353 bp, Homo sapiens
gcggctgaggtgatctgttgatgtcctgttatgctcgtattttcaggacatcatagaatcgaccattctacacagacaacaagcaatggttactacatcattgaattaatctcgccttccaaaaacttgactggttctattgtaagaaggtggacaacaagaaagtgcattaggatctttcaatgctcgtacaatacacctgtgggcatcttctcgagcctgggaagcattgtcctctgtgtaacttccgagcaattccaccatgacttttgaagcagcatcactcttcttacaatccacaagtgcctcataaagtagtcttaaaagggtgtgctttttttcagtggtgagat

SEQ ID NO: 527446 - DNA, 648 bp, Homo sapiens
  misc_feature (514)..(514): n is a, c, g, or t
  misc_feature (525)..(526): n is a, c, g, or t
  misc_feature (529)..(529): n is a, c, g, or t
agcggatgcaattgtagttatactcagtaatatagttacacttgattaaagccattataaaggaaatgtaatcccatactgattatcttcacatttctttggttaaagatcagtctgtttcattgagataacagttcaggagaaaagttattgactacatgtatctatagtattgtctaagcaacaggagtttagtttgcatgttttttatttttgagagtacatcaacgtaatgaaatgtatttaaaattgtacccatatatacataatgatatatatatatatttatgttttacagcagtgtttttccttggagatgattcaatcaaattgcagaagagacacttctaattaattattgggaagtacaagctaggattatgttttcctgaacgtttgtgactagcagtgatctcttacagacgtgggggtctggacacttggaccttaaattggaaatggttaaaaaattgttatccaaagaatgacaatggtttgtttgccaagtcttttngtttgtgtgtnngtnttttgagacggaatctgtcacccagacttgagtgcagtggcgtgatctcggctcactctaacgtccacctcctgggttcaagcaattctccagcctcaacctcctgagtagctgggata

SEQ ID NO: 527447 - DNA, 219 bp, Homo sapiens
attaggagactgctccacgattcatgacaggcagcatctgagaaaggaggcttatgatcccagagttcacattcctgcaaaccaagtaacatatatgtcaagattgcggttccggttgttcacgctagaatgcaggtcactgcgatctagacgggggcgctgccgaagccacgtaccaagtcacgccgtgtatgctgagcctcctgcctttcggcccgc

SEQ ID NO: 527448 - DNA, 192 bp, Homo sapiens
ggatcttatggacatcaggacaatgggccaggaagggttgtgcaaaggcaggaccctgtgcctgctttatgcttctgtcaaaatgctggacttctgagaagggaactaggaacaggtgacatatacaacatgcggtggtcacagctttagaccccccgtgcaaaaaataatgtcatagcttgtataccttga

SEQ ID NO: 527449 - DNA, 345 bp, Homo sapiens
  misc_feature (218)..(218): n is a, c, g, or t
gtccctgccccacagcggcgtcactcttttcatcgcctactgatgttgcgcagctccacggtggtgccaccgagatcgaactggcggctgtcgaaatccgcacgctgcagacgcgcctggagttgcgcgtcaccgcgcattgcaataccggcgacgctcagccgggcaccggtgccccgcagatcggcactgcccttgccgacccgcccggaggcatncagtgagacatccccactgagcaggccgatcccgccgagcaggcgcacgttgtcattgccgaggtaacggttgtaggcggtcaggtccggtacccgtgcatcggtgaagcggagctgggcccgcatg

SEQ ID NO: 527450 - DNA, 284 bp, Homo sapiens
ggtcgactgaattcctcgccaccccagcggcaaataatttccgactggcgcaggcaactctccaggtctcgggcaaatccgctcagtacggcatcgcggcataggtggccgtgggtatcgttgagttgcttgaagtgatccatatccagcagcagcgcggtcagtggcttgggttcgcgttgggcttcatgcagagcctggaccgccagcaggtcgaagccccggcggttgggcaggccggtgaggatgtcgagggttgccagggcctggatcttgcgtcgacg

SEQ ID NO: 527451 - DNA, 1252 bp, Homo sapiens
agagcggcggggcataggggtaaaactataatagaaaataatacctacatagctagaataagtaaataataactactataacctagtaaaagtaaaaataatagatacaataaccatagtatatatgtataagtaacagggatatataataataatatattagaataataaataggtgtattagttacttaattatttatagaactatattgtagagtgctatatttatttaggtttggtgttaattatgtttagtaggatatcttattatttctattatattaaccaaaggtaagcctagaactagcataaagatacacctatgaatagtaaaggtatatcataaagaaactaataactaaaattctatatttactatcataattgtgttactattaatttataatttatagttcgttatttattatttatatttttatttgggttaataatatttgtagtatgttatttgtgttttgttttttatagattaatatttttctatttctgtgttgtgtttatattttgttcttaggtaggtgtaggtgtggtgggtagtgtggtttaggttgcgggggtgtgagaggtggtggtagtggaggcgtgtgggataagcgcgaacccaaaaaagtgacgattcataaaatacagagtgaatgtcgaaaaataaataaaataacaagagagggaggatggtgggaggggtgtgtgtgttgtttgttgtagttggttatttttatgttgtttttttttgtttatattgaatcgataagcgatttgtaagactgattaggtcagtaataaatttatttagtaataatttatttgatattattatttatttttgttatatttatctttagtacaattcatttattttctacatattatattttataattgttttttcttgttgtttaatttttgttgttgttgtatgtattgtttgaattcctgttgttttgttattttgtttgttttcttgtgtttattgtatgtttggtatttcgtttgtgtattggttgtgttgtactttgttttttcttggtatgtttggtacagtatgttgagagggtatttttcgtatggttgacttctgtgtttttttgtgtagttggatgtcgctcgggtagaatggtttttttgatagtgtgggtgttttttgtgtggtttttgtttggttatatggttttttgggtgttttttttgtttgtttgtgtggttgtttgtgtttgtttgttttctgttgtgt

SEQ ID NO: 527452 - DNA, 251 bp, Homo sapiens
tagggtgggtccaaagacgatatccaaggtactctgcattcataagattctccttttcgtggagggtcactctctttagatgtgccatgaggtaccggagagtaccgcagtgagcaggtggcagtagtttcagtgcttcatgaagggttccaattgctcatccggatccataatttgggcagattctataaacttagggtaggcatcatatgtaatggaggtgggaatgggcaaatccctggaagtatgag

SEQ ID NO: 527453 - DNA, 307 bp, Homo sapiens
  misc_feature (67)..(67): n is a, c, g, or t
  misc_feature (121)..(121): n is a, c, g, or t
  misc_feature (139)..(139): n is a, c, g, or t
  misc_feature (201)..(201): n is a, c, g, or t
  misc_feature (292)..(292): n is a, c, g, or t
cacatattgccaggtgcagtggctcacacctgcaatctcagcactttgggaggctgtggtgggaggnttgcttgaggccaggaattcaagacccacctggacaacatagtgagaccctgtntcaaaaaaaaaaaaaaanttagctgagtatggtggcatgcacatgtagtgctagctacttgggaggctgaggtgggaggnttgcttgagcccacaagttcgaggctgcaatgagtcatgatgatgtcactgcactgcagctttggacaacaaagcaagaccaaatcaaaancaaaaaacccaatta

SEQ ID NO: 527454 - DNA, 545 bp, Homo sapiens
  misc_feature (341)..(341): n is a, c, g, or t
  misc_feature (487)..(487): n is a, c, g, or t
  misc_feature (528)..(528): n is a, c, g, or t
  misc_feature (541)..(541): n is a, c, g, or t
tgatgagaacccctccctttgcaaggtgtgagatctttgagagcagagggtgtgagcctgtagcccaggagacctgcaccggtgcatgtgagacacatagagcagtgagtgagtgagagagagagaaaggaaggaaagaaggaaggagaaaggaaggaaagaaggaagagataaagatctgaatgtttaaatgtccactcaaaagggagcaagttaataaacttgtggtgtgatcatacaagggaatattacacaacagtcaaaaatgagttaattagccctacatatatactcatgatgctatttatatcgtgatatagctccgtgatgccaagttttanaacatgcaaaactttgtgtatttatttatgcatgtgctcttgtctcccatggaagcagctgacctttgttgaggaccctctgttccagacgccgtgttatgaattaggccattcagttcctttgacaaccctgtgagcattgagcncaactgatggctcaattttccaaaatgagatggcttaggcncaggaagggttanggtg

SEQ ID NO: 527455 - DNA, 154 bp, Homo sapiens
gctagatggagcgggccatggacagccgctctgtcacccacaaaagatcatcttccacatggcggaggtactggagctgctcgcgagaagcactgcaggctccggcagcgataccgcatggtctgacacaaggccctgaactactgctccacgg

SEQ ID NO: 527456 - DNA, 335 bp, Homo sapiens
catccggggtcgtatgtcagactaccacttactaccttggtgaccagggagggctcagtcagctaacttctctttaccttctttccggaaaggagaataagggcctggagaggaagccacatcttaactaactttaaagcctcggtaatttacttctggacccttattctctccattcatactattttctccatcatatggttaaatccaggggagtttttcggaaagggaacttctcagttcctctaacacttacgggtatatatgaggggacactcaagccctacagaggtaaacggatggacccaggatgtggacggacccaggatgtggga

SEQ ID NO: 527457 - DNA, 415 bp, Homo sapiens
  misc_feature (22)..(22): n is a, c, g, or t
  misc_feature (337)..(337): n is a, c, g, or t
caaacctggccttttttagttngggagtgaccctaaaataaaccttgatgtccatataaatatatttatttgtcaagttaggaccaagttatgatttggtttccttgcatccctgatttttaagattaaaatgaaaaaaggtgcccgggccatggtggcctcatgtctgtaatcccagcactttgggaggctgaggcgggtgataacctgaggttggggacccagcctgacccaacgtggagaaatcctgtctctactaaaaatacaaaattggctgggcacggtggcgcatgctctcccggctactcgagaggctgaggaaggagaattgcttggncctgggaggcagaggttgcggtgagccgagattgcgccattgcactccagcctgggcaacaaaagcgaaatccgtctc

SEQ ID NO: 527458 - DNA, 240 bp, Homo sapiens
cttaaacattcttcatatgtgatgtcctaagtcactaaagttaaaactttcccacccagaaaggccacttagataaaatcttagagttatttcatactcttcttagtcctcttccaagctcactttgaagtctcactggggttgataaggaatttctcttgctttctcaataaatctctatttcactcatgtttaatttgtaggatagaattgcgggaaataaaagttcttgttcccttt

SEQ ID NO: 527459 - DNA, 221 bp, Homo sapiens
ggcctgttgagcctgctgagagaagaatattagaagttcattatgctcggctgggcgcgttggctcacgcctgtaactccagcacttcgggaggccgaggcgggtggatcacgaggtcaggagatggacaccattctggctaacatggtgaaaccctgtctctactaaaactacaaaaaaaattagacagacatggtggcacgtgcctgtaatcccagcta

SEQ ID NO: 527460 - DNA, 646 bp, Homo sapiens
gagaaatttccaggtcataggacttctctttaaagtaaaataattaggccaggcacggtggcttattcccgtaatctcagcactttgggaggccaaggcaggtggatcacttgaggtcaggagtttgagaccagcatggccaacatggtgaaaccccgtctctacaaaaatactaaaataaggccaagaagggtggctcatgcccataatcccagcattttgggaggccaaggcgggcagatcacttgaagtcaggagtttgagaccagcatggccaacatgatgaaaccccgtctctactaaaaatataaaaattagctgggcatggtggtgggcacctgtaatcccaactactctggaggctgaggcaggagaatcacttgaacctaggaggcagaggttgcagtgagccaagattgcgtcactgcattccagcctgggcaacaagagcaagactccatctaaaaataaaataaatacaaaaattagcaggatgtggtggtgtgttcctgtagtctcagctactcaggaggctgaggcagaagaatcacttgaacccaggaggtggagattgcagttaactgagatagggccactgcattccagcctggatgacagagtgagactccatcttaaaaaaaaaaaa

SEQ ID NO: 527461 - DNA, 239 bp, Homo sapiens
tcgactatgaacgtatttctcttcctcatgatttcctagtagcactttccttcctctagcccactttactgtaagaatgcaccaccacgccaggctaattttttttgcatttttagtagagacagggtttctccatgttggtcaggctggcctcaaactcccgacctcaggtaatctgcctgcctcggcctcccaaagtgctgagattacaggcataagccagtacaacctgccggtgg

SEQ ID NO: 527462 - DNA, 436 bp, Homo sapiens
  misc_feature (206)..(206): n is a, c, g, or t
ttcaggttgattccccccacctgacgttggtgtggggcccacgttggcatatactgtggccatggagagatcatccactttgagggcaagaactcaggaggctgtgggctcctgggaagtttctgggctcctggaaaggcatcgtatccaaacaggggcagcgcccgctgctgcgctcctgctggcgcgtgctgcgcagagtgagngaagcgacggacgcggaccaccatcctatcactccatgcgcagcaactgtgtgcactttgcactgtgtctgctcgtcccaggtcccagcctggacccccggcaaatagacgggagctccagcaggtgtaatggacgtggacgtgtccccggattaagcatgaccttggccctcctgggtggacgtggaggcttcagaaagattcattaaactactttccaaagcttaaaa

SEQ ID NO: 527463 - DNA, 854 bp, Homo sapiens
gggtgacctctttttcccgggtcccctctattggccgccttgtgtaccccgatccggggcccgcccccgctgctggggcaccaagaagagttctgcacccgttatggtttcttataagcgggcgcgctgctgttggtttatccgccggctctgcatgaggttggtcgctccacgcccgcgtgcttatcggcgatgcggtgctccccctctccgttgagaagtcgccctttatggagcgcgacttgtgtagccgcgcgtccgtatgttccgtgtctcgcctacgccgaagcttagtataaccgccccatctcaaatattctgttcgcacaccatccatcccagaaagccctctgtcgggcggatcaaccccctttctggggggccctcaggcccccccgctaatgcgtcttcccccgcgggcgacgtgcactttgctcgaactgtcttccgccgcgcggattgcaactgccgcccagttgttagtgtcggcctctcgtccgatacgcccacgtatggccgactgcgcctcatccaccgcattgccctgcactaaggtgcacccgctctcccaaggagatgtttctaggttctagtcgtccccctcacatcaggcgttttgagagtgtttgtacaaacgtcctgataccattgccctaccttccccctccatgtttacccccggcgaggtactacttgcttgtctgcgatgccccgccttctcccatgggcccaatatcacgtcctcactcaactccgccggcgctccaccacaatattctttcccccccccaaatactcccctgtaaaaactatttcaccaccacacacccacatgggggcgccccatcaatgac

SEQ ID NO: 527464 - DNA, 323 bp, Homo sapiens
tggcacagttcctgagtagctgggattacaggtgcgtgacacacgcccggctaatttttgtatttttacgtagagatgttgtttctccatgttggacaggtttgtctcaaaactcctgagctcaagtgatccacctgcctcggctcccgaagtactgggattatacgcatgagccaccgtgcccagacgtcattcttatattattatttcctaggtgtctctcctgaagactatcttctggtctcgaaatggacatgatggatccacggatgtacagcagagagcctggaggtccaaccgccgctagtcaggacgctggtcga

SEQ ID NO: 527465 - DNA, 454 bp, Homo sapiens
ttcgattggctgggcacttagtgagacctgcttctgaaaaatccaaaaactagctgggcatggtggctatatcgcacatgtatccctgctacattgggaggctgagacagcgaggatcacttgatgccaaggaggtcaaggctgcagagagctgtgatactgctactgaactccagcctgggtgacagagtatggaccctgtctcaataaataaatgaataaggtctgggcgtggtgcattatcgctgtaatcccagcactttgggagaccgaggagggtggaccaccttgaggtcaggaattcgagaacaggctggttaaccatgatgaaagcccatctctactaaagatacaaaaattaactaggtgtggtggcacaggcattgtgtacccagctattcaggagactgaggcaggagaatcacttgaacttggtaagttgcccgccaaatcg

SEQ ID NO: 527466 - DNA, 500 bp, Homo sapiens
  misc_feature (1)..(1): n is a, c, g, or t
  misc_feature (13)..(13): n is a, c, g, or t
  misc_feature (23)..(23): n is a, c, g, or t
  misc_feature (87)..(87): n is a, c, g, or t
  misc_feature (111)..(111): n is a, c, g, or t
  misc_feature (119)..(119): n is a, c, g, or t
  misc_feature (142)..(142): n is a, c, g, or t
  misc_feature (161)..(161): n is a, c, g, or t
ntttcctttagtnattcctttancagtggacctggtcccacctttaaatttaattggatattattattacgttttgccttccaagtnctccagatatcctccaaacctttnggcgttgncatttcatcggactacgggaatnattcctcaaattgaaattntccttgatgggtcctcttctggttcttaattctagtcatgaaaaggaaaagacaaaaagatagccaaatcttaaaactagtcatcggccgggtgttgcatgtcacgcctgtaatcccagcactttgggaggccgaggcgggtggatcacgaggtcaggagatcgagaccatcctggctaacacagtgaaaccccgtctctactaaaaatacaaaaaattagccgggcgtggtgcgggcgcctgtagtcccagctacttgagaggctgaggcaggagaatggcgtgaacccgggaggcggagcttgcagtgagccgagatcgcgccactgcactccagcc

SEQ ID NO: 527467 - DNA, 640 bp, Homo sapiens
tactactttatcaaaacatgtcccttaggtgtgtaggattcatttttaaaattcttcctagaaaataatatacaagggagaggcatatttattcccaatcacacttcgggaaaatgcttcccggtggtcgagaagggtcttctctcttcttttcacgggtggttttgggccttagcagtgtgttaagatgtgagatttcaggttagtgcgacgtgagcaaactctcttattacaaccatcgaaggggcacacatagggccgtgtctccggtagtggatctcgcacagtgtgtgcgcaaatggaagtccagtgaaaagcgtttcccacagccttcgaacgtgcactggaaagggcttctctccagtatgaaccagtgggtgtcgtttaagtttggaactctcaacaaaagtcttggccacattctgcacagacgtggactcggggaccgtgggtgtgcagatgttttctcagggccgagttatcccggaacttcttggtggcagcctttatgagggcaagctatggtgctgggagcatcatcttcttaaatttttctgggcttcattctagcaaattctggccagtggttggggatctgagaggtcaatgccaggtattcctccaggaggaagttcttccg

SEQ ID NO: 527468 - DNA, 413 bp, Homo sapiens
cgaaacttatttttaaaactttacaattaccatattactctcgttactgagcaaattttgatggcttgccaaaaaaaaaaaaatcatgagcagctaaactagcccaaagtgtaagaaaatgtaggcattgtgagaactgacacacattacagggaaccacaaaacagagacaggcttcaacaggtggttggtactaacaaatggctattcacaccttataaaatggatggctggtctacggtacggtgggctcatgcctggtattcctcagctacttggggaaggctccagtgtggggaggatcaacgctggcagtccaggagttccaagaaccaagctgggcacaacaacaagtggagaaccctggtctcaaaacaaaagaagaaaaaaacaaagaaaacaaagaaaagaag

SEQ ID NO: 527469 - DNA, 128 bp, Homo sapiens
tccagagggcggacaacaaatcacataaggaacaacgaagacagcaggatattcagcctggagaagactacaagaaggcttcagaataagatgatatctgaagagtcatccagaggcccacataaaca

SEQ ID NO: 527470 - DNA, 610 bp, Homo sapiens
tcttctttaaaatgttgctaaccctaaaacaagaaatgatgaggataattatgataactagagattgaagtggaataactgtaatgttctttgagaactttaaacttacttccgttttcattgttcgaatttttccagacactaacttccctagtggtagatatttcggacctagatcaattgggagtagagaaaaggagatggaaggaaggaaaggaaataacttttattgaatgtctgttctgcagcaggcactgagtacacggtttgtcatagtcatatatcgtacgctctgctgtcgccttctcactagccagctaatttcactcggcacaactcttacgtaactgcactcctctatttgaacggatgaggatagactcttcagagtggccaggttacatgtccagagcaagattcaaacccaggtcttctgatttcaaatcttatgctcttaacacaattcaaacttcatatccaggggttaattccctttcctcttatactcttatcgtcccagggtccggactgtcgtctccatggtatcacacacctgtcttgaatcaaagggaacgtaccaagtcaaaatccaaacccctcccatcgcacg

SEQ ID NO: 527471 - DNA, 201 bp, Homo sapiens
gtggctttggtcgagtggacctgcacctcatgtttaggagacaggccatgccttatcaagagcatgcagctcactgattgcatcctctagtttccgcacggtggcccaccatcaagtatgtccgacagagcctggtcagaaggcagacttcaagtatctcattctccatgctccgggcgctaccggagacttcgtacattt

SEQ ID NO: 527472 - DNA, 157 bp, Homo sapiens
attatgacagattaagatgactttagtgagctgaaaccaacagtgtgcagttactagataagatggagtgatgagggaaaatggaagagacaggaatgagtactggccttggggcatatggttgactgtgtgggtggggcacagagggccgaagcaa

SEQ ID NO: 527473 - DNA, 1003 bp, Homo sapiens
  misc_feature (279)..(279): n is a, c, g, or t
gttgggagctaggacattggagagagagagagagagagagagagagagagagagggagacagatgatgaagagaggagaagagagctgatatgatagtgatagtgatagtgatagtgatgtgatctcagggaatgtggtgttgaagggaagggtatgtatctatgctttgctatttgagagggcagagtgatgttgtatgctctggtctttgccacccttccagtctattgtctctggcaatgtttatacctctcttgtgacatctctcatacatcatnctctactcgtgtgcagaggggaagagaagtgtgggtatttacttcacagcatctgtggaacgactacttacagtgagataagtggctataagtgtgcttagccaggacatagtacctggtgagtgctcaatacgtggaaacacaattttatcactatctcattattcacggaagtagtaaaattaatttgtgtcgagtaaacttgtacccttggatgtatggaccgcgtgattgtccaaaaggcaggatctcagagagagagacccagaagtcagactccaaatttactcgatcattgtgcataagttattctttagttacgttcccacgattgtcacgtgtctgtctattgataacactctctgttatatagatgacctagtattttcacagcctcagagtatgtgtgtctgtggtcaggtgtccaagttagtgatccctcaggggtgtgcaaaaggtaatacttaataggcactcacttaccgtgctcagggttccagccttgctcagatcccctgttcccgcacttcttcacgtatcatgagggcccatattccagttttggccccctgggtgcccaatggaattatgtcccccacatttgtttccgtgtgcatccacaattcttatatgcgaggaacttgctgaaaaccgggcggaactataagtgggggtaaaacccgctggtgtgcccatagaattccccaaaggagtacacaccgtg

SEQ ID NO: 527474 - DNA, 384 bp, Homo sapiens
atggtaaacgagccaaactggataactgctggggccattctcagcatggagatgattccctcgtggctgaatcccaagacccgcggcgactccagcgtctcctggaagagttcccgctcctggccggaagacgatgacggcccgtcggtcactgaaccgctagtgggagcaaggctcgatgaggaggtcggctttgagctgctctccaccgccccccaccagctggtaaaagatgtggaagctgcactcgttcttgtcctggcggatggcccgcgacttatccagcaagtaggctctcaatagtgtcccccacaatgtacccggcaacataaaagttgatgcggatgaatttgccgaatcgggaggagttgtcattcttcactt

SEQ ID NO: 527475 - DNA, 116 bp, Homo sapiens
tatgttctcgaatcgttagcatgtagcatctaagaacatttgcaggttccaagaagatgataatgcatatttctaaagaggaccccaagatgcttaggggtcaaggcaccgggtca

SEQ ID NO: 527476 - DNA, 445 bp, Homo sapiens
aaatattttattaagaaactgtttcaaagataaatttgcactgctcctttttcttgccccacccctcctgatgggacaaaagggtgaagagctcaaagaaccccgactcccccctcccctcccacctcattgtgtaccatgaggggtccttgggaaatgtcttacctcttgtgttgaatggagacctgggttgagatgtgtctgctcttgtaggaagatcttttgtatcaggaacatgtacactaggccctgttcccgtccacaagctgagccatatgtacataagctagactgttttcttaggtgtgcacttttatagtctgtttttgaagattaacacatttgcaaggtgattgacaccatctttgcctaaatgcagtgagtgtacaggaagctcgttctcgagacagtacatacaatccggagggggtcacatagactaggg

SEQ ID NO: 527477 - DNA, 375 bp, Homo sapiens
ttattaccagagacttactctgtcacccagggtgcagtggcaaaatcacagttcatggcagcctcagcctccggggctcaagcaatctcggcctcagcctccccagtagcaaggactacaggcatgtgccactgaactgggctaatttttaaatttttctttggtagagagtggggtctcacaggcgggttaagagttccgggcctcaagcgatcctccgtgcctggggctcccaaacggcggggatggcagatgtgaaccagggcgcctagcctccttacctttttggttggttggttggagacggagtttggctctggtggcccaggcggaagtacaagggtgtgatctcggctcagtacaaccggccggtgg

SEQ ID NO: 527478 - DNA, 275 bp, Homo sapiens
cactgaccctgagtacatccatgatagcttgctacatagagattgttatacgttgtcatagtctattgcttaacttgatgcttgtagttggaagagttcattaccatcatatctacttgagtcatttggttttgctagctgactatcatgactgcctacgaacgagtcaattatgggaactccccagagttattttactaaggattaactagtgcatcataaccttgatgattacgcctcttacttatttactttattacagtatctaaaagctg

SEQ ID NO: 527479 - DNA, 453 bp, Homo sapiens
gagagagagagagagagagagagagagagagagagagagagagagagagagagagagagagagatagagagagcgcgtgacactctctgtgcgcgctatccttcctttgttctcctcgcctcttccctgcctctcgcctacgtctcttttcctcctcttctttcccccttctcagtgcactctctttgcctcctgcttccttcttcctgctccttgtcctctactttccactctcttttctgcgccctcctccacttgtctcttttgtctgtgtctcacgcccgtttcttgcctagcatctctctcctgtccggtatcctctcttgtctcgtcctcgtgctcatctgctctctctgcctgtccttcctcctttgcctctttgtcctcttcctgctcctctcccactcttgcggctttctgcacactctctgcttttccttccttgtctgtcct

SEQ ID NO: 527480 - DNA, 513 bp, Homo sapiens
cgttcgtcggttgactctgaggatccctactgcgttgctctactgttcctaagtttatttggcggcacacccggtatgagggccctgcaccctggaagcaaggtgttgggcctcgttggtggtgatccgtgtctatgtgctgaccgcgcatgacccggtggggcagcgcgtactttatcttcgtctcgtgtctgagatccctctcgggccggtggtatttgctggccgcgatctcctccaccttcatgatctgaatggagtgggctcgggcgcggtgccgggcacccatgtctcggtagcactgggtgacagcgcctgcggtggtcaggtcccggtattcccggtacatgttgtgggtgccgctccgggagtcatagcgcagccagatcccgaagttcttcacccgcaggggggacttctcaaacacctgcccacagtagacaatctcccctgaagacttcttcatcttctttaactgagatacaaagtaccagaagcgggacttggcgacga

SEQ ID NO: 527481 - DNA, 368 bp, Homo sapiens
ctcgactctatgtaggatccccgctgagatgacagtcggccactgtgcccgaccagctcccatggtcttgagtcttggcacccacaaatttttttttttgggagacagagtctagctctgctccccaggatggagtgcagtggcatgatcatagctcattgcagcctccaattcctgggctcaagcaatcctctttcctcagcctcctgaggagctgctactaggcacatgccaccatgctcaaccaatttttgaaatgtttgtagaaacagggtctcaccatgttgcccaggttgttctcgaactgttgggctcacatgatcctcctgtctccacctctcaaaaagtactgggatcacaggcttgag

SEQ ID NO: 527482 - DNA, 909 bp, Homo sapiens
ataaagtgcagcgggaccgggtttactgtatggagtcttccccgcgcatgttcttctcccgctgtgtggatccgcgccacgggggattgatcaagaggccttttgccacggtggcgcgtctgccccaagcgttcgggggttgacaaacacaaggttgtgtgctgccacccttcggggagtttattttggccgcttcgccttctgtatatcaggggtgtgtcccgcgcccagatttggcttccctccatgacacggtgttcgtccttgttacttcggcgaggatgtctgccccgccagggccaaagaaccgcgcgccccgccaaagggaaaactacaaagccgacaaatcctctgtcaacggaaaacaagcggcccatctggtcatgccgcaccgagtgcgctgcctgcccaaagcgcccaaggaaggaccacaacccgccaagcagggggagacacacacatcatgccccccgggagtaatgatcgccctgatgagcgagagactcgccaaggcgctctctcatgaagactgcaacagtcccaaagaaaggaatctccgcggccggcgcggcggaccaccccctggaataccacgcacccatttgcggcgccaccaaggcccggccattgtggttctccagacactggtgacctaaagaacgcaacactacggggggaaaacttggggagcaaccccactcgtgatagggaaaatgcaaccaaacattaagccccgcgtttgggcgggggcgccccagaaagcaccgaacatgtggtccgggggccgcgatggacgcgggagaagatacagctgcgaacctccgcagggcctcggaggtggccaaccgggtgcaggtgtgcccccccgcccccaccccctgggtaaagcgaatccccccccacatgtcg

SEQ ID NO: 527483 - DNA, 278 bp, Homo sapiens
  misc_feature (59)..(60): n is a, c, g, or t
tttttaaaaaaaatttcccccggggggtttcggggaaaaaaaaccccctttttgggggnnccccccccctttttttttttccggggggggcccttttggggggggggttttaaaaaaaaaccaggggtttttttttttttttcccttaagggggggcccccgttttttaggggggccccctttttgggggggggcccccccccttttttccccccccccggggggggttttttggggggggtttcccccagaaaaaaaaagggccctttttgggggga

SEQ ID NO: 527484 - DNA, 173 bp, Homo sapiens
gggtaaaacaaccccagctttggaagaaatcgtcgttcctataacccgggggtattgggtttatttttaaattaccaggatcccttccagtaaaagggaatatttttttcggcccaaaaggggcccctccttccccctttctgggttcaaccccctatcgaaaaattattgcc

SEQ ID NO: 527485 - DNA, 486 bp, Homo sapiens
attggccttatgttccctgcctctggaccctattttcctgactcactgggccatatgggctccccattttccaccaaccccttcccacaggctttttccccgacttggacttccctgtcccacagggcgacacagtagtgaagttgaggaaatgatgagtgcttggtaggaacccctcccggggttcacctgaggctggtgaccggccatgggccgtgcagtcacttgcctgtttctccagcagctcaagcctggggagtgggcatagcaagctcatggcaagtccacccaccactgggggctggccgggccaactggagggcaaaacacccccattggccccttaccccttgtgttctgtacaaccggggtttgtaatacaatgtccctaaaaaaaccgggggggccttggaaggggactggaaccattggccccatggcggggaaagaatttccaactcttttaccccccccccgatgacccgg

SEQ ID NO: 527486 - DNA, 106 bp, Homo sapiens
  misc_feature (85)..(85): n is a, c, g, or t
taccttctctaatcctgtgataactaaaatgtctgccttcaaaagcactagaagagataacgtgtatgaattgcttgcccgatangtgggtgccccaaccatattt

SEQ ID NO: 527487 - DNA, 7313 bp, Homo sapiens
ggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccacacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagactttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactctctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatagcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgttgagaaatgtaaattgtaataatgtaaatggggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtggtgtgtgtatatatacacacacacatacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 527488 - DNA, 2661 bp, Homo sapiens
acattcagctcggtacccacaccacctgagtccaggagtttgagacagcctgggcaacatagtaagactgcatctctacaaaattctaaaaggccaagcacagtggttcatgcctgtactatcagcaccttgggaggccaggagttcaaaaccagcctgagcaacaaagcaagaccttgtctgtacaaaagaaaaatgaaaaattagcttgatgtggtgacgctcatctgtagtcccagctactcaggaggctgaggcgggagatcgcttgagcccagcagtttgaggttatagtgaggtatgattgtgccactacattctagcctgggtgagagagtaagaccttgtctcttaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 527489 - DNA, 264 bp, Homo sapiens
acaggatcccgatcgtccagcatcaactcatggtgcttgtgttttacttggtgggttttgtggctgtcattctaatgcgtgtgcatcttgaatgacctggactcggtacacattagatgagtgagaccacctctgcaggttctggctgatgactttgaccagtggtgacaatggcttggaaaattatccagtacagatgtcttcctgcttccccccgatacctgtggatctgctcatgtgcttgtgcattggctgtgtggtgcc

SEQ ID NO: 527490 - DNA, 7188 bp, Homo sapiens
ctgaggacgactttatgaccaagagctgaacaaggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccacacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagactttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactctctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatagcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgttgagaaatgtaaattgtaataatgtaaatggggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtggtgtgtgtatatatacacacacacatacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 527491 - DNA, 7086 bp, Homo sapiens
tggagacggcctgggtgctggcgaagcggaggccggaattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccacacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagactttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactctctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatagcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgttgagaaatgtaaattgtaataatgtaaatggggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtggtgtgtgtatatatacacacacacatacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 527492 - DNA, 930 bp, Homo sapiens
gggctccgactgtctgggccgtccgcccgtcggttgccatcatggcggacgcgtgacagtgcagtgtgcgtcctgggattcgcggtctcaccatcctggtactcagccgcttgcatgtacgtgaaagtgctcatccaggtgggatatgagcctctgaccttaaacaataggacgaatgattttggggcggaaagaatgtgtcagcttcctggtctcttgtagatgatgcatcattgaaattggcagattagtacgatggggaggcgcgggtgttgttgaggcaggtccttaactccaagaagtgggttctgggagtcctggagaactggggtcgatggtggagttgaataggattatgaggatattgatatgggtgaggagtaaggagctgggagtgttcagaatcgaagtctcatcttcctttgaccagcgtaatcaaggaagaggactcgagagatgaggtcgtgcgttctagttgtagcctcatcataagatcccggtttcatgtgatcacgactgagatctatggtacagtccattcggccgagaatccaatgtgctgtcggacttgtgattcctttgaccctcttatcgggatgcgggattctacggtttccggggtctgttcctggccttctagtgtgacgtcctttcttcgtggctgtgttgctcctggctagctcggcgaaactatgcctggcggtgcgtgtttaccttgatgccatgtggggtttctcagcgcgagggctattgcgctgtggccacccttgggtggtccccttcgcgtgtcccctggtgctggggggctcttcaccagttctgggggcggtgggtgcgcccggggagcgcgggatttggggcgcgaattggcacgtacgggggctcccaaaggactggtttttaaaaagcggcgcctgttgcgctcttcca

SEQ ID NO: 527493 - DNA, 7273 bp, Homo sapiens
ctatttatctaggtaatactttttatttatgcatttatttggtcacgtaaatgtgcttagacctaataaacatatgtagttggtgaaaattaatgcatgactcgtgagcagagtatggaatgtaagcatgtgccatgaaactgcaattcttttatcctgtattttccatcatttacataccggttccatttagaggatagtccattttcacttttttttcatagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccacacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagactttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactctctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatagcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgttgagaaatgtaaattgtaataatgtaaatggggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtggtgtgtgtatatatacacacacacatacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 527494 - DNA, 615 bp, Homo sapiens
atggcgggccctgctgggctcacgggggactcagggttggaccccagtaggcctccgccaggtgtggtgggcaccctctctgtggaagttaggaagggctgttgagggaaggtggcatggcgggctgggtcttgagcggtggggaggagttgggcccatccacttgtagcggggcacagggctctggctgaccaccagcagggcaggcggagggaagggtccggcgccctcttttcccactggtgtcctcctgctgtgaagccaggcctgtaggagcctgcaagcctcggggggcacaggggacaggcctgacacacagagggctcctcgggcactcatcctatagtagggagacgggccctgggaggggagggagccaggaggcagccatgcgccctccctaagatggaaaacgcaggggcctggtgagggcggtgctgaccacagtgctctgcacaccaggctactgctggcgccccagctccggggaacatagagtccttggggacacaggggcccagggcctccagagctgggatacggtggaggggctgctggatcccaaacaccctttaggcctccttcatccctagtcagcattccagccaggacccc

SEQ ID NO: 527495 - DNA, 168 bp, Homo sapiens
cgtagagtattcatctacaaaccacaaagacagttggaatgcaccataccttattattctgcgcatgagactgtcatgtcgctaggcacagctctatgcttccttattcgagccgatctgggccagccaggcaaccttctgggtaacgaccacatctacaacgttatc

SEQ ID NO: 527496 - DNA, 358 bp, Homo sapiens
  misc_feature (71)..(71): n is a, c, g, or t
  misc_feature (90)..(90): n is a, c, g, or t
  misc_feature (150)..(151): n is a, c, g, or t
  misc_feature (169)..(169): n is a, c, g, or t
  misc_feature (174)..(174): n is a, c, g, or t
  misc_feature (177)..(177): n is a, c, g, or t
  misc_feature (182)..(182): n is a, c, g, or t
  misc_feature (185)..(185): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (256)..(256): n is a, c, g, or t
  misc_feature (258)..(258): n is a, c, g, or t
  misc_feature (266)..(267): n is a, c, g, or t
  misc_feature (272)..(272): n is a, c, g, or t
  misc_feature (354)..(354): n is a, c, g, or t
ggctgaggtgggattttccctccccacagtgcactgagcaatggagggtggtgagggagccatgctgctgnattctggttggcatttccncattatgtaaaatggggtgttgggtagggcagactctgcttgggtttggttgtaagatanncctggaggagaagcacantgtcncantgaantanttgagcaaaaactactgtaaataattcaatgggcagactctgcttgggtttggttgtaaganaanccnggngnagaagcanngttgncccattgaattatttgagcaaaaactactgtaaataacttttttgtcttttgtcaaataaaatttttttttgtttttttaancaga

SEQ ID NO: 527497 - DNA, 455 bp, Homo sapiens
aaggatgggagcagggtccagcattatttaaaaccttccgtttcagcttaagctaaggggagggggaatccctcctttccagcttgaaattggccatctagaaaaaactcggtccataatggctgaagaactagtttaatttaccaatccaaatgatggacttggagagaaggtgaaggggataccccaacttagaactcagctaagagatttgggtccaaggggccaccctattttgccgatggatggagaaaaagccgaaaaggccgaagaacttcgatttggtttcgaagatggtaaaaatatgggccaaactccaatagatggacttttaaggccaagtttccgtttacttgtgaaaattgaattcccctccaactgaaaggtagccttttatattttaacctttaatgtgggcttcccattaatttttttataaaattagaaagggggga

SEQ ID NO: 527498 - DNA, 356 bp, Homo sapiens
cctaactcagcctaagactgggagccaagcaccagctgggggcagagactgtgggaaattataggacagcaaaatgaagagagggccgggggcggtggctcatgcttgtaatcccagcactttggaaggccgaagcgggcggatcacctgaggtcagaagttcgagaccagcctggccaacatggagaaaccccgtctttactaaaaacacaaaaaattacctgggcgtggtggcgggtgcctgtaatcccagctacgtgggaggctgaggcgggagaattgcttgaacccgggaggcagaggttagatacagtgagccgagattgcaccactgcactccagcccgggtgagacag

SEQ ID NO: 527499 - DNA, 141 bp, Homo sapiens
cctttttagcacccataacggtacgtgatggcataccatctgtgtgcgtttctggcgatgcagcaattccaagaaggtgttgtatgagatggctgtgacagcaccagtctgttctgctattccatacccaatccccggtcg

SEQ ID NO: 527500 - DNA, 638 bp, Homo sapiens
agcggatcgttagttgctgccgctgccttcagcaagacgctgctctgaggcggggagggcgccgcgtcctgagcgcgcggtccagcgtcacggcggggcggtggggctcctccttggacccccggagctccccgcgccgggagcactggcccaggcccctagagccccgagagctccgagagctccgactcggcgtcccgcgcgcctccctgccgctcccgcccagggctggcgatgctgcgaccgacccgatcccgccgctggtccccggccgcccggggtgctgctggctcgggctgctgtgcggcggtcgtgggtctgggaccgtgcgatgttaacaaggcatcaagcctcttggggtggagcccacctaccacggcagtaggtcactggagaacgacaacaccgtgctcctcgaccccccagtgatcgcgctggataaaggatgcgcctcgtgcgatttgcagggtgagattcgtggattgaaaattcacgggcagaatgtcccctttgatgcagtggtagtggatagaatcactggtgagggagtcattcgcgtccaaagagaaactggactgtgagctgccgaacagactattcatccacaatccaggcctatgatggtgggaagggacctg

SEQ ID NO: 527501 - DNA, 353 bp, Homo sapiens
cttgcgacgcgcgagagctgtgctgtgccgcgcagttaggccagcagtcagtccgcggagtcagctagcctgccgctggagggcagccatgaagcattaccaggtgcgagattctggacgcacagactagggagaatctgtgttacgtctaggtcgacctaaacgttacacatgggtgttattctataacgcttcctagctgagttatcacaggagaacctgatcacgtgcatcagagagcttggagaaagctagagtgattcagccaggctacggtgttcagtatgattacttacatccccgtcagatcaccccttccttggagactcatttggttcaacgactcttctttg

SEQ ID NO: 527502 - DNA, 803 bp, Homo sapiens
ggagcattttgggaggctgacgtgcatgcggatctcctgatgtcaggagttcaagaccaggctggacaacgatggtgaaaggccatgtgctcttactagaatagatactagaaaattagctagtggatgtggttggtgaggcgcctgtaatctggataatactttgaggaagggtgaggcaggataattgatggaacccgggaggcaggtggtagcaagtgggacgataggagtcaacgcacatgggagctaacatgccatgggtacaatagagatgggagcgatagagctaccagtcttagtagagaaaataaacgaaaaaataacatgaaagtgataaaagctaatgtgctgtaggtattctgactagatgcacctaggtgtgaagataggtttttatagaggaatatattggtatggcgaggtggactgactggaagtcaaattgattggtgaatagatgtacaaggtaaagtgtggttaacagagtatgtggtaataaaatatacatggagaaccagtgggtggtctaagtaaaataagtggagagagagagtacatttggttacgttcaatttatcagtcggaaaagtggcgaagcgttggagagaacactagaacgtatggatgtaatccagggacttgaggtcaataacaatgtggacatcatagcttaagaggggattaaaataaatttggggtgcttatttatataaaggaacagatggttttcagtaacgcgatggggacctaagttgtgattataattcaaaatgatttgccctttggggagttatagagtg

SEQ ID NO: 527503 - DNA, 873 bp, Homo sapiens
  misc_feature (67)..(67): n is a, c, g, or t
  misc_feature (78)..(78): n is a, c, g, or t
  misc_feature (84)..(84): n is a, c, g, or t
  misc_feature (91)..(92): n is a, c, g, or t
  misc_feature (99)..(99): n is a, c, g, or t
  misc_feature (120)..(120): n is a, c, g, or t
  misc_feature (125)..(125): n is a, c, g, or t
  misc_feature (130)..(130): n is a, c, g, or t
  misc_feature (134)..(134): n is a, c, g, or t
  misc_feature (136)..(136): n is a, c, g, or t
  misc_feature (149)..(149): n is a, c, g, or t
  misc_feature (158)..(158): n is a, c, g, or t
  misc_feature (169)..(170): n is a, c, g, or t
  misc_feature (203)..(203): n is a, c, g, or t
  misc_feature (208)..(208): n is a, c, g, or t
  misc_feature (212)..(212): n is a, c, g, or t
  misc_feature (235)..(235): n is a, c, g, or t
  misc_feature (244)..(244): n is a, c, g, or t
  misc_feature (274)..(274): n is a, c, g, or t
  misc_feature (294)..(294): n is a, c, g, or t
  misc_feature (873)..(873): n is a, c, g, or t
atgattcgcaattgaaggtacaggtgaaagtaactgccacggatgttcatctgagtcttttcaaagnaatctgcaccntcatanaaaccannaatgccnctatcctgaggccttgatttngcatntttcnaaancnagggaattagtcnaactgtgcnccatgatgtgnnaatgatactggtttttagcattttataggccancagantctntggtcttaaatttaaaagtgagntgagccttntttaaaaagctcggttttcacaaaaacaangtagaagatattttctcacntcaacgtgatgtccagtgtgctcatcagcacctgtttctccctctaatcatagaggatattcttattatttagaaaggcttcaagggaaacaacttttgacacctaagtcgtgtcctaccttcgcttcagcttcgcatttcccatttctgtgaaattcccaactttagagaagcagatttgccatggccttctgacaaccttgtacatctctcacataaaccgcataggcagggcttaactacaggctggcccgagtctgcactgagtctgaccctgaagttcctttggaacaggagaggccatcttgtgatgggctggaacaaggtaatttctcatccacctccctagtttcagttgagcaatggaacttcccacctgagcccctagggttcagctacaggctataagactgccgtcctgtggtttagtgttggttccttagcagcagagtgatgccacctctgctgcccgtcatctgactcctctggatgggtgttatcctgtggcttaagagctaacaccatgctgatcttgctttgctatatgtgtaactaataaaccccgatgctggcctgaan

SEQ ID NO: 527504 - DNA, 779 bp, Homo sapiens
  misc_feature (779)..(779): n is a, c, g, or t
ccaaacccccgggctttttagatccagttgcgtccccctaataagggctccaagaactctgtgcttccaacctatttattagggcgacccagaactcctggggttcttagaacttatacgagacgacgctatgaccctttcttaaaaagagctcgggtggttcaccaacaaccaatggggacgggctttttctttccctccaccctgaggccccggggggctcatcagcacctgtttctccctctaatcatagaggatattcttattatttagaaaggcttcaagggaaacaacttttgacacctaagtcgtgtcctaccttcgcttcagcttcgcatttcccatttctgtgaaattcccaactttagagaagcagatttgccatggccttctgacaaccttgtacatctctcacataaaccgcataggcagggcttaactacaggctggcccgagtctgcactgagtctgaccctgaagttcctttggaacaggagaggccatcttgtgatgggctggaacaaggtaatttctcatccacctccctagtttcagttgagcaatggaacttcccacctgagcccctagggttcagctacaggctataagactgccgtcctgtggtttagtgttggttccttagcagcagagtgatgccacctctgctgcccgtcatctgactcctctggatgggtgttatcctgtggcttaagagctaacaccatgctgatcttgctttgctatatgtgtaactaataaaccccgatgctggcctgaan

SEQ ID NO: 527505 - DNA, 101 bp, Homo sapiens
ctcttttttcttgttccaatcgaggcaatagtacacgcaagacaactaagttctcaatagcacatataagacattcatcctcccccttctgtcgtcttctc

SEQ ID NO: 527506 - DNA, 147 bp, Homo sapiens
tgttttcacttgggccctgggaatgaactttgtattatttttttaaaaccttcccattacgggtaaaaattattgcaacttaaattttgcctgagcttgatcaaaggtcatttgtgtaaatgagtaattaaaaaatattttaatcca

SEQ ID NO: 527507 - DNA, 283 bp, Homo sapiens
  misc_feature (42)..(42): n is a, c, g, or t
tgtcctggagggagcatgcggtcccggtccctccccatggcntgcatcctttcccacacttttgagagctgcccccccaggagcagctcagatagaatcagctggagaccccagcatccctggccttgccagacaccaagtggcgcagataaactcagagtccgagttttggcccgtcaaaggtgctctcagaatcatcatttgcatttggcgggacctgtcccccctcaaaacccccaggttccttttttttccgtccaccaattaaagatctttgccccta

SEQ ID NO: 527508 - DNA, 538 bp, Homo sapiens
  misc_feature (220)..(220): n is a, c, g, or t
  misc_feature (275)..(277): n is a, c, g, or t
ccttcacgggcacccctccaacacccccgcaagggttttgggggtttttttctagaccaggggtttgacctcattaaaaagttttttcctctcttcccccggaggaggatcaggccttagggcggcccccaacattaggattttcgggaaacccccctcccccttgacccccccttgtttcccccgtgggcccccaaaaaaaaacaacagggttttatanggggccccccccccaggcccccttaaggagggctggggttcaccccccttggggnnncccccttaaggaaaaggggttccccctttcccccccaaaccaagggggcttttccccgggccccgggtttaccccccagtttttaagggcaaagtgggcccccttttggggggaactcacccggggcccccggggggggtttttggggtgggggttggattaaactcggaaccccttgtttttctttgtggccccagttttgtttttggtttttgggttggaaatttgtaaaattaaatccttttccctttttggggggga

SEQ ID NO: 527509 - DNA, 912 bp, Homo sapiens
agcggaggatccttctagctgaacaaagtcagccacataagcagactacaccagccggctacaattggaagtcagagtctcgcaaagacatgttgcttgattagtagtgctgtgcaagcatgtctggtagggtgccaccttagcttccctgttggccacctggattgtgtttactttaggcgtgagcactgtgactcgtgcgctgtggacatgaatccctcactggtacacaaaaagctaattgagaccgtatttactccaataagctaccaagaactaatgaggtaatactcactcaaatgctgaatcagaaagaacttatccagataatgctccagtcgtaatggcaaccgtgaactcattatacgttacattccatattatgagaggccctaccgtgcctggacttgcaggggctactacaaacactcgggcgcagatggatagtccctggaatcactattagggctagaacctacacacaacaactcgtaacaattcttggccaggccgacacgcgtgccatagaataccggcaccaccgtgtaccagcgcaacaggcgcagtgagcccaagacaccagggctcgaatgagggagtcactccgtaagaacgggcccatcagcgaatatcgaaagctgcaattcacattctcgacaacgcagagcgctagtatgttaaactaccgccacacacgacgcgaacataccatacggctcaaaacagcagaccaagatccagcaggaacacaaaaggaaataacgatagagaggacaaagtccaacgacattcaactggacacccaaaagaaagacaagataagaaaaggaaggaagcatcacagttgtaagacgagtatataggaccaatgcataacagatagcaatacgaggacctcatacggattagaga

SEQ ID NO: 527510 - DNA, 125 bp, Homo sapiens
ttgagtatcccgcggttgtgggttgtgtagtgtttgtggacaaggcctgccgtgtgaatctgaggatgagatgcttcacgctcacaactcagcattgagcacgtgagcacctctgtgctgctgga

SEQ ID NO: 527511 - DNA, 123 bp, Homo sapiens
atcataacagagggtaaaagtactttgcagataccaagcaggggctgctacttttgttgttgttgtttgtttgagacagagtcttgctctgtagcccaggcggagtgcagtggcggatctcgg

SEQ ID NO: 527512 - DNA, 201 bp, Homo sapiens
ggcaccagtttatggcaccagaaaaagtgctccccacattcgtcggactatggcctgtgtgtgtggactgagaagccattcaccgtaagggtgcagaaagctcgaccaagccgacattgcaaaacaacgtacgtacaatttttaacatgtacaggttcgatcgtttctatagaaatgggtttatctaaagaaaagtacttg

SEQ ID NO: 527513 - DNA, 742 bp, Homo sapiens
  misc_feature (11)..(11): n is a, c, g, or t
  misc_feature (19)..(20): n is a, c, g, or t
  misc_feature (53)..(53): n is a, c, g, or t
ggtcgatctancaggatcnnggtcgctcggacatgcatagcgcgtccagcgcncggatggctccatttcagccattcagcgctccacggcgttgccagcgcgcgcacggttgggctccagaactggtcatacagccgttcgttgatttccgagacggcgcgcacatgctcgaacagggcacgcgggtatgggaattgaatgtcttcgacgcgacgcggctcaaacgtgaccccgcgttgggagttgttctgtggcggcgcatcggagtgttccgacagcttcatctcgtacaagccgggcggcagcgcctcaatcgcatcgaggctttgcaggatcgcgcgatgctcgtgacgcgccacgcttgcggagacgaaaatgccgaggtgtccgacatgcgggttggtgagatacacgattcgctggccggcggcgaccagagcttccgtactttcgtacacgacgggaatccagccgagcgcctggtgcggtggcgtgatgttgtcgccgtacgaggcaaagatgacgatcggtttgcaaatgcgccgtaagtcgaccgtgcacttaccgtcgacatgcacttcgccggtttccaacttgttgccgacaaaaagatcctggatggttgcgaccagttcttcccggctgagaaagtaaaagcattccaccagcgctcgaattccaaaaccggtcacttcacatccgtcggacgaagacagtgtagagctgtccgagcgataggatc

SEQ ID NO: 527514 - DNA, 355 bp, Homo sapiens
gataaaagaatttgtgattaatatatccaggggctccccaaagaaacatgttttaacccctttaattaggtttttttaactgatagttttccctcctttataatcagtaggagagactgtttagatgttggggcagctttatgatttaagtttggaacatgttataactgaatttaggaccctagttttggtaagctattaggattttttaatagaacttactccccctgcctccccagccttatgttttttttaatgacttttgggtcctgggctccctttgcggtttgaaaaagggtttgcagtcagaactggggtctgatgataaaagcctttgggagcaataaaaagttgt

SEQ ID NO: 527515 - DNA, 2499 bp, Homo sapiens
  misc_feature (392)..(392): n is a, c, g, or t
  misc_feature (409)..(409): n is a, c, g, or t
  misc_feature (827)..(827): n is a, c, g, or t
  misc_feature (835)..(835): n is a, c, g, or t
  misc_feature (987)..(987): n is a, c, g, or t
  misc_feature (989)..(989): n is a, c, g, or t
  misc_feature (996)..(996): n is a, c, g, or t
  misc_feature (1004)..(1004): n is a, c, g, or t
  misc_feature (1085)..(1086): n is a, c, g, or t
  misc_feature (2469)..(2469): n is a, c, g, or t
  misc_feature (2472)..(2472): n is a, c, g, or t
  misc_feature (2476)..(2476): n is a, c, g, or t
  misc_feature (2479)..(2479): n is a, c, g, or t
  misc_feature (2483)..(2483): n is a, c, g, or t
  misc_feature (2485)..(2485): n is a, c, g, or t
  misc_feature (2488)..(2488): n is a, c, g, or t
agacagcggacccgtttgcacacagtcatgtgggacacgcaggccattgctgcacgtgcggaaagtcttcttgcagcgggggagttgcagtaggatggcttctcatcggacttgtccttgcagtgggggacgccgtcgcaggtcaagctgaagttgatgcactcgccattggcacactcaaactcatcttgtgctcggcaagaggaattcaccgctcggcaggtgaggtcatcctggaggattcggccccctcggcatgagcagttgacatggccctggtgagtgagcagacacaggtcctggcagccaccgttgttgattcggcatggagagagttcacagctgttggtgtcgttggccacggcgatgatgcccatgggctgctgggggangtccacgcgcagcagcntcatgttgctgcccacgtgcttgttggcccgctgcactgcccgccgcacccagtcagtccagaaaatgtgctccccatacacagccagcccgaaggggtggacaggctctgactttaggatcacatagcggtgggagccgtcatactcgcaccgctcgatcttgtccagggtggcgtcagagaagtagagcttctcggcacggtggtcgatggccaggccattgggggtacggatgtccttctcgataagggtcaggacattggctcccgagagcgccgcccgcatgatgctgggatgctgctcattccagttggtccagaacatgaggttctggcactcgtccaaaacgaaggcccgtgggtggtcatctccagacatagtgatgacggtctcacgctcgaaggcccctgggcgggnctggtccnctgtgtggcgcgtgatggtggatgtcgtgtagcttgtccaatagagagtgtcccagccacggtgataggccaggccttccacggagcccacgttttccacaatggtgatcctcctggagccatcgtcgtgatctgttggatgttcccaaagngnatgtcgntgaagaanatgcgattgggggtgcccggagaggtgcctgcccggtagtcaaaggccagggcgatgacgttcttcatgtgctcagggtcnncgaagggctgcacgggcgcattgaggttgcgctcatccgacaggtggatactcttgagaatggtgcgctctgagtagagcaggtagccggcatactcgcggcacgatgctccgtcttcagccagcatcccgtgggcacaggcgcaggcccgctgcccacggccccggtacaggcacagctgctggcacccgccattggccaccgcgcacacgttggtgcctttctgccggtcccggttgaagactttgatgtctttaagctggacgccgatgccggttcgcaggggcacggagtctgtggcattgtctttgctcccgcgcttgatagagccgttggcatgagtcctgtcactccagtagatgaaatcctcaaacacagacactgaaaacatgtccatgttgttgctggacagaaccacctcgcggttctcacctgtctccaggtcgatccgttcaatcttgtctgtccgtgcatcgcaccagtacagcttcccatcctggtagtccactgagatgccgttgggccagctgatgctgacgttgaccagcaccacacgctccgtgccatctagccgagaccgctcaatacgcggatactgaccccactcagtccagaacaagtaccctttctccgggtggacggtgatggcccggggcttgtctagaccctgggagatcaccacgtagcggaaggagccattgagccgggcgacctcgatgacatcaaagccctggtctgtccagtagatgttgcctgcgatccagtccactgcaatgccctccacacggccaatgccattggtcaccacgtcttcacgccacgtctggtcccgcttggcccggctgatcgtgctcaggcccatgtccacccagtagatggtgtcattttcagcgtggaagtcgatgccgacagccagcgaggtcccggacactgggaccagggcatctgacttgtcattgggatccaggggaattcccctgattccctcatgcacagagtacaggagaaaggaacctacgccctcgcaggcctgctggccactccggaggctatagccggctgtgcacatgcaggagcgggtcgtctctgacgtgggcaggcagagctgggagcagtcaccgttgttgacactgcaggggttggtgcccttatggtccagctggatgctctcgtcatagaccttcatgtgcatcaccagggtggtgctgttccgaaggaccacggagcccgagccgtcagccttgctgcatgtgcccatcttttccgacacctgatcagcccaccacagcttgtcccccatgatggccagggcggtggccttgcccagctggctccgcatggcatcgatgacctccagcccactccatccaggttgcagcggtngangganggntccngnagnatcacttaagc

SEQ ID NO: 527516 - DNA, 2306 bp, Homo sapiens
  misc_feature (634)..(634): n is a, c, g, or t
  misc_feature (642)..(642): n is a, c, g, or t
  misc_feature (794)..(794): n is a, c, g, or t
  misc_feature (796)..(796): n is a, c, g, or t
  misc_feature (803)..(803): n is a, c, g, or t
  misc_feature (811)..(811): n is a, c, g, or t
  misc_feature (892)..(893): n is a, c, g, or t
  misc_feature (2276)..(2276): n is a, c, g, or t
  misc_feature (2279)..(2279): n is a, c, g, or t
  misc_feature (2283)..(2283): n is a, c, g, or t
  misc_feature (2286)..(2286): n is a, c, g, or t
  misc_feature (2290)..(2290): n is a, c, g, or t
  misc_feature (2292)..(2292): n is a, c, g, or t
  misc_feature (2295)..(2295): n is a, c, g, or t
agacagcggacccgtttgcacacagtcatgtgggacacgcaggccattgctgcacgtgcggaaagtcttcttgcagcgggggagttgcagtaggatggcttctcatcggacttgtccttgcagtgggggacgccgtcgcaggtcaagctgaagttgatgcactcgccattggcacactcaaactcatcttgtgctcggcaagaggaattcaccgctcggcaggtgaggtcatcctggaggattcggccccctcggcatgagcagttgacatggccctggtgagtgagcagacacaggtcctggcagccaccgttgttgattcggcatggagagagttcacatagcggtgggagccgtcatactcgcaccgctcgatcttgtccagggtggcgtcagagaagtagagcttctcggcacggtggtcgatggccaggccattgggggtacggatgtccttctcgataagggtcaggacattggctcccgagagcgccgcccgcatgatgctgggatgctgctcattccagttggtccagaacatgaggttctggcactcgtccaaaacgaaggcccgtgggtggtcatctccagacatagtgatgacggtctcacgctcgaaggcccctgggcgggnctggtccnctgtgtggcgcgtgatggtggatgtcgtgtagcttgtccaatagagagtgtcccagccacggtgataggccaggccttccacggagcccacgttttccacaatggtgatcctcctggagccatcgtcgtgatctgttggatgttcccaaagngnatgtcgntgaagaanatgcgattgggggtgcccggagaggtgcctgcccggtagtcaaaggccagggcgatgacgttcttcatgtgctcagggtcnncgaagggctgcacgggcgcattgaggttgcgctcatccgacaggtggatactcttgagaatggtgcgctctgagtagagcaggtagccggcatactcgcggcacgatgctccgtcttcagccagcatcccgtgggcacaggcgcaggcccgctgcccacggccccggtacaggcacagctgctggcacccgccattggccaccgcgcacacgttggtgcctttctgccggtcccggttgaagactttgatgtctttaagctggacgccgatgccggttcgcaggggcacggagtctgtggcattgtctttgctcccgcgcttgatagagccgttggcatgagtcctgtcactccagtagatgaaatcctcaaacacagacactgaaaacatgtccatgttgttgctggacagaaccacctcgcggttctcacctgtctccaggtcgatccgttcaatcttgtctgtccgtgcatcgcaccagtacagcttcccatcctggtagtccactgagatgccgttgggccagctgatgctgacgttgaccagcaccacacgctccgtgccatctagccgagaccgctcaatacgcggatactgaccccactcagtccagaacaagtaccctttctccgggtggacggtgatggcccggggcttgtctagaccctgggagatcaccacgtagcggaaggagccattgagccgggcgacctcgatgacatcaaagccctggtctgtccagtagatgttgcctgcgatccagtccactgcaatgccctccacacggccaatgccattggtcaccacgtcttcacgccacgtctggtcccgcttggcccggctgatcgtgctcaggcccatgtccacccagtagatggtgtcattttcagcgtggaagtcgatgccgacagccagcgaggtcccggacactgggaccagggcatctgacttgtcattgggatccaggggaattcccctgattccctcatgcacagagtacaggagaaaggaacctacgccctcgcaggcctgctggccactccggaggctatagccggctgtgcacatgcaggagcgggtcgtctctgacgtgggcaggcagagctgggagcagtcaccgttgttgacactgcaggggttggtgcccttatggtccagctggatgctctcgtcatagaccttcatgtgcatcaccagggtggtgctgttccgaaggaccacggagcccgagccgtcagccttgctgcatgtgcccatcttttccgacacctgatcagcccaccacagcttgtcccccatgatggccagggcggtggccttgcccagctggctccgcatggcatcgatgacctccagcccactccatccaggttgcagcggtngangganggntccngnagnatcacttaagc

SEQ ID NO: 527517 - DNA, 874 bp, Homo sapiens
  misc_feature (104)..(104): n is a, c, g, or t
  misc_feature (131)..(131): n is a, c, g, or t
  misc_feature (138)..(138): n is a, c, g, or t
  misc_feature (144)..(144): n is a, c, g, or t
  misc_feature (158)..(158): n is a, c, g, or t
  misc_feature (160)..(160): n is a, c, g, or t
  misc_feature (179)..(179): n is a, c, g, or t
  misc_feature (204)..(204): n is a, c, g, or t
  misc_feature (243)..(243): n is a, c, g, or t
  misc_feature (368)..(368): n is a, c, g, or t
  misc_feature (380)..(382): n is a, c, g, or t
  misc_feature (402)..(402): n is a, c, g, or t
  misc_feature (436)..(436): n is a, c, g, or t
  misc_feature (458)..(458): n is a, c, g, or t
  misc_feature (485)..(485): n is a, c, g, or t
  misc_feature (495)..(495): n is a, c, g, or t
  misc_feature (497)..(497): n is a, c, g, or t
  misc_feature (504)..(504): n is a, c, g, or t
  misc_feature (516)..(516): n is a, c, g, or t
  misc_feature (524)..(524): n is a, c, g, or t
  misc_feature (533)..(533): n is a, c, g, or t
  misc_feature (541)..(541): n is a, c, g, or t
  misc_feature (564)..(564): n is a, c, g, or t
  misc_feature (580)..(580): n is a, c, g, or t
  misc_feature (606)..(606): n is a, c, g, or t
  misc_feature (612)..(612): n is a, c, g, or t
  misc_feature (616)..(616): n is a, c, g, or t
  misc_feature (623)..(623): n is a, c, g, or t
  misc_feature (628)..(628): n is a, c, g, or t
  misc_feature (638)..(638): n is a, c, g, or t
  misc_feature (645)..(645): n is a, c, g, or t
  misc_feature (647)..(648): n is a, c, g, or t
  misc_feature (681)..(681): n is a, c, g, or t
  misc_feature (687)..(687): n is a, c, g, or t
  misc_feature (691)..(691): n is a, c, g, or t
  misc_feature (711)..(711): n is a, c, g, or t
  misc_feature (716)..(716): n is a, c, g, or t
  misc_feature (718)..(718): n is a, c, g, or t
  misc_feature (733)..(733): n is a, c, g, or t
  misc_feature (787)..(787): n is a, c, g, or t
  misc_feature (800)..(800): n is a, c, g, or t
  misc_feature (802)..(802): n is a, c, g, or t
  misc_feature (806)..(806): n is a, c, g, or t
  misc_feature (872)..(872): n is a, c, g, or t
tggggtctcacctgttgcgtgactcccccacagtccggccgcgggagtccgaccctgaatgcccagggagtgttgagagaaatctggacgagtttcgggtcccnctcccttgggagcacgtggcctaccancctctcnattgcngggttgggtggtcncnacaccggggtcgccttgangccagtccggctgccgaggtctgcnggagtccacctccggccacctggcaattttgaaagactnccttactttccccatctcagtcccagggcaggggcccttggagtgacttggctggggtctgtggcccgatccccctcccgtccctcaggacccgggctttctactgtacaaacttctcgtgggcngcctcccctcgnnnctcgggcatcatggcctcanaggctcggggtggtctgggggcccctccgctccncgtctcccccctccctaccggnccccgccccctgcctcacacacacctncccgctcgancngcgcccntctatggactgncaaatagnaagacgatngccgaggngctgttcacccgctcactggctnagagcgagctccgtantgccccgtatgagtaccccgaggcgngccccnttgnccagctngaagngcggcggcanagctagngnnggcgctccacccagctgtcccgctggcgcacgncctccngctncgggccccgcccactttccngacgncngaccgtgcctcgganctcccgctctccccggccccgggtgcggggccaggtgaccgacgcctgcgggcncgtgctgatgctnancggnagtttccgcgagtcccctctctggggcggcaccgtatggggtgcgattcccacactgctggcagcnca

SEQ ID NO: 527518 - DNA, 223 bp, Homo sapiens
catgtctagaactattgtctagtcctaggtcctaattctcctctgttttcttctaaatgtgttattatagacatgttacgtttagagttatgatctattgaaagaaagggtagtagaaagaaggtctatggttattaacttgagattagggcatatgtatggagtcaactgtttcctagcatttatggaagaccatacttatccgcgaatgacctatattcag

SEQ ID NO: 527519 - DNA, 337 bp, Homo sapiens
cattcggggcataggagctagactcatgtcatagaaaagaaagaaagaaagaaatcctgaaaggaaacacagtgaaaagtgtccccttaccactcaccaggcacgcgtagcgcctacaggaaaccagtatctatttgcctggacatggtttatgcaaaatgtctgcaggatctgagtgatgttctgagggctcatgttggcgtatttatacctgctctcttctgtgcctgcttgaatgggagtcaccagagatcgtcttgtcagagctgccagctttgattgcgttgaccctatctcgtggattatgctagtgttagctcttatggcccgctggagt

SEQ ID NO: 527520 - DNA, 406 bp, Homo sapiens
  misc_feature (1)..(1): n is a, c, g, or t
  misc_feature (18)..(18): n is a, c, g, or t
  misc_feature (143)..(144): n is a, c, g, or t
ntcaaaaaaaaaaaaacncacaaccctgtcctgctcagcctggttgacgagtgagatcctgtctcaaagaaatatataaaattaaacttggttatagggcccgggtgcattggctcacacttaaatccccgcagggaggccanntggatggatcacgtgaggtcaggagttcgagaccgcccgaccaactggtgaaaccttgtctctactaaaaacacaaaattagccgggtgtgatggcacgtgcctgtaatcccagctacttgggaggctgaggcaggagaatcgcgtgaatccgggaggcggaggttgcagtgagccgagattgcgccattgcactccagcctggacaatgagagtgaaactccatctcaaaaacaaaaacctgggtatgtatctagaagtgg

SEQ ID NO: 527521 - DNA, 3924 bp, Homo sapiens
gaaccggtagtccgcggtggcgcggtccgcccctcacctggccagcggcgggcgctgaggggcccaatgggagccgcggcctggccgccccgccccgcgcctccggacgtctgtgccgggacaaggccgccgctggtgccgggtccttgaggagagcgcctcccgtccgaggccagccgcctctgtcagccgtccgcgcgggccgggtctgaagcgccgccgggacggcgaagagccgcggccgccgcggagaaggaggcagcgcaggaggccggagcggccgccgcgcccgagcacatggcgtccatcttactgaggagctgccgcggccgggcgcccgcccgcctcccgccgccgcctcggtacaccgtcccgcggggtagtccaggggatcctgctcatctcagctgtgccagcaccctggggttgaggaactgcctgaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaagctgattgctgaggaaggggtggacagcctgaatgtcaaggagctgcaggcagcgtgtcgggcacgaggcatgcgggccctgggcgtcacggaagaccgcctgaggggtcagctgaagcagtggctggacctgcacctgcatcaggagatccccacatcgctgctcatcctgtcccgggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccatggagattcagtctgtctggaatcccggaacccctccacagaatcgtgtctggatccacactgtggtgtggctgccacggcctcctggctccagaggcagctgggccgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgcacactttcagttggatgtgggtcattgtggagacagaggtgtctgccatctctgtggcctctggagagtgacgtctccctgctgggagtgctggttctcacgtgcggtttcccttgtgtatcggagctctttctcggctttctatttcccccagttctttaagcagtcaattggcacagagtttcccacgggggctgcagtggattcactgtgtcagggatgagcctggcttgggggttggtggggctctgaagcgcatttggggttctttgtagcttctaatgtgaggtttgagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccagggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctagaagtgcgcctgggtg

SEQ ID NO: 527522 - DNA, 2698 bp, Homo sapiens
caaattcacgaggaatgctcccaaagcacagagaggttaaattactcagtctaaggtcacgcagcagtaagtaatggagctggaatttgagctctaacagtctgctccggagctcgggccttgctgctggcgtcaggccatgcacagagagctgatggaagcaggaggagctgatgtgaagttatgcgacacacatggccttttaggaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaaggtgctgtgatacgtctgagtccctgtgacctcaccagggagccttccctgattttctgtttccctttcgctgtgctcagcagagtggagctcccccaggtgctggctggcgcttgaaagtttacccaggaggctcagtcgggggccagtggagtgtcaggagtctgcccccacgagctcccagtgagttaagctgtggtggctgcgcctcgtcagccttcagaattatgggcgtctgtgtctcatcaccctgcagctgtccaggagcagtagaatctgacccatgaggagcctgagaccctgatggtgtgaggtgtgggtggcttggccgggctcctctgctgggcattgccctctggctggagtcagtcaagaagatcccaggtcccaggggctggtcagaggcctggactgtgggagcagtgggggctggagaggaggagcggcccttgaggtttcctgcggtcatgtggtgagtgaggtgaggatggggagacggcagctgccacggaccgagatccctgaggactagatggggttcacgaggccggtgttgttggcttgagggacttgtgccactttggagtgagaaggatgtgtctgaagtgcaggaagagcttaaaccagggcctagaaactccagccatgcgtgtgcgttgtctgtggggttttcccgctgcagcacagaggcgagtggtttccatggctgcaaagccagaaatacttgctgtctggcccttgacagaaaagactgccaggctgaggcctaaccacggagaagcctctcgggaggaggcgacacagccatggggctgctgagccccccagggagtgggtggtggttccagcaagatgttttagggggagccatgctttgggagcctcacccaggacatcgtgccttgcagagcaggaggggcccgtcccaacctttcctgggccgcccagctgccaagaaggatgtgcttgcagtcacctgcacgggggtgtgctgcatagggccgcccccaggagcacacctgaaattgtgtctcagagctggcatcctgcatgttacgatttgagttgggcaccaagtcagcctcgtcctccctcatctgtcacctctgctaggtaccctcctagcccagctcttggcagagactgagctggtggcttgtccctcaggtggtaggaactgcagaggatcacccaaagggccctgagtgatccacgctaagggactctagctctccctaaagagctagatggccacccctcccccaaggctcaggcagtcatccgtgggagatgtaggtgcacacaggtgcacctcttcctgccccagagcagcagggtcccggccacttctgtggcagagagaggatcacaggacctgcatgcagcagcctgtgggcccgggcgtctcccccagcagacagcagcctcagctttgctggttcaggcaggagaggtccacaggccagacgccacctttccccaggctagcccagcaccggagtcagaagtcagtggtttgaggccaagctgggcaggtgacttgaggtcgggtatttgagaccagcctggccaacatagtgaaatcccatctctactaaaatacaaaaattagctgggtgtggtggcgcagcctgtaatcccagctactcgggaggctaaggcaggagaatcccttgaacccaggaggtggaggttgcagtgaaccgagattacaccactgcattccagcctgggtaacagagcgagaccctgtctcaaac

SEQ ID NO: 527523 - DNA, 490 bp, Homo sapiens
gaaccggtagtccgcggtggcgcggtccgcccctcacctggccagcggcgggcgctgaggggcccaatgggagccgcggcctggccgccccgccccgcgcctccggacgtctgtgccgggacaaggccgccgctggtgccgggtccttgaggagagcgcctcccgtccgaggccagccgcctctgtcagccgtccgcgcgggccgggtctgaagcgccgccgggacggcgaagagccgcggccgccgcggagaaggaggcagcgcaggaggccggagcggccgccgcgcccgagcacatggcgtccatcttactgaggagctgccgcggccgggcgcccgcccgcctcccgccgccgcctcggtacaccgtcccgcggggtaagcggcgggcaccccagggcggggccggctcccggctggtgggtcgggagcgcggacgacccgcgggttcgggctgggtgtcacggcgatgcggggagcccggtggtc

SEQ ID NO: 527524 - DNA, 3025 bp, Homo sapiens
gaaccggtagtccgcggtggcgcggtccgcccctcacctggccagcggcgggcgctgaggggcccaatgggagccgcggcctggccgccccgccccgcgcctccggacgtctgtgccgggacaaggccgccgctggtgccgggtccttgaggagagcgcctcccgtccgaggccagccgcctctgtcagccgtccgcgcgggccgggtctgaagcgccgccgggacggcgaagagccgcggccgccgcggagaaggaggcagcgcaggaggccggagcggccgccgcgcccgagcacatggcgtccatcttactgaggagctgccgcggccgggcgcccgcccgcctcccgccgccgcctcggtacaccgtcccgcggggtagtccaggggatcctgctcatctcagctgtgccagcaccctggggttgaggaactgcctgaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaagctgattgctgaggaaggggtggacagcctgaatgtcaaggagctgcaggcagcgtgtcgggcacgaggcatgcgggccctgggcgtcacggaagaccgcctgaggggtcagctgaagcagtggctggacctgcacctgcatcaggagatccccacatcgctgctcatcctgtcccgggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccatggagattcagtctgtctggaatcccggaacccctccacagaatcgtgtctggatccacactgtggtgtggctgccacggcctcctggctccagaggcagctgggccgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgca

SEQ ID NO: 527525 - DNA, 2302 bp, Homo sapiens
ggacgcgtgggtcgacccacgtcgtgcgtcgtacccgacgcggtgcggacccaggcgtcctggacccacgctgtcggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccatggagattcagtctgtctggaatcccggaacccctccacagaatcgtgtctggatccacactgtggtgtggctgccacggcctcctggctccagaggcagctgggccgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgcacactttcagttggatgtgggtcattgtggagacagaggtgtctgccatctctgtggcctctggagagtgacgtctccctgctgggagtgctggttctcacgtgcggtttcccttgtgtatcggagctctttctcggctttctatttcccccagttctttaagcagtcaattggcacagagtttcccacgggggctgcagtggattcactgtgtcagggatgagcctggcttgggggttggtggggctctgaagcgcatttggggttctttgtagcttctaatgtgaggtttgagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccagggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctagaagtgcgcctgggtg

SEQ ID NO: 527526 - DNA, 102 bp, Homo sapiens
gctaggtatcctatagggggggcttgtatgattatgggcgtgattagtagtagttagaggtgaacatagtagtagggtatatattgtaattgaaatgctcgg

SEQ ID NO: 527527 - DNA, 841 bp, Homo sapiens
  misc_feature (373)..(373): n is a, c, g, or t
  misc_feature (549)..(549): n is a, c, g, or t
gtgtggtatctcagattgggctatgccatcagtaataaaagtaaacatgaggactgtctatcgataagaagtagagtcttccataggcagtgcctttgacttaggaaagtccttcatcgaacttggtgtagtcgaggttcgatccatttttggcataatatcacggagtcgtgactccacttggcttaataattcaaaacgggaggtattgtagtaacatattgtggcaagaaaggaggctctggaaaagttggactttgaaagtggtgtcgtgagttcggtatgcaaacggagattttatatactttggagaaaagcaccctttccaggaagttggtggtagataacatatacaggttggtccattggggtnttcttggggttttggaaggttacaacttacaatggtaaccttgggttttggcggtacacggtggaattagcggggaactggtaacaatttggctttgggggtaaatttaacctttaaagagcgattgtgaaaaagaagccccccaatataaagggcgtttgaggaacacacagagncgtccccaagagtttttctgggtgggggacacctaacattgtcggtttgtgggttgtggcccctaaaaaagggaataaatccgtgtgaaaggaaaaagggttttgggttttcccaaagggtaacatacgggtaagttgaactagcccagtttataaacctaaggctaaaaaggttacatttccgagagagcagagtctaattgggaccttttaaagagtttggggggcccgttgcgcacaagcgaattttctccctatattttggggggagagttggggtcgtttcacatac

SEQ ID NO: 527528 - DNA, 918 bp, Homo sapiens
gtgccgcttaggtctgggaggagtcgcgattgggcgagttgatcatgggtctgtcatagtgggctggtgcttgccggatcattggtgtggacgatcaatatgggattaagttttgcaagtggacaaagtagatttggtagcacgattgtaaatgtgtttaacctcgtcaggatattagtataatcccattccagggagagtgctcattgaggatgacgctggatgggaggagtggaactattgctttgaatgtattggtgatgtgaaggtcatgagagcaggatcttggagtgcatgtcacaatgggtgtgtggcgttctgacagtcaagtggttggaggtatgtgtttcaggtgagggaaaatggcctgtcgttcagtgtccagatggttgacgggtcgcacactggtgatggcacggtcttgtggagggatggtagcagtgtaagaaagtgtcccagaggtggtgtctgaaactatgtgtgcaacatatgatgaaagttgtgggaatttgtgtagctcacgatctgtgtttgggatggatattgatatatgtgtttgaattgatggattctggaaagagcattcgaactgtgtaagggatcaaatccataggaagaggaatagttgttcattcctgtcgcgatgtgatagtgtagcatgtttacgggctggagaatgcgactgcgatcgtataggctcgtagaggtcacagtactgcagaaattggtgtggggtgtcatacatgatcgttatatacggccggattatgagctgacttggatgatgtccaagtagtatcgattttagggattagaggacgatttattgggggctgttcgaaagggatggcaggtgggaaccatgaggaagggccggggttttactcatatgcagcgccggaaacataaacgaatggg

SEQ ID NO: 527529 - DNA, 102 bp, Homo sapiens
gaggacgccaccgcatctacacgagccaacatgaacgactggaagcatctcatatgagactcaactcctctaatatgacgaaacgacaaactcgcaggtata

SEQ ID NO: 527530 - DNA, 122 bp, Homo sapiens
ctatgagctaagagagttttggacagaatcaatggaactaaaaggcaaaccacagaatgggtgacaatatttgttaaatcgctatactcgagtataggtgattaactatccatggatatgca

SEQ ID NO: 527531 - DNA, 145 bp, Homo sapiens
caccaccttaagtatcaggcggttagaaatttctaaggctggacgaatatatatggtaccccaacgaaaaacccatgggaaaatttttaacccaatgctataatatcgcaaggggctaaccccctatagcctgtctgccgttaaa

SEQ ID NO: 527532 - DNA, 908 bp, Homo sapiens
ctaactcatgcccccatgtctaacaacatggctttctcagcaaaaaaaaaaaaaaaagaaaaaaaaaactgtttggcccggcctgaaagttttgacaacaattcctgagtgggagcgaccggggacccctccgtgtccaacgagacatgcgtggcgcatcaaaggtagtccaacaaagacaaccgcggggcgcagcccatgggagcgccttggcctactcacgccaaaccaacaaacaaacgcacggagacgacacccgggaccgcggtgcaaggcacaaacccagactaagcaatcgaaggacgaccatcacgggactccctcactaagggcgtctcagcagtaaaaccgagtgaataagaccaccgcccactcggggagtccacaggaggttacccaagggaaccgccttctgacatccggccctagattaccttctcacatgaacaaaaactagcccccatactcaatcatatacctaaatcctctccctcactaaaacgtcagccattctcctcactctctcaatcttatccatcatagcaggcagttgaaggaggctttaaaccaaacacccagcatacgcaaaaatcttagaaatacacctccaatacgcacataggatggaatatacgcagtctacacgaacaacctacatcaccatactatattaaatatgaatatgatcaaaaatactagcgaattcctactaatcaaattaaatccaaaacaaagaccatatatacatcgactgaacagatacatggaaacacctatacataccctcgtaccaagagatgccccaacgactgcacaggcatttaaaataaaacagccttaacacacaatagacaacctactatatacacctatacacaaaaccttaaaaacaacaaaccacactgcca

SEQ ID NO: 527533 - DNA, 423 bp, Homo sapiens
caaaatgatctttgggaaaataatgcccgccggtgctactggtaaaatggccaggaccttttcatatgtgttggccttcaccacgatggtgaacggtggatcacagggcgttgtctgctctgggcactatcacttcctctaaggggtctcattcgttgtaagaagagtcagggcagtccttgggcagaggctcactggctttgtcgtcagctgcacagtagtcccgcaagaaagccgtagctgtctggctgctctggaaagttcgctgctaccatcctgtcaaggttcgtacaaaccaagatccgatgtagtgcaccgcctcggcgccgcggctttcgccgcgcagacaccgcatccacagcatcgtactggcccgactggtacacgcgcgaaatgttcctggcctctggaccgcgtcggtcc

SEQ ID NO: 527534 - DNA, 584 bp, Homo sapiens
tccaaaatggtaagcagagttcaggagatagctgggctctgagagaagtctaaggggcaacgaaaagcctaaaagagcctccggggatccatccgtcatcccaaagagccttgtgaactgcgatttagaatcaggtgtgccatcttgagaaaccatcccacattccaaacaaaattagtttaatgttcccacataaaaaggtcccgagccaggtggaggatcattatatgagcatacaccatggaactaaaaaggtttgcatgccgctggaaagaattcatggggaaatttattacagatccatttcttatgtaagttgtgtcctcctgtgatgagctcagtggaaggagcaaggccaagaaaggttatttgggccaaatatcattatcgtttcccctttgagaaataagatattcttcatctagatattcttctagtcccaggaagaggaaggagggcaggaaaaaaaaaccctcaaactttctacaaggacagttctttgcctttaggaaaagtctatctatttctcaattcttcctgcaaactgggcaaactgaagaacgggggataaaacagaggtgaaa

SEQ ID NO: 527535 - DNA, 493 bp, Homo sapiens
  misc_feature (488)..(488): n is a, c, g, or t
tggagacggtctcatcccaagatatctcatattttatacaaaggtccaaaagccaaaaaaaaaaaatcaaaaattaaaaatccttctgatctcaagcatttaagaaacaggctactcagccggtatggctttcccgggacagaggtgtacagtcatcctccctttctcctggaacatacatctcatatgcacatcatttaacttaatctccaaggggtattaagaaacacagtggaccagggcctcctaaaaactcggggcccagtttctagaaggccacattctccggggatcccttcttgcatctagttatctctttccagtctgcaggggctcctcctccggaggataacgtcctagacttgggatctggcctctctcccttgacctctgaaggttagtgagcgctaggacttagtcctggtctcttcttaatttatattctctcccagggagctggtttatgcctaggcgttatataacaaggntttat

SEQ ID NO: 527536 - DNA, 163 bp, Homo sapiens
actggtgccatcatagctcactgggggctccagctcccgggctcaagagagtcctcccacctcaaacacccacaagcagcgtggtgactacaggatctgtgccaccacttacctagctatttttttttttcgtttttttgagcacagagtgtcacatgtcgcc

SEQ ID NO: 527537 - DNA, 265 bp, Homo sapiens
gttggtggcagcagtaccctgtacactgatgtacatcgacttccaagaaaaacagcctgtggatcgtgggtaggagtcccccaggcactcagagaacacttaaagaatcctgaaatagcacagaagatccagaagctgatggatgtgggatcatgattgcaaattcggtgatgacattgtcatccccccttcccttcatgcatcatgttccaggataaggcgcatggatgggatcacatcatgcatcagctgcacctcaaggatc

SEQ ID NO: 527538 - DNA, 869 bp, Homo sapiens
tcctcacccaaggagttctgctgtacaaacaggtgatggagggcctgggtcacctttggaaacagagtgaccagctcattgggagatcatccctgtctccagagtctttacataatccagcaggctgcatgaatgacctgaccccctgattagacttggaggtggacaatagtgacctgcgcagtatggtggactgtggtgccatcttatgcttcatctaggacctgtgcagtccttgggaatcagtagatgctcctgttacaggcgtggtttctggtctagaattgctgtgaggaaaatgaggaatccctccatcctagcacgctgccaggcggtgtgtgttctagaacccttcatgtcagtacaggaatttgctggtacctcctcttcgaccatcagttcagacgtccgatgcacctctgacattatgttatcgcagaagaagtgtccgccaaggtaagtgccaaccaggtactaagtcctctccaggttggtcctgggaggctggccctgttggctccttccccatcttcacagaatacacctctggctcaagtgtttgtccctttggagtctgtttaggcccagcagcctgccgtctctcattgtgtatgaccggactggagttcagaattctgctccacttctcccagacgggagcccctgtggcgcccagaggtacaggtgctgctcttgaccatgatgagcacggtccccagcctgtctgggatatcatgtttcaagtggctgtgccaaaggtcaatgagagtgaagctgacagcgggaatccagctccaagctttcctgcattcagtcctttggatgcctccaagtgtgatatctcagatgcttgctgcttgaacattcca

SEQ ID NO: 527539 - DNA, 365 bp, Homo sapiens
tctgtggctcagcaccgtgtaagtcattacacttttagaggctgaagtaagcatgaaccctgtgagtctcaatatttcgacaccatgcctgggcattggggctaaacactgacactaacatgaattacatatttatcctagtgtgattgcgaacctgtagtcccagctactcaggaggctgaggtaagaggatcccctgagcccaggagacagagactacagtgagcctagattgtgccattgcactccaggctgggtgacagagtgagacctcattcccccccacaaaaaacgattaactttcttataattctgaaataataaaggtaaaaatctaaaatataatctaagtctagcggtgaggg

SEQ ID NO: 527540 - DNA, 289 bp, Homo sapiens
gcccattcccaaacaataagcagcccagttgccaagcccaaatacccagctctcaactggattctcatcttttcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaatt

SEQ ID NO: 527541 - DNA, 205 bp, Homo sapiens
tagagatccgcgtggttcttgcagatattggctgctgttctgctaccggcaggctcgttcagctcatgcacgctcttgccgacgtatccttgctgtcagcagtgctccagctcagcctgatggcctggttctgccgctccagctcctcatgtgcctcctgctcctcctccagtgcccgtgtcagtgacagggcccgagcctcacg

SEQ ID NO: 527542 - DNA, 191 bp, Homo sapiens
caggtactggtcctgcaccaacttagcaggcaacagtccctcccctagtggcacagggtaccagtttagtaggcctagtatgatggcgcgatgtaacacgagaaagcacataccaaggaccaccacacatccacctgatccaaaaaggccttcgattactgggataatcctatttcattacgctcagaagt

SEQ ID NO: 527543 - DNA, 159 bp, Homo sapiens
ccaccacacctggctgatttttgtatttttggtagagaccgggttttgccatgttggccaggctggtcttgaactcctgacttcaggtgatccacccacctcagccttccaaagtgcccatatggagatttttaaggtcagaggtataaactgtacata

SEQ ID NO: 527544 - DNA, 268 bp, Homo sapiens
ctggagagcgggaaggagacgctgcagcgcacggacccccgcaagacacatatgacccaccaccccatctacgaccatgaggccactctgagaagcagggccctgagcttctaccctgcggagatcacactgacctggcagcgccacggggaggaccagaccgaggacacggagcttgcgtagaccaggcctgcaggggatggaaccttccagatgtgggcagctgtggtaggaccttctgaagaggcgcagagatgcacctgccatg

SEQ ID NO: 527545 - DNA, 1000 bp, Homo sapiens
gccaagggggagtgggctgctggctgggtgcggccctgtgctgtgggccctgatgactgactgctactgaagagccaacgtgtatgggcatcccgcgtcttcctactagtagcggcgttgttatcgatggcacacgatgcctcgagctgaggtcagcgagcgtgctcgctccactggactcgggagccacatgtgggcacgcgacctccaggtctccagtccgtaaccagtgcatgagagctgctcgcgtgagggacattgcttgtaccactgtcatgagtgagtgtcggggacgcgcgtgcacgcgtggtggacgggtcgagcagagtgcagcggatgccttgggtgggcctggttgtagctcctgtgttgggcctgtgcttggagaacctgtggttcgctccgcgggtggaatgtgtgcagacagcagctacaggagttgggtaggaggtagcaccgagggaagagcaggcgattgccccggatatagagtcggaagaccatggtccctcatgagatccccgggatttgacgaggattgccagagaagggctctgtagtacgtggcttcggggagcaccttaggaatcactcgagtgagcgaaggggttccgtatcagctgacccaacgaaagtggccccggcgaggaagccaagcgcaggtgaccggacggtcggcatggagaaacactacaagctctaaacaaggtgtcctgccttgttagacttagatactattgccatccacccactacccgttaaagtgtgcaaaatagtagcaataactaatataattcttttgagaagtgtagaagaaaaagcacctggtgtgataaacgtggagtggagaggctggaggagaccgagccatagagaatgcttgttggtctgtgaacgtgaaacagagggtggaactacggggtctagatggagacggggaaggtacaggcaaggcgagtaacaggacggcgagaagagaggaaatgcatggataggggaa

SEQ ID NO: 527546 - DNA, 974 bp, Homo sapiens
  misc_feature (2)..(2): n is a, c, g, or t
  misc_feature (272)..(272): n is a, c, g, or t
  misc_feature (359)..(359): n is a, c, g, or t
  misc_feature (396)..(396): n is a, c, g, or t
  misc_feature (400)..(400): n is a, c, g, or t
  misc_feature (468)..(468): n is a, c, g, or t
  misc_feature (669)..(669): n is a, c, g, or t
  misc_feature (685)..(685): n is a, c, g, or t
  misc_feature (704)..(704): n is a, c, g, or t
  misc_feature (722)..(722): n is a, c, g, or t
  misc_feature (730)..(730): n is a, c, g, or t
  misc_feature (747)..(747): n is a, c, g, or t
  misc_feature (754)..(754): n is a, c, g, or t
  misc_feature (768)..(768): n is a, c, g, or t
  misc_feature (793)..(793): n is a, c, g, or t
  misc_feature (833)..(835): n is a, c, g, or t
  misc_feature (842)..(842): n is a, c, g, or t
  misc_feature (844)..(845): n is a, c, g, or t
  misc_feature (847)..(847): n is a, c, g, or t
  misc_feature (851)..(851): n is a, c, g, or t
  misc_feature (864)..(864): n is a, c, g, or t
  misc_feature (898)..(898): n is a, c, g, or t
  misc_feature (960)..(960): n is a, c, g, or t
anaaaaataagggtgggtgcgcttcccaaccatttaatacagagtaacagtgtaagaactctggtggaaaacagggtggggtcgggggatgacatccaactaaggaggggtccatggtctcgcctttgagtccgttgaagaggaaggcgtcctggtactccttcatgtcctgcgtggagcgggactggtccaggaagagtgagtggacccgcttgaggtaatccacctgcactcctgtccccttgcgtttccggcacaccaagctggcagcngtaatgagctggatggcgtacgcagtaacgtctccggcccgaggcgggtaagccccgtgtaggcgtcctcactcatctccacacctncttcctcgcaccggatgcggaggatctgcttcgtgtntttntcgctgttgggggtggtggagaagataagcagcgggtccagcaggcctatggggatgccgtaagggcnctggtagctggtgccccggattcgcgtaaggccacggttgggggccatgaacaggacaggggcaaagtaactttccagggcccggttgaggaaggagaagctctcgatgttcagcatgtggacctcgtcgatgaacagcacttcagggatgaactccgccttgccctcctcgcgccactaagccaccttggcattaatctnctcacggacttctganttgatctcccctgttttanctgaaaagagcgcaaggnagccctgnaaaaaaaaatagaagangtggatnttgtgcagggacanggtgtgcaccacctccttgcgtttntggagcccccatctgggcactgcacgaacttttttttttnnntcattgngnngnagtngcgggcgcgtatnaaggagcggcccaagcttggagaacttgcccgtngccttgtcgatggtgaacacgtccccggcctggaccttgttcttggtcagggactcaattancttggtgcccaggt

SEQ ID NO: 527547 - DNA, 162 bp, Homo sapiens
tcaaattggaccagagtttattaccattttggaattatcaaaaaaaattttaaattcccgtttcttaaagttttaaaaaaaatgccccgttgacacgggtccaaaagttcccatatagttaaacggatttttaattaatttttaatttttttttgaaaaagg

SEQ ID NO: 527548 - DNA, 629 bp, Homo sapiens
  misc_feature (405)..(405): n is a, c, g, or t
  misc_feature (615)..(615): n is a, c, g, or t
tcgagccggaccagacgtcattctgcatccaggatttttttttttctcttccaacttttaggttcagtgggtacatgtgcgggtttattatatgggtaaattatgtgtcacagggtgtgggtgtaccaattatttcatcacctaggtagtaagcatagtacccaagggtagttttggatctcaccctcctcccaccctccaccctcaagtcggtcccgggtgtcggtggttcccttcttggtgtccatgtgttctcagggtttagctcccacttataagtgagagcgatattgggtttttccgttccggtattaattcacttaggagggcctctagctccatccgtatggctgtaaaggacatggtctcattctttttttatggcggtgtagtatggcattcggncaagattggtaatggggggacttttttctaatagattggggtgaaagtggattttctattcgggcttttactaggctcggggaccccaggtaacctaggaattagagtaatatcggttagatcatggatttgaaatctttctttgggaggtaggcatttagaactataaactttccttttaacactgttctgctgcatcccagagaattncgtatgttatgtct

SEQ ID NO: 527549 - DNA, 336 bp, Homo sapiens
tacagtttatcctgccaggcgcaccttggcaaaacggtagcgactaaatgtctgaaacacctgggcccagacgtgtcgaggccaggccttatggacttgagcataggattttgacaaggatgccagtgtctctaggcaccagcatcctggggacagggccagagcatatgccatggacagtgctgccaggttttggatttctgccttgtgccgcaggtgagagtgagaggcacgatgacagcatagctgggcacaccctgtcacgaggggcccagcaggggctgggcagacagagctggccatgctgggagcactgcgtggaggcccttgagggcc

SEQ ID NO: 527550 - DNA, 608 bp, Homo sapiens
  misc_feature (16)..(16): n is a, c, g, or t
  misc_feature (137)..(138): n is a, c, g, or t
  misc_feature (140)..(140): n is a, c, g, or t
  misc_feature (209)..(209): n is a, c, g, or t
  misc_feature (241)..(241): n is a, c, g, or t
  misc_feature (283)..(284): n is a, c, g, or t
  misc_feature (347)..(347): n is a, c, g, or t
  misc_feature (351)..(351): n is a, c, g, or t
  misc_feature (407)..(407): n is a, c, g, or t
  misc_feature (495)..(495): n is a, c, g, or t
  misc_feature (518)..(518): n is a, c, g, or t
  misc_feature (548)..(548): n is a, c, g, or t
gcgctaaacctgcaancatcaccttcttatccatcaacatgaagaatgtcctacaatggactccaccagagggtcttcaaggagttaaagttacttacactgtgcagtatttcatcacaaattggcccaccagaggnnancctgactacagatgagaagtccatttctgttgtcctgagagctccagagaagtggaagagaaatcctcnagaagaccttcctgtttccaatgcaacaaatntactccaatctgaagtataaccgtgtctgtgttgaatactanntcaaacagaaccgtgggtcccaagtgtgtgaccaacccacaacgcctgggtgctcacctgggntggnggcgaaacactctttactgcgtacacgtggagtccttcgtcccaggggccccctcnccgtgcttcagcctttctgagaagcagtgtgccagggactttgaaagatcaatcatcagagttcaaggctaaaaatcatcttctgggnatgttttggccatatctaattancgtgttttcttttttctgtgatggggctantccatctacggatatatccacgttgggaaaagaggaacaccagcaaattttgattttgtt

SEQ ID NO: 527551 - DNA, 104 bp, Homo sapiens
gccccttatttttttttttctattcgtaaaggattcaaagcaggcacaggtggtgtacacttcaagtcccagctactagggagtctgaaggcagtctgtagggt

SEQ ID NO: 527552 - DNA, 136 bp, Homo sapiens
tgcggtccgtatagggctgtggtggttactgactgatggtagcatgaccctgtggacacagcacatattactgtgcacacagagcggatcacagcagctcgttgttgtgttcgagccctggggcccgggaaccgct

SEQ ID NO: 527553 - DNA, 233 bp, Homo sapiens
  misc_feature (52)..(52): n is a, c, g, or t
ctgcacccaccccagcgagaatccatctaaaaaaatttatccaaaaaaaaantttggggggctgtcggggggttttttaaaaacccattttaaaaccctccaaagggggatcttattttccagcccagggaaggaggccctgccctagggttaaaattgtagagccggaagaaaagagaccccagggcccccccctcttttagggtgggcctgttggggcccccctcccggca

SEQ ID NO: 527554 - DNA, 400 bp, Homo sapiens
aggctccttatgtcttgaccattgtagacattgcaagtaacacattctctacagtagcatagcccagttcaaacagtacttacatcttctgatgagtatcgtagttcacagctaggcacagagatatgcatagtcatacattatgggtaatttccagatggtgcgaatggtgtacacgcctccattagcacaggtaatggtgaccatatgtctgtttttactagtggcaagaattgtctcggacagtagtgtttgtgattcaagcaggatgtttcccaaactttgttggtaaatgatgctttcgtaagtgtgaaatcaactcatatcgatggcacgatggatcctcagataaaaaacccatgttttcccagaaacgccttcaattcagctcagtgtccac

SEQ ID NO: 527555 - DNA, 214 bp, Homo sapiens
tgtgggagtctgcattggacgcagtgttcgaagtagatgatgtacggactgggtaaaagccgcttccctcaagagtaacctacaatcttcccatgcacagatgataatacagatcttagcagaatcttgaaaagcgccagcagatcccaaaagaggccccttcgagcaccacgcaagaagatccatcgcagaaagggggttttcccccccctct

SEQ ID NO: 527556 - DNA, 365 bp, Homo sapiens
ctacaagcgcacgccaccacgcccggctaatttttttttttagtggagagtgggtttcactatgttggccaggctggttctgagctcctgacctcaggtgatccacccacctcagcactttgggaggctgaggtgggaggattgcctgagcccagaaatttgagaccaccctgggcaacacagtgagacctcatctctactaaaaggaaaaaagaactagctagatgtggtggtatatgcctgttttccagctattcgggaggctaaagcgggaggattgcttgagcctgagagcggtaggttgcagtgagccgtgatcacgcctctgcatctctgcctgggcaacagagtgcgatcctgtctct

SEQ ID NO: 527557 - DNA, 692 bp, Homo sapiens
tggtgaatcacctgaggttagaagtttgagaccagcctggccaacatggtgaaaccccatctctactaaaaataaaaaaattagctgcgtgtggtggtgggtgcctgtaaccccagctacttgggaggttgaggcaggagaatcgcttgagcccaggaggtggaggttgcaacgtgagccgagattgcgtcattgcactccagcctgggcgacaagagtgaaactctcactctccctcgaaaaaaaaaaaaattgtggatcctgtttgggtcccccggtgggaatccgtcttttctgacgtttggccgttgtttcccctcatcccccaggtggctagtaaattctcttcccctcgtgccttgcacccgtgttgcccttagctatagcctgggccgcctcacttgccgtgtcctgcattcagcccagccacagagtcctacaggtccggggcttgcttgtggaaacggcattgtcttctaaactctgggggcgggggctggggtgtgttcccttacttgtaaagggtcctgtggttggggagcagggagtaatggggatgaaaacgctgtgtgaaggcggcagcaccctggtatggggtaacgccctgtcccctcattgcaggtggttgggcatgaagcatcaggccagaggtgtgagtggcaagcctcacccaaattgctgtcctgttaaag

SEQ ID NO: 527558 - DNA, 1213 bp, Homo sapiens
  misc_feature (253)..(253): n is a, c, g, or t
ggcacgggccgcgactgcatgaatgaacgcagcactatacacggttcccactcgcggatacaggctggtccccagcatgtattatgctgctcatgactgaccatccagctcggttatgagaactgaaatctagaatcacagtgcggcacaatcaatcattacatgtgcgtcgcgtaaaccgggccatctcgatgtgcacgtctttccggcatatggcaatgcgtcgcgaggagccaatctgtactccgtgtcnactctaacatgacctatactgcgtgagcccgtagaccaagccatccgcatttcctgtggagttgagactacctttacgttgacactagacactaaggcaatgaatgcatcactcgaaggacttcagtgctagtaattatattccaacactgttcgctggtagtagcagctctggaccactaggctggtatccattcgtatccatgacaggcctacctaactgctagctcgtcatcagcgcatatctaatagtagaccctgctaaattctatgctgcgactctggtcatcgccgctgtagctctacgctaattccggatggaatagtgtcgttgggcacacaggcggcctacgggcaaagcgaagcgatcacggtgcagataatgtcacatacaccagcgtgaagggtcggcactgctctcctcgacaggcgtacctctcatgggaaccaggtgtgacaagactgacgtgggggaaacaaacctccacctgacaggtacacttgtcaacgccaggcaaaggcagcagcggggcgacactaaacgcttggacagcccacgagccataggggaccacagcaaggcacacggcggcactagcccccaagagggaacacggaggacaaagaaaccacacaggcagacgaacacacaccacttaaccaatcgaacgtagcaacgatactagaaacacaagttgcaccgcgatactataccacaagggctgggtcgactacgcacgtcgccagaacgaaaaacattcacaagcccaacgtcaggcgccgtaagacatgccacaaaaagcaggtgcaaatagacgtagacactactacataagacaaacgaaacgcgaacaagcagagcgactacaaaaagcatctagactaccacgtccccgctccctacgctcgtccgtctctcacacgctctcagcaacgaaagcacaaaagcccagagaaaaga

SEQ ID NO: 527559 - DNA, 327 bp, Homo sapiens
tccccaagcccccatctggtctaacactctgtaattagccaggcagagtcctgctcaagtgccactcatttgaagcatgaccaatgcaatccagctgaaagctaaagcaggcagcaataaattctcttcatacagtaggtttcctagagtaacctggtattccagtgtttcccaaacagtgttccctggaaccctgtcccataggttggcaataggagaagtgagagaagaggattctgtgtcaagaaaagttggcaaacattgggtttagtaaagttaaatagggttcttttgctcaaccgtgctaataaactcactaataaattc

SEQ ID NO: 527560 - DNA, 115 bp, Homo sapiens
aaaaaaaaccgacaaaagacaaagtggggggcttttgttgtttacaaaaaagttctaaaagctgtgtaaacagttttttatgaaaaatattaaaagactttggtgatgacattta

SEQ ID NO: 527561 - DNA, 739 bp, Homo sapiens
gggagagtagacagcagaacatgctggcggaggctaagcagagactgtagatagctggcgacagggcgacgacgtgcagcgattgctgtgtgctggggccagcccctgggactcccgggtgcaggaggacccgtgtcccgggtcctggcgctggcatccctgtggcaaaatgcgtggaggaacgcttgaaggaaatggatgtgcgtgagatgggcctgttttgagcatgtgaagttctcgggggctccagtacctggaatcccaactgcttgtgcctgctggtgccccactgtccccactggtccccaatgtagaagcgatgcagtgtcccagctggctcctgtgatccgcccaattatctgctgacaacacataccatgcatggtccagcagactctggaggcccgatgcagctgctgcaattaccacagtagttcctcccatggtgggtggccctccttttgtatgccctgttggctttgggcccctggtgatctgtagtcacccttggtaacaggcaccaagaggggcttctatgaaaatgccatttgtttcccttgcaggatagtgccaattacagtgcctgggcccccacggccataattcaagttgccaatattatgctccccccatatgatcaagtcgatcagtctggtattgcactcacacatcgtgactacttgtagtcacaccaaatgtaactctcaccccaatgaatgacgtccacataccactatgc

SEQ ID NO: 527562 - DNA, 531 bp, Homo sapiens
  misc_feature (229)..(229): n is a, c, g, or t
  misc_feature (317)..(317): n is a, c, g, or t
gggaggcggagctgcagtgagccgagatcgtcccactgcactctggcctgggcgacacagcgagactccgtctcaaaaaaaaaaaagattttaatagaggaagtgactattactcagataaacagagactactctgcccaatttcaaattatgaaaatctctggataggcaaacgggaaaagctagtagggcggcggtaaagtggtcctttccagtatctctcacggtncatactcacagggccagtgggcctctcaaatatcccattctggccagcctcaaaaaccgggtgcagctctgccatgaagtctcccggnatggaatagggtgtgaggggaaagggaaatgggttggcaccaaccttcggtgttccataagccagggacctaggaaaaataaatacaacattaggggagctctctcagggtccaggaagaaggggcttgaaatctggggcattatttaagagcagtctccacattttttaccaaatttctcctttttcgtgcgaagcagagccatgtctctcca

SEQ ID NO: 527563 - DNA, 860 bp, Homo sapiens
gtaatgcaacagccggagtggagagtgtctgttgaagctgctgctctttcactctctcatggcgtctaccgagagctcagcacccagggtgaacatctgataccattggcgcaacgaagtggacaagcctgatgcagtctgttgacatgttttccaaagtcctggagcatcagctgcttcagtattaccaaactggtggatcggaacatgggggttctgacagttccataatgctgggatcagatggatgaggatgaattggaacgcctgtacagatgagagactccaggcgactagaggaaagctcacacaatgcagcaagacaatagcacatggctttcctagaagggacatggggcaaatacagagaaatccctagtgaacgagactttccttctcagagatagtcacggcagtacgtgcccatgtggtgtgcccatgtcctacacgaggacgtccacattcgaggtgtagagagactagtagagacatctggcaatattgtccacagaaactaccgtcgtagagcaggattttgaagctgaatgtcggaaataagcacctgttcccttgtggtgaagagacattgcataattcaaagttcattcccatgacttagcaactgctactcagatgggaccaacatgccacgatcatgttgctggggttacctgccctatgcacttacccgatgacttcacccacaggcacgccttcccacacggcgcgcgcgggctcttgacactcctgcactacacagggaagattccataggacggcgcgccattcacacacccacacgccatgcggcaccaaccttcaacttcgtggaaaagaacacccaccgggacacgaccact

SEQ ID NO: 527564 - DNA, 757 bp, Homo sapiens
gatggtcacgatgcaggcgctatagtatggtccgtacagaagacgcttactgtcaccctagtcataagaatgagtcgttgatcatcctggtcatgatcacggccctcataagtcatgtttcctgtagtctgctgttccgtagtccgggtatgccctttgtgctaacattcacaaaaaaagtgaagtaatactaacatctcagactctcaggagatagaaaccgtgctgaagctatcctgcccgacagtcatcctagtccttcatcgaccgtcccatccctacgcgatcctttatataacaagacgaggtcaacggatcccttccctttacctatcaaactcaattggggcacacgagatggtactgaaccgtacagagtacagccgattacaggctggacgtaatctttcaatctccttgacatactttcccccgattgattggctagaaccatggcgaacgtgcagacgtccgttgaccgttgacaagtcgacgtaagtactcccgatatgaagagcccccattcgtataataattacatcacagagatgtcttgcactcatgagctgtccccgacattgaggcttaaaaacagatgcaattcccggaccgtcgtaaaacaaagcacgtttcaacgctacacagacggggggtatactagcggtcaatgctctgaaatctgtggagcaaaccgacagttgtcatgcccatcgtcctagaattagttccgcctaataatctttgaaatcaggggcgg

SEQ ID NO: 527565 - DNA, 217 bp, Homo sapiens
  misc_feature (111)..(111): n is a, c, g, or t
  misc_feature (178)..(178): n is a, c, g, or t
tgcacgaaatactgacctctgggacagggagctttgaatatgcctctgtagtgatttgtatcatttacctctttatgctgacttcctgttatgtggaattgctctactctntcctagttcttccatcacaagtgcttcctgaaccacagactggaccagaattcttggtgataagctntggtttggcccagggtttcttgatctcagcactattaac

SEQ ID NO: 527566 - DNA, 806 bp, Homo sapiens
agcggatgcagagcggctggggaactggaccagcagtcccgctgcaggctgatctgagcaaagcctctggcccaccgtacagtggccttcctgatgccctgctggtctgcgtcttcgtgaatgggctcctgtggttgaccatcgaatgggcgtctgggtagagctgcccctgctggtgatggcagctgcccggagggctggtacgctgccgctcctacctcgcggtggtcatccagctggccaatatcgggcccctcctggtcagcctgctccatcacgttccggcccagctgcgctttccgaagtgcccatgatcttcagcgcctggctcgggcgtgggagatccgtcaaccgtgcatccatcgtttgcctgtcactctcggagatatgagcctccgtggcgtgcgtggcatcggacacgcacagcgagtcgccttcttggtcctcaccttcttcctggccctggtggactgcacctcttcagtgaccttcctgccgttcatgatgccggctgcgccaccgtactacctcatcagcttcttggtgggtagaaggactcagtcggcctcttgcctgccctggtggctcttgcccagggctccggtctcactacctgcgtcaatgtcactgagatatcagacagcgtaccaagccctgtacccacagagggcagactgacatcgaagcagggagttcccagagcttcggatgtccggcctccccggcaatggaagcagccttgtcccgactggagagccgatacctgccgcccacttttcaccctggtcttcttcctcctcctatcc

SEQ ID NO: 527567 - DNA, 470 bp, Homo sapiens
  misc_feature (177)..(177): n is a, c, g, or t
  misc_feature (288)..(288): n is a, c, g, or t
agcgggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcgggaggtctttgtngtgttgcttctctgcattcccttcatttctcctaaaagagtggcagaagattttcaagtcccggctggtggaggtggttagtgtcctatggcaagcaccttctttgtggtnctcagtgtcatccttgtgctgttggtcatcgatgccgtgcgcgagaattcggaagtatgatgatgtgacggaaaaggtgaacctccagaacgaatcccggggccatggagcacttccacaggagggtgggtggagcaggtggactggagtttttcttgagggcaataaaagttgtcatggtg

SEQ ID NO: 527568 - DNA, 618 bp, Homo sapiens
tggcagttttaacttttatttaaacaaaaaacgtgtgcacattgagcgtgccatacttcatttttctttcactgtgcgcagccgtggcattgtggggttgtgggtgacctcgtgagtggccagttggggacagctctttccacgagtggcttggcggttctgggaggaaacattgtgtgtgagcgactctcggacacagataaaattgtttgtgcacattcagcagcactttccagctctcctttgacgtttggtggaccaggaactttccggaagccactgtgggcagccatggtgcttgggttttattgggtgtgctctccatataaccacagtggtggggcatctcaaaactcgtgggcccttggaatctcttctcatagcgaaacccgtgttgtgtctcaatgtgccttctgggggtttctccggccgagttatacgccttataaattgtgtgaccattattcgggtctagacgggggtgccgagatatagaactctcttgggggtctcctctttttgagaccagactcttgggggctctcaccaagcggggctcttgaggcgcggccaattgattgccagaaaaacggacagagtggtgtgccaccttccgat

SEQ ID NO: 527569 - DNA, 1311 bp, Homo sapiens
  misc_feature (177)..(177): n is a, c, g, or t
  misc_feature (288)..(288): n is a, c, g, or t
  misc_feature (595)..(595): n is a, c, g, or t
  misc_feature (599)..(599): n is a, c, g, or t
  misc_feature (803)..(803): n is a, c, g, or t
  misc_feature (867)..(867): n is a, c, g, or t
  misc_feature (978)..(978): n is a, c, g, or t
agcgggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcgggaggtctttgtngtgttgcttctctgcattcccttcatttctcctaaaagagtggcagaagattttcaagtcccggctggtggaggtggttagtgtcctatggcaagcaccttctttgtggtnctcagtgtcatccttgtgctgttggtcatcgatgccgtgcgcgagaattcggaagtatgatgatgtgacggaaaaggtgaacctccagaacgaatcccggggccatggagcacttccacatgaagcttttccgtgcccagaggaatctctacattgctggcttttccttgctgctgtccttcctggttaagacgcctggtgactctcatttcgcagtcaggccacgctgctggcctccaatgaagcctttaaaaagcagggggagagtgctagtgaggcggccaagaagtacatggaggagaatgancagntcaagaagggagctgctgtgacggaggcaagttggatgtcgggaatgctgaggtgaagttggaggaagagaatcaggagcctgaacggctgacctgcagaagctaaaggacgagtctggccagcactaagcaaaaactagagaaagctgaaaaccaggttctggccatgcggaatcagtttgagggcctcaccaaggagtacgnccgctttgctggaggagcacgcaaagctgcaggcttgcagtagatggtcccatggacaagaagnaagagtaagggcctccttcctcccctgcctgcagctggcttccacctggcacgtgcctgctgcttcctgagagcccggcctctccctccagtacttttgtttgtgcccttntgcttcccccattcccttccacaggtcatagctcgtcatttcggcccttgtccacactctccaagcacattacaggggacctgattgctacacgttcagaatgcgtttgctgtcatcctgcttggcctggccaggcctggcacacccttggcttccacgcctgagggtggagagcacgagttagttgtagtccggcttgcggtggggctgacttcctgttggtttgagcccctttttgttttgccctctgggtgttttttttggtcccgcaggagggtgggtggagcaggtggactggagtttttcttgagggcaataaaagttgtcatggtg

SEQ ID NO: 527570 - DNA, 80 bp, Homo sapiens
accttgcttacttctgagggctgcagctccgcagtgtggaagccgataagaaaaggatttgaagcattccagccaaaatg

SEQ ID NO: 527571 - DNA, 1258 bp, Homo sapiens
  misc_feature (177)..(177): n is a, c, g, or t
  misc_feature (288)..(288): n is a, c, g, or t
  misc_feature (595)..(595): n is a, c, g, or t
  misc_feature (599)..(599): n is a, c, g, or t
  misc_feature (870)..(870): n is a, c, g, or t
agcgggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcgggaggtctttgtngtgttgcttctctgcattcccttcatttctcctaaaagagtggcagaagattttcaagtcccggctggtggaggtggttagtgtcctatggcaagcaccttctttgtggtnctcagtgtcatccttgtgctgttggtcatcgatgccgtgcgcgagaattcggaagtatgatgatgtgacggaaaaggtgaacctccagaacgaatcccggggccatggagcacttccacatgaagcttttccgtgcccagaggaatctctacattgctggcttttccttgctgctgtccttcctggttaagacgcctggtgactctcatttcgcagtcaggccacgctgctggcctccaatgaagcctttaaaaagcagggggagagtgctagtgaggcggccaagaagtacatggaggagaatgancagntcaagaagggagctgctgtgacggaggcaagttggatgtcgggaatgctgaggtgaagttggaggaagagaatcaggagcctgaacggctgacctgcagaagctaaaggacgagtctggccagcactaagcaaaaactagagaaagctgaaaaccaggttctggccatgcggaatcagtttgagggcctcaccaaggagtaccacctggcacgtgcctgctgcttcctgagagcccggcctctccctccagtacttttgtttgtgcccttntgcttcccccattcccttccacaggtcatagctcgtcatttcggcccttgtccacactctccaagcacattacaggggacctgattgctacacgttcagaatgcgtttgctgtcatcctgcttggcctggccaggcctggcacacccttggcttccacgcctgagggtggagagcacgagttagttgtagtccggcttgcggtggggctgacttcctgttggtttgagcccctttttgttttgccctctgggtgttttttttggtcccgcaggagggtgggtggagcaggtggactggagtttttcttgagggcaataaaagttgtcatggtgaaacaaaccccagccatcaccagccgcacccaccccggccttctgcgccaaccac

SEQ ID NO: 527572 - DNA, 412 bp, Homo sapiens
ggtcccggtaaactgcactgacacacattcgggaacgccgggagcgcaggtcattcctgtgggaagtggaacccgcagggtcctgtggagaactagcttggaatgctgtatgactagacacgaaacagtactctcggtaaaccacccagcacgtgagacctcgtcatttacccactggaaatctcctgcccacacaaaaacctgcacccggatgttgatagcatctttcttcataattaccaaaacctggaagcgaccaagatgcccttcagtagataagtggaaaaataaaccgtggtgcatccatactggactattatccagtactgaaaagaaatgagcagtcgggccaagagcaggcacatgggagaagcatcaagtccctgttactaagtagagaagcccctctgac

SEQ ID NO: 527573 - DNA, 1366 bp, Homo sapiens
  misc_feature (177)..(177): n is a, c, g, or t
  misc_feature (288)..(288): n is a, c, g, or t
  misc_feature (595)..(595): n is a, c, g, or t
  misc_feature (599)..(599): n is a, c, g, or t
  misc_feature (803)..(803): n is a, c, g, or t
  misc_feature (867)..(867): n is a, c, g, or t
  misc_feature (978)..(978): n is a, c, g, or t
agcgggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcgggaggtctttgtngtgttgcttctctgcattcccttcatttctcctaaaagagtggcagaagattttcaagtcccggctggtggaggtggttagtgtcctatggcaagcaccttctttgtggtnctcagtgtcatccttgtgctgttggtcatcgatgccgtgcgcgagaattcggaagtatgatgatgtgacggaaaaggtgaacctccagaacgaatcccggggccatggagcacttccacatgaagcttttccgtgcccagaggaatctctacattgctggcttttccttgctgctgtccttcctggttaagacgcctggtgactctcatttcgcagtcaggccacgctgctggcctccaatgaagcctttaaaaagcagggggagagtgctagtgaggcggccaagaagtacatggaggagaatgancagntcaagaagggagctgctgtgacggaggcaagttggatgtcgggaatgctgaggtgaagttggaggaagagaatcaggagcctgaacggctgacctgcagaagctaaaggacgagtctggccagcactaagcaaaaactagagaaagctgaaaaccaggttctggccatgcggaatcagtttgagggcctcaccaaggagtacgnccgctttgctggaggagcacgcaaagctgcaggcttgcagtagatggtcccatggacaagaagnaagagtaagggcctccttcctcccctgcctgcagctggcttccacctggcacgtgcctgctgcttcctgagagcccggcctctccctccagtacttttgtttgtgcccttntgcttcccccattcccttccacaggtcatagctcgtcatttcggcccttgtccacactctccaagcacattacaggggacctgattgctacacgttcagaatgcgtttgctgtcatcctgcttggcctggccaggcctggcacacccttggcttccacgcctgagggtggagagcacgagttagttgtagtccggcttgcggtggggctgacttcctgttggtttgagcccctttttgttttgccctctgggtgttttttttggtcccgcaggagggtgggtggagcaggtggactggagtttttcttgagggcaataaaagttgtcatggtgaaacaaaccccagccatcaccagccgcacccaccccggccttctgcgccaaccac

SEQ ID NO: 527574 - DNA, 827 bp, Homo sapiens
  misc_feature (388)..(388): n is a, c, g, or t
  misc_feature (600)..(600): n is a, c, g, or t
gattaggagacaaggattcaccatgtggcaggctggtctcgaactctgacctcaagtgatctagcgcacctcggctcccaaagttcaggtattacaggcgcgagcaactgcaccaggcagtatagactgtatttctactactttttgggctttggaacaaattcagtggttatacagcttggagatcagaaataatttattagctcattacctgtaaaggagcacaagttagtcctgtggggaacgtttgaagtcttggagagaagatctgccttttggtaaataactgggcaacaggaagacatcctgcctcttgtacccccataccacttcctgttgaattagcattagtattaactgcctacagaaaaagcagtgctgaggcttngcagaactagcaggagccgaaagagaactgtggggccctttgggtcaaaatgggtcatctgccatgggaatagatgttgaagaacacatcaaactttggaaggtgcttcctatggcccatatgaaaccagtgtgagatgctggggtttgcacgggaatcagctgtgagtgcttatcagggggtgatgggtaaacccaggccatgtgacttcncaaagcctcttcttagcttataacagtctgggtcaagttttctttaaaagtaaaccagcaagttttgccatctgcctttgtttgagaagagatgggacactcataaaaattgcttaaaatggaagtgggcagagaaaccgttggcagccagccagggaaattttctttgtaaagggcatgtaagcgagaagcttgttctgggacaaaaaaagggaagagttcgatta

SEQ ID NO: 527575 - DNA, 1396 bp, Homo sapiens
  misc_feature (262)..(262): n is a, c, g, or t
  misc_feature (373)..(373): n is a, c, g, or t
  misc_feature (680)..(680): n is a, c, g, or t
  misc_feature (684)..(684): n is a, c, g, or t
  misc_feature (888)..(888): n is a, c, g, or t
  misc_feature (952)..(952): n is a, c, g, or t
  misc_feature (1063)..(1063): n is a, c, g, or t
agcggacgttgactgtgggaaactcggtgacgcgggctccgcgcgccgggctgggctccgggaccgcggaggctccccggaccactcgacgacgggacgagaggcgagcggcgcggggaggcccgggggccggggaatctcggggcccgcagcctagctgcgtgaaacaagctcacatcttcctgtgggaaaccttctagcaacaggatgagtctgcagtggactgcagttgccaccttcctctatgcgggaggtctttgtngtgttgcttctctgcattcccttcatttctcctaaaagagtggcagaagattttcaagtcccggctggtggaggtggttagtgtcctatggcaagcaccttctttgtggtnctcagtgtcatccttgtgctgttggtcatcgatgccgtgcgcgagaattcggaagtatgatgatgtgacggaaaaggtgaacctccagaacgaatcccggggccatggagcacttccacatgaagcttttccgtgcccagaggaatctctacattgctggcttttccttgctgctgtccttcctggttaagacgcctggtgactctcatttcgcagtcaggccacgctgctggcctccaatgaagcctttaaaaagcagggggagagtgctagtgaggcggccaagaagtacatggaggagaatgancagntcaagaagggagctgctgtgacggaggcaagttggatgtcgggaatgctgaggtgaagttggaggaagagaatcaggagcctgaacggctgacctgcagaagctaaaggacgagtctggccagcactaagcaaaaactagagaaagctgaaaaccaggttctggccatgcggaatcagtttgagggcctcaccaaggagtacgnccgctttgctggaggagcacgcaaagctgcaggcttgcagtagatggtcccatggacaagaagnaagagtaagggcctccttcctcccctgcctgcagctggcttccacctggcacgtgcctgctgcttcctgagagcccggcctctccctccagtacttttgtttgtgcccttntgcttcccccattcccttccacaggtcatagctcgtcatttcggcccttgtccacactctccaagcacattacaggggacctgattgctacacgttcagaatgcgtttgctgtcatcctgcttggcctggccaggcctggcacacccttggcttccacgcctgagggtggagagcacgagttagttgtagtccggcttgcggtggggctgacttcctgttggtttgagcccctttttgttttgccctctgggtgttttttttggtcccgcaggagggtgggtggagcaggtggactggagtttttcttgagggcaataaaagttgtcatggtg

SEQ ID NO: 527576 - DNA, 180 bp, Homo sapiens
ctggtgagaagtcttcagacgtttagtcaagcttggtttacttgccggagtgctacaggggcaacctgggtttccatccacaacttcaatattaattatcgaatcccagtgttctgtcagcgcgctcaaccagggtcaagtcttggattggaggcaggatcacaggctcgggtcgctgca

SEQ ID NO: 527577 - DNA, 137 bp, Homo sapiens
tttccagacttagttggaggcagactctctccctctcttcttcttcactttcttggagaggcaatttgtcatggattacattttcaaagcctttataaatgtgaattccagtgtggagagagccagtgtggagagag

SEQ ID NO: 527578 - DNA, 445 bp, Homo sapiens
ctctgaaaaggcgagtccattcacatctctgcgaatcagaatctcgaagtgtattctttgtagcctggccagataaatgtgtgaggctgcttagtggattgatgttcagaaaccggcttgatacaaatgtaggtgtacactcagtttcacatgatcaacaacgtagagtaaaagcactctgctagataccgtgaggaagtaaagatcaatcagggttggaccctgctaaagggataagatcaagtgggcaggagtggattcctaaaacctcctacacctcctctcctctactggcttttcttcttaaagagctgagaagactgaagtggtctgaagataaatgcggctccaccccgagcattgctacaatagcctctgtcttcccacctatcgccagctcctcttagagccaagccttgatttatgccccggaggttataggcat

SEQ ID NO: 527579 - DNA, 342 bp, Homo sapiens
aggatctggcccttgtgtctgcacgctcgtgagtgatctactatgacgctgggcattgcctgtacatcggtccaggttttcaggtcacgggattcgctggcgcgcacgccaatgccgaacaccacgatgtgcaccagcaccacaagcccgagcaccagccagagcaggccacgagatttacggcggggtgaacctggattggaaaacggaagtggacatttcataccccttgaatggcggtggtcgcaagcgtggtgtgctgacgccgcccgtgctcaagactgcaacctcagcggaaaccaggaacaacgtggcaatggttggcaaacgccaggcctgcca

SEQ ID NO: 527580 - DNA, 580 bp, Homo sapiens
  misc_feature (1)..(1): n is a, c, g, or t
  misc_feature (29)..(29): n is a, c, g, or t
  misc_feature (51)..(51): n is a, c, g, or t
  misc_feature (66)..(66): n is a, c, g, or t
  misc_feature (87)..(87): n is a, c, g, or t
  misc_feature (112)..(112): n is a, c, g, or t
  misc_feature (127)..(127): n is a, c, g, or t
  misc_feature (143)..(143): n is a, c, g, or t
  misc_feature (145)..(145): n is a, c, g, or t
  misc_feature (161)..(161): n is a, c, g, or t
  misc_feature (166)..(166): n is a, c, g, or t
  misc_feature (207)..(207): n is a, c, g, or t
  misc_feature (212)..(212): n is a, c, g, or t
  misc_feature (232)..(232): n is a, c, g, or t
  misc_feature (259)..(259): n is a, c, g, or t
  misc_feature (362)..(362): n is a, c, g, or t
ngaaggccaagggatttggggagaatttngaagtgcaaatttgtttggttnggattccggaaaggnggagttatgagattgggcagngaacatatttaaggaattaatggangaaacttggcagaantaaagaaaggttcaantntggagattgtcagtgnttgtngagtacttagtaaaattgatgaaaagagatgattcttaganacatnttggtgaaattttggaattntagtgataaagagaaaataataagggnttttagagagagaagagaaattacctaccaaggaacaagaatcaggttgacagcagacttatcactggacacactggatgctagaagtaaatggagcaatgtnttcaaagttctgctggaaaaaggctttaatcctagaatcctatatccagccaaaatggcatttgattttaggggcaaaacaaaggtatttcttagtattgaagaatttagagattatgttttgcatatgcccaccttgagagaattactggggaataatataccttagcacgccagggtgactacaaacaatatgctttcctcccccagcatgcatcc

SEQ ID NO: 527581 - DNA, 428 bp, Homo sapiens
cagagcaaatggtgactccctcccaccagaaggatactgccatgtctgtgcattgtggcatgccctgcacgtgttttagcaactgatatgtcagagtacggctcctctccccacattgaggttgatgcagcatgcttctgtttcattccactgtcccgagtcattgtctaaagacaccagcggccactcccagtaacactggtagctctagcatggtagtatcaatgactaaagcaatcagaatcagcaggacttcctaatttttattgtgttactgcaagaggatcgggcagaaggctgtaatgttcagtacttttatgacaggctatttaatgtccagttaacttctttcttaattgggaataatagctaagtaccatatcttatagtctgactaactcaaatcttatttaaaaggcttaactttg

SEQ ID NO: 527582 - DNA, 272 bp, Homo sapiens
ctgtgctttttccttctcagattcgcctgtcctgttcttgacaggagtcatcactactgacacggcctagcgcacagactttcccaatctaattaaggtatgctgtgtgaggtgggtgggatcgcaaaacgccttcacacgtttcctggctgccgtgaagggggaacccctactctcactttaatgacgtcccaggacatggcatgattgtttgtgcataacgggaatctcccaaaccgaaaaggcaaaactttcctcctctcttccagcgc

SEQ ID NO: 527583 - DNA, 483 bp, Homo sapiens
attatcgcccaacctacataacagtacttcacgtgactctcttggtatgtacattctatgggttcggatataatatatagtgacatgtatccacccttctgtctcctacaaacatagtcgcactgtcttacaaatcctctgcactctgcctatgtatccctccttaccctcagcccctgacaaccactgatcttttaatgtctccatagttttgcctataaccagaatgtcatatagtaggaatcatatgattggcttctttcacttagaaatatgcatttcagttacctccatgtcctttcatgtattgatagctcatttctttacagtgctgaataatgttccattgtctaggtgcgccataatttattctttcacctactgaagagatatgttggttgcttccaagttcgggaaattatgaatcaagctgctataaatatcagagtgcaggttacagaacagatatatgtaatgaactcc

SEQ ID NO: 527584 - DNA, 231 bp, Homo sapiens
tagctcctaactatagtaagttgccacgagggtcccaggcagagctgcagagctggaaccggaggctccacagtccttgcctgctcataggacctaccttacagagcacctttctaacagactaggactagcccagctaccgtaggggtaggcatactaggttatctaggtagctaattctagcccaaggttaatacgagctacctgcgctcatagtattccaaacatttc

SEQ ID NO: 527585 - DNA, 499 bp, Homo sapiens
gatgctctgtatccggcatgtgctgtatgccagcggcagcccatcgctgtctactggtcgattgaacgagactgtccgaattgctgtacacccttcggttaccgagaccctggggtgctgccttgggggcgcagctggaggaggaggaggaggactgtaggaatggagtcacaaaggccttcacagaagtcacccagacatgagctgcaggaccctcacccttcccgggaactgccctggcccatgcaggccagacgggcactcatggcaaagaaatgccacgcagagaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgcgctggcctacagcacatg

SEQ ID NO: 527586 - DNA, 207 bp, Homo sapiens
  misc_feature (30)..(30): n is a, c, g, or t
  misc_feature (99)..(99): n is a, c, g, or t
  misc_feature (108)..(108): n is a, c, g, or t
  misc_feature (149)..(149): n is a, c, g, or t
  misc_feature (169)..(169): n is a, c, g, or t
  misc_feature (179)..(179): n is a, c, g, or t
  misc_feature (206)..(206): n is a, c, g, or t
ctgaagtggagagatcgcctgagcccaggnggtcaaggctacagtgagccgtgactgcaccactgcactccaccctgggcagaggtggaggagacactnaagcgactncagagccagaagggagtgcagggaatcatcgtcgtgaacanagaaggcattcccatcaagngcaccatggncaaccccaccaccacccagtatgccanc

SEQ ID NO: 527587 - DNA, 840 bp, Homo sapiens
tggagcggggcaaatcgtttaaggtgtaaaagtaggccaacgggggaggacaaggtcccaaaacccagcctttctccggatgcccgccgggacctgtgtgccggggccagtcccttgcctgcccaaagcctggaggcccagaagctcccagagaaggagggggaaagaaggtgggggggtggcagctcagccccacagagtacagggaggaaacaaacaggggcgtagtggaattaagcctggtgaaaaatccatctcgggagtgtggaatccatgaagttcttcagaatctccggtgcttcagtccgtcgtgaagtgggaagccccagggactcctgtcgcgggtcgatacagtcatcttgtgccaccaggcggggaagtcaataaggggtcgcaggtcggacagttgggaagtcctcagggataaatcttcgtggggtgatggactcgtcagggtcatgggaccaccagggggaatccaccactccatcttatggatctcctgccagaggcaaagtacaccacctgggccgcctcaagggaggccaaagagtgtctcactccgaccgtcacacatcgatggaggaggtccccactaaaaggatgtcgcggggtggcccctgtgaagccccacccggagaggttgccgccagtggaatgtccaccacacaaggtccgtccccctttcagccggagaagttctcaacagaaagggggcccgtcaggccacagtcccgaaagggttcgggtccacagcggaaactgggacagtcttggcccgcgacaagagggggacaagacctaggcatcacaaacgccccaaatccaagaatgggtcag

SEQ ID NO: 527588 - DNA, 208 bp, Homo sapiens
caaacacgcagcacacacgttgcacacgcaagcacccacctgcacacacatcagtgcgcacacacacgcacacccccacaaatattggatgaaaacaatagagtatatctaacgcaaatacagatatcgtgtagtggatcagggccaagatgtccgcgtctttagtagtgacgcaggggtggggtgtacccgacgtctcgattcttcg

SEQ ID NO: 527589 - DNA, 2114 bp, Homo sapiens
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttcttcccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctcccacctttacacatgcccaggcagcacctcaggccctttgtggggcagggaagctgaggcagtaagcgggcaggcagagctggaggcctttcaggccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgcgtggcctatccactcctcacatccacacactgcacccccactcctggggcagggccaccagcatccaggcggccagcaggcacctgagtggctgggacaagggatcccccttccctgtggttctattatattataattataattaaatatgagagcatgataaggaaaa

SEQ ID NO: 527590 - DNA, 171 bp, Homo sapiens
tagggccataatctctagtggccactctcccgtttcctttctccaagatcttaaccctgggccatttgaaccctagttacttctttcttttgttttgttttggtttattggtttgtttgttttgagacgaagtctcactcccgcctgggcgacagagcgagactctgtctc

SEQ ID NO: 527591 - DNA, 395 bp, Homo sapiens
  misc_feature (73)..(73): n is a, c, g, or t
gatccccgtcagggtttccagcaagggcaccctcatcccttgtgcaggtgagaggcggcagaccacgccgaancaggtcacgcgggccggcggctgatgaggtgttggatcccaggcccctctctcgcggtctctctcgtctctgccgtctctatctgtgtctgtctctgtctctctctctgtctgtctcggtctgcctgtctctctttatctgtgtctctttctgtctgtctgtctctgtctgtctgcctttctctctccctctctttctctctgtgtctctttctgtctgtctgtctctgtctgtctgcctttctctctccctctctttctctctgtgtctctttctgtctgtctgtctctgtctgtctgcctttctctctccctctctttct

SEQ ID NO: 527592 - DNA, 111 bp, Homo sapiens
cattcattgtctgctcgtggcctgtggctgcagggcaggtgcacgcctgccgttcccggcgccggcgcagcccagctggcaggctcatccatggacgtgtcatcttcgggg

SEQ ID NO: 527593 - DNA, 494 bp, Homo sapiens
  misc_feature (219)..(219): n is a, c, g, or t
  misc_feature (242)..(242): n is a, c, g, or t
attgttaaaagaaaaaagtaaggctgagcgcggtggctcatgcctgtaatcccagcactttggaagggtgaggctgaggtcaggagttcgagaccagcctggccaacacggtgaaaacctgtctctactaaaaataaaaaaagttagccagtcgtgatagcgggcgcctgtaatcccagctactcgggaggctgaggcgggagaatcgctcgaacccanaaggcggaggttgcagggagcanagattgtgccactacactccagcctgggtgacaagaacgagactccatctcaaaaaaaaaaaaaaaagtagcaaaaaattcaaacatagaggcctatagaataaaaacacacctcagatcacacacctttttttagaggtaacccctccaaacactctggattatatacccttcagaatttgtgagaagcacatgttcatagttagcatttggagtacctatgaaatgcccggcacatagttttgcttttgg

SEQ ID NO: 527594 - DNA, 207 bp, Homo sapiens
gttttttttcccccccccccccccccccttttgctttttttaaaccccccgggggccccagggtttttttaatgttttttcccaaaaaattttgaaaattggggttttctccccgttccccccccaattttttttgtacggtaaaaaaaccgtttttttttttctttggccccccccttttttatggatttttaagggggtggggga

SEQ ID NO: 527595 - DNA, 134 bp, Homo sapiens
cttgagctgtggtttccctatctatagaatgggaatcaatacctcatggggttgttgtaacggtgacaatttgtcacctgccaagagcagtggttggcatatattaagtaataaatggtgattataggcttttt

SEQ ID NO: 527596 - DNA, 884 bp, Homo sapiens
ggcacccctctgacatccggctgttcttctcacatgacaaaaatagcccccatctcaatcatataccaaatctctccctcataaagtaagccttctcctcactctctcaatcttatccatcatagcaggcagttgaggtggataaaaccaaacccagctacgcaaaattcttagcatactcctcaattacccacataggatgaataatagcagttctaccgtacaaccctaaaataacccattcttaattaacctaatttatattatcctaatactaccgattcctactatcaattaaactccagcaccaggacctatatatctcgcacctgaaacaaagctaacatgataacacccttaattccatccaccctcttctccctaggaggctgcccccgtaaaccggttttgcccaaagtggccattatcgaagacttcacaaaaaaaatagctcatcatcccaacataatagccacatcaccctccttaactctattctactacgctaattatccacctcaatcaaatatccccatatttaacaacgtaaacattacatggccgctttgaacatttaaaaaaccaacccaattcctccccaaatcatggccttacagctaatcctacttatttccgtttataataataatcttttaagaacacacaaagaaccaacaaacactgtggcgccccgcagaaaagtttacaccactgcgggggcgccaaggaggaaggcaacgggtccgagaacgcgcaccgggggttccaaaaaccgggccggcttgacaccgagtggcatggcacgcagagcaccgccgcgccgcggcccgagggccgcgccacgcgaaacggcagaccaacggcaacgcacagcacagcgccac

SEQ ID NO: 527597 - DNA, 250 bp, Homo sapiens
  misc_feature (239)..(239): n is a, c, g, or t
ccaggtagactaactgacgtgcttctgctttaaatattgtgaaaacattacagcggaatgaattttcgcagatggttaggtcaaattgcagttaccatcatatgcaacagtgaagtttttgcgacaatttaaaggcgtttggctggttctttagatcagcttcttcctactgattcttcattcttcatgcagtttctaaccacggttagccagctgattcacgctgggttaggtctacnctgggggtacc

SEQ ID NO: 527598 - DNA, 638 bp, Homo sapiens
actcgcctgatccactgtctgccagaaagtgcaatggtatgcagaggaggctggtaaggggacagaagccagagatggtaactggccaccacactggctgaggaagagagcagtgggctctcaatcttagctctcatgccaagtgccatcctcatcccaacatccagcagcgtcccccataatgtgcactgcctggcctgaggtaaatggagagctcacctaaggcctaaagttgaaaaggggctttccagagccccaggagtgctggacatctcaccagccatggaaagagactgtgtcctcgtggccacagacaggcaatgatggaagactgccctcatttcagggccttctggagtcctcagttgagggttcagctctggcaacagaggacacttctggtgtccaaagattctcggtgcctggtggatgtaaaaccgattgatggcatctgctggcttctggagcactgcttagccattcttatctgtgttccccagccaaagcactgtagaaagcttggtctctggctagcattctggactgttagacagcctggctgcagctagcactggatggagagagtacagtgtggtgaagtggggacagggggcattctgccacatgggctaaggttc

SEQ ID NO: 527599 - DNA, 1018 bp, Homo sapiens
  misc_feature (1018)..(1018): n is a, c, g, or t
attatcactatatttaataatcacagtctagagatgttcatgggtaaaagtactgccttgcacaggagcctgtttctaaagaaacccatgctgtgaaatagagaacttttctactgatcatcataactctgtatctgagcagtgataccaaccacatctgaagtcaacagaagatccaagtttaaaattgcctgcggaatgtgtgcagtatctagaaaaatgaaccgtagttttgtttttttaaatacagaagtcatgttgtttctgcactttataataaagcatggaagaaattatcttagtaggcaatgtaacacttttgaaagtaacccatttcagatttgaaatactgcaataatggttgtctttaaaaaaaaaaaagaaagttgtactggttaagggtatttactcttattcttcaatggcgtgagtagaatctcatacttctagaatttaccaatatatatatggtatagctggacagggggtacatgatttttaaaggtaggtagttaggggatatctttaggtagtgatagtagcctgaaccacattttagataactcaattatgtatgtatgtgcataacacatatagcaaaacactaatggtagaatgctttttatgtgctagactattatattaggaggatgccgattgtactaggcaatatcacagtttggaaaattacaaatcccccctaatttaatactccaatacttagcaacgagaaacctggcaaatggcctacaatagtgtgaagggcagatgaccataaatgaggaagcttgccagccgaccgagcacgcactgcccaacgacgtgaagcgaaacaccgacatcgggcgcaagcaagaaaaggaagccaggatataaatgggacagtaccaccagcaccggagaaaagagaacgacgacgacggactcgcacagaacgaccgccgcacccaaccggccacgcgcgccaccaaccgagacccacacaccagaaccggaggcgcacacggacgagcacgcn

SEQ ID NO: 527600 - DNA, 104 bp, Homo sapiens
aaaaaaccccggttttaaatgggggaatccgttggggtttgtaaaaacttgtatgtggggaagacattgttgtctttttgtgaaaataaaaatccccccctgga

SEQ ID NO: 527601 - DNA, 567 bp, Homo sapiens
  misc_feature (213)..(213): n is a, c, g, or t
caactgtattgcctatttgaaaattgcactgggcatggtggttcacgcctgtaattcccagcactttgggaggccaaggtgggtggatcacctgaggtcaggagttcaagatcagcctggccaacatggtgaaaccctgtctcgggaaacccctgtctctactaaaaatacaaaaattatctgggcatggtagtgcatgcctgtagtcccagntatttgggaggctgaggcaggagaattgcttgaatcccagaggcggaggttgcagtgagtggagacagcaccaatgcactccagtctaagtgacagagcaagactctgtcccaaaaaaaaaaaaaaaaagggaaattgctaagagagattttaaatattcataccacaaaaaaagtgaagtgatggatatgttaattagcctggtttaatcacatgtatcaaaaagtcatgtagtaccctgtaaatgcagttatttgtcaattaaaaatgattaacgagtttaaaattttttcgaagtgtaacatttttaactttttcttgttcaaataaagttttctgttttttaaaatcaca

SEQ ID NO: 527602 - DNA, 290 bp, Homo sapiens
ggggggggggggggggaaaaaaggggttgttaacccccccccatcttaaaaaaaattttttgggtttttcccccatttagaggggggggttttccaaaaaaaaaggggggtttccccccaatttttttaaaaaaattggggttggcaagtaaaaaattttgtgggttccccaaaaacttcctcatttaaaaggttttttcccgaaaaaaaatgggcaaaattttttttcccccaaccccctggggtttttttatttaaaaaacaaaaccccctgggggttttttctttga

SEQ ID NO: 527603 - DNA, 175 bp, Homo sapiens
ctcaagcggtgtcggggaactgctacgcgcaccccgttgaggttccttctcgccgatgaccccggcgcaggtagacaatcatggccggcctgtacgccaaggaactcatgctgcgcggcgatctgagtcggatgctcgtcatcgccccgggcagcctggtcgagcagtggcagga

SEQ ID NO: 527604 - DNA, 349 bp, Homo sapiens
  misc_feature (17)..(17): n is a, c, g, or t
  misc_feature (237)..(237): n is a, c, g, or t
  misc_feature (244)..(244): n is a, c, g, or t
  misc_feature (248)..(248): n is a, c, g, or t
  misc_feature (252)..(252): n is a, c, g, or t
  misc_feature (255)..(255): n is a, c, g, or t
  misc_feature (259)..(259): n is a, c, g, or t
  misc_feature (280)..(280): n is a, c, g, or t
  misc_feature (306)..(306): n is a, c, g, or t
  misc_feature (332)..(332): n is a, c, g, or t
  misc_feature (340)..(340): n is a, c, g, or t
  misc_feature (346)..(346): n is a, c, g, or t
acggtgggatgggaacnaaaagcaaggacaaaaagctgttcgggacaaacttggagcaggaggatgaatttgaggacccaaatattgatggggaagaggagaaattacaacccccaccccagggcaggcaccccttttgcccattttaagagccccccgaaaccctttttgccttttgcttttattttgcctttgcccccagggcccccgggcccctcagcacctgatgaaaaggangaaaaanattncgantcntagngccttttgccccccagaccanagccccttttagttggttttagttgntttggggggaggaaaaaaggtaaagntgtttttnaatttntta

SEQ ID NO: 527605 - DNA, 289 bp, Homo sapiens
acagctgaaaggcactggtaagacgtaagtgtaaggcttatatcctacgacaataatgtactataatattttatatactattgttgcttggacgagctccctgtccctgccgagtgatgctgatctcgctcatgcacttgctccaatcagcgattctgctagctcctgagtactggactacgtgctgcccccactgctattttgcatttagagagaccaggttcctacattgccaggtagtctccactcctgactcaggtgatctgcccactcggtctcccaagggtac

SEQ ID NO: 527606 - DNA, 153 bp, Homo sapiens
cctaacgtgaactgctcgctccagctccagcgccagcgcagctggttgccaggcgtcattggagaggcctggctagccccagtggcagcagggagatggtggacctgatatgggcgtggcagagaggcctattggcctatgctagacaaagtg

SEQ ID NO: 527607 - DNA, 324 bp, Homo sapiens
aaaagggctttttcccccccccccccccccccctgggacgtttttgggaaaaagcttttctgtccggtttaaacaaaccgtttgacatagctcgttggcaaggacattttgttaaaccaatctaattaaagggtaatatggggcccatttgggttcccgttgtaataatttggtaagtaaacttctgggggcaaaattactgtttaattttactcttaaaatgttgcatgtttggcggcattcctaagggccctgtaattttaaacttttaattgccgtttgtggatatgaaagggtttctgaataaaaatctttcccccttta

SEQ ID NO: 527608 - DNA, 2578 bp, Homo sapiens
  misc_feature (2025)..(2025): n is a, c, g, or t
  misc_feature (2036)..(2036): n is a, c, g, or t
  misc_feature (2164)..(2164): n is a, c, g, or t
  misc_feature (2264)..(2264): n is a, c, g, or t
gctgatagcacagttctgtccagagaaggaaggcggaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcgttgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaattgagttataggaataaggacggtaatctgcattttgtctctttgtatcttcagtaatttacttggtctcntcaggtttgancagtcactttaggataagaatgtgcctctcaagccttgactccctggtattctttttttgattgcattcaacttcgttacttgagcttcagcaacttaagaacttctgaagttcttaaagttctgaanttcttaaagcccatggatcctttctcagaaaaataactgtaaatctttctggacagccatgactgtagcaaggcttgatagcagaagtttggtggttcanaattatacaactaatcccaggtgattttatcaattccagtgttaccatctcctgagttttggtttgtaatcttttgtccctcccacccccacagaagattttaagtagggtgactttttaaataaaaatttattgaataattaatgataaaacataataataaacataaataataaacaaaattaccgagaaccccatccccatataacaccaacagtgtacatgtttactgtcacttttgatatggtttatccagtgtgaacagcaatttattatttttgctcatcaaaaaataaaggattttttttcacttg

SEQ ID NO: 527609 - DNA, 158 bp, Homo sapiens
ctctagaggatcgggtatgctgacaggtaagggagagtggtgtcgtgttgaagtcagaggagacacctggtgtcagtgtagccaggatgccttgagggggcctccgacgcctgcttcaacaacttcttgatgtcatcatatttgggaggtttttctag

SEQ ID NO: 527610 - DNA, 589 bp, Homo sapiens
ctacatatacaatcagctctgtacccagaacgactataacaagtaagcctttaatcttggccaactttattacatgaagacgataaatgattcgatatgtgatagagtgcataactatacagagaatgagacttatgccagaaatggagagcacgaatttgaaacaacatgaatatctcaggtacagattgctagattctagctatttgtttaggcctgcaaggcaaggtcatacagctattgaaaggtggattccaaaagcactatgagtcacccgtgctgattggcatagctggcccactaagagaaatgtccgttgcgctctacactactgttctcccgtgcttgataatcccccactaaaaaatgttaggggaaaaaaacgcagctggttatgaaaagatatatctcatttcattaaaaaatcaatgtcaatgctgttaatagaatccttttatcttcaggacagaggcaatgccctaaacaaacaccagctcaagagcctctgatgccaacctagagggtacccaaacacaaacttagcatagaggtaagaatctctatgtcttttggtggaggcaaagccatt

SEQ ID NO: 527611 - DNA, 172 bp, Homo sapiens
acgcagtcccacgtatagacgttagtcaaggtgtagcccatgaggtggcacgacaatgggctacattttctaccccagacaacctacgatagcccttatgaaacttaagggtcgcaggtggatttcgcagtaaactgagagtagcgtgcctagattcagggtcttggtgcgg

SEQ ID NO: 527612 - DNA, 1629 bp, Homo sapiens
  misc_feature (516)..(516): n is a, c, g, or t
taggccaggtgcaggggctcacatctgtaatcccagcatctctgaaaggctgaggggggcgggatcacctggaggttggggatgttcaagggaccacgcctgggccacgcatagtggaaaccccggtcttctactggaaatatacaaataaattacgctggggcatgggtggtgtggggccgcctggtatatccgcagctactgtgagaaggcttcgaggcaggaagaaatgcgttgaaaccgtgggaagtgtgggaggtgtgcagtgtgagcccgagaatgtgcgaccagtgggtatttccacccgcgggtgtgaacaggtgcaagaacttcacatgtcttcaaaaacaaacaacaaaacaaatgtgtgtggacgatctctatttcacacagatttctacatataagaatcttaggtgtggtagaagggcgctttctcatacgtgtgagaagatgtgtgtgggggagatatatgtggggagacttctctataaatgtgtggtatacaccccccangagaaaagacggggagaaatttaaagcgctgtgtgggtattctgtattgtatagaacaccccatgtgtatcgcgcgctgttttacacttatatatatctcgggtggggtaaaaaattctccacgtgtggacacaatctcctataaaatagggcgagaaactatttggcacagagatataaatgtttgatttgtgatcccttttagagagagatatagacttagagaagattcccgagagtgccatataaagagggggggcacccctataggggaagcccgcgggggtgtgaaaacattttcgcgcggaaaagaagcaattaaacatttgcgaagtgtgtgttgtgtgtaacgccccaagaggttttagtacataaccttcgatcacacccgcacagaagtgaggagggcgggcccattgttctgccaccaacacttaaatagtgcagcctgcaaggggcggcagcccgccgtggtatactacaacaaccgcgtgtgggctatacagcgacccgccaagaaagaagagaacactaaccaactgggccaaagagggcgactgaggaagacagaacacatcaccagacactgggaggcgacacacaaagcaaggaggacgtggcgggcccacacaacagagagtagcgaccgcctgtcagaccagtaatgtcgtccagccagtaagagaacctagaaggggagcgctgtcagcccaggcatattttagcgccaaaccgggacacacatggggtgttgaccccaagaggataatattcccgcgcagagagaaaaagattgataacggccaccagccaacaacagcgtgggggtgaaaagcacccccactgaagaccgctagaaacgacgccggggagagggagaacaagcgaaaaagcaggaccaggcttctacaaaacaggcggcccgcagctgagccacaacagagtgagggggcccacacaccgagggtggaacacatcaggagtagcaaaacgaagtgtaggtgacacacaccacatctgagagagaagaccgagacagcgcagggacgagaaagtacacaagcaagaagaagacaagaggtgacggccgcatccaacaaacacacagcgcgg

SEQ ID NO: 527613 - DNA, 258 bp, Homo sapiens
gtgactcaccgatctctatatgctgtctcatgtacacacgtgagtatacagtgttactaatgtcttgattttgcactgccatagggaatgttcaggttacttggctggaatttatcagacttgtgagtaaacaagttgaagtttaaccagatgaaggggaatattgagggccctaagggtaaacaaaataatcagtatctgagatagtggctaatggggctccccagggctaattagggaaccgttattcctgattgc

SEQ ID NO: 527614 - DNA, 314 bp, Homo sapiens
ccttagtctctactaaagatacaaaaattagccgggatggtggcatctgcctgtagtcccagctactcggaaggatggaaaaggagaaatgcttgaacctgggaggcaaaggctgcagtgagctgagattgtgccactgcactgcaccctgggagtcagcaagattccttctcaaaaaaaaagaaaaaaaaacaaacaaacgggtattattggtgaacaattaactgtccatattaaaaaaaaactccgacagattctacaaagtaagaattaagatggctagacacaagactaaccaatttcagggctgtgga

SEQ ID NO: 527615 - DNA, 228 bp, Homo sapiens
acccccaccccttgttgggttttttttaaggggggaaccggaggggccccaagttattcctttccccatcccgcttttccttgaaagcttgaggaattgaattttttttgggaattttgttaatttggtttggttttttgttgtttccaattccaggaattttccatttttccctttgggggggattcttgaggaaaggagggccattaaaaggggttaaacccttga

SEQ ID NO: 527616 - DNA, 956 bp, Homo sapiens
  misc_feature (528)..(528): n is a, c, g, or t
  misc_feature (553)..(553): n is a, c, g, or t
  misc_feature (561)..(561): n is a, c, g, or t
  misc_feature (578)..(578): n is a, c, g, or t
  misc_feature (580)..(580): n is a, c, g, or t
  misc_feature (582)..(582): n is a, c, g, or t
  misc_feature (661)..(661): n is a, c, g, or t
  misc_feature (664)..(664): n is a, c, g, or t
  misc_feature (771)..(771): n is a, c, g, or t
  misc_feature (823)..(823): n is a, c, g, or t
  misc_feature (825)..(825): n is a, c, g, or t
  misc_feature (835)..(835): n is a, c, g, or t
  misc_feature (845)..(845): n is a, c, g, or t
  misc_feature (850)..(850): n is a, c, g, or t
  misc_feature (877)..(877): n is a, c, g, or t
  misc_feature (884)..(884): n is a, c, g, or t
gacaactccctgtcacctcatgactgcaggagcagactgtgtcatactctacccccgtactgaaagtgctggcgtttcgcagcaatagtccggattccgaccctgtgactatcctagcttcgctcttcttatcgctgtccaggggccaccccgtatggcgtgtcccctctgtacgatgaacgaacatgatgctccgtgcacgccatgcctgcactgtaggtgccatgatcgggatggagccccacatcgatggtgccagctgtcatggaaggctagtctgtacaccctaaggcgagccatgatcgactaggttccgagcacattcttgcatggaagcacgttgtcttcgagcgtccttggggagcaggattgctccataggaatcggtacacgatacgatcttctgccacaagaaaatcgcatttgcagctgcgcgctcaagtcattaaccatagcacagtgcacgcctgtctagcagctgaaatgggcgtgagccacgttgaagcatatcctaaggaagttgttcgntactaacgctgatgaagcgattggntcccttgncgatacggagcccatgntntngtcacggcatgggattctcacgcgggtatcgcgtacgtggcctgacacgcatgggatacgccagtggcctgccgtcccntgnctatgacatagacgttgtgatcctctccgggcgtagataagaggcgtttgccctgtgtgtcccatgttgaccacatccgcgaggtactagcaacccatgtctttccntctgcgctaggggtctcatcacacatttgccatagggacactgcgttgtggncntctacaggantccgagtccntgggncgtatcctatgagccccttgtcgtaangcaccanatcgagacgacggatgttgcgcgaaggactactatagcttcgcgatactatgctcattagcatagaggtctt

SEQ ID NO: 527617 - DNA, 939 bp, Homo sapiens
ctccaggccctccccttcgctggtgctggttcctcatccgtctcgtgctctccggggccctccccttagctggtgctggttcctcatctgtctcgtggtctccggggccctccccttcgctggtgctggttcgtcatccgtctcgtgctctccggggccttcactggtgctggcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggaggtgaggctggcgtgggcaagcgtgctcactctccacgctccacatgaggctgggaaccagaggagccaggtgcagcctgcttgcaccatttgcttgcccttgacctggaggggctggaactaggcctccatgggcttgcccattctaaaccacctctctctggcatctggtccataaggagagacgggcatcttggagcccatcccattccctcttcctgggtttcctaataggacagcctctggccagagcgggttttgtggggtacccccgccacgccctcttgcgttgttccaccccgaaggtcctggaaaaagggcaccccccactttgacggatctaccccctggcccccgggggccggcaaagctgc

SEQ ID NO: 527618 - DNA, 325 bp, Homo sapiens
  misc_feature (179)..(179): n is a, c, g, or t
aagcaaagcacacggtggtggtggcggcacagcgacggtggtggtaataactaccatttatccaacttcatcctgtggttcttatgtgccaggtattgtgctaaatactttatgtggattgtatcatttaatccagacacagggttgtgagagtaataggtgctgttatccctattttnctgataaagaaacagtcttatgtagctagtagggcagaaccaggattcaaatccaaggagtttgactccctaccttattcttctaaacactactctattctattttgattttgggtcctgagcataccctttcttttgtcttccct

SEQ ID NO: 527619 - DNA, 873 bp, Homo sapiens
gcggccgcagcatggacccttcctgcctcctgcccaccctcccctctgctgggtgctcccgggcccctacacccccacttgggacctgatgcgggggggctgatgacactggggactgacgtctgtggtctttcccaggtgaccggcgcctgggaggcccagattgatgcccagtgacaggctcgtggccgcagaaggcccccgcctcagacccagatcgtcccctcagagagcagatggggatagtgaagggaaaagcaccattttgttgaatttctgggcctgggttgtggtggtaatgggaggggtcagtgctaacaagatctgtctgtcatcagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggaggtgaggctggcgtgggcaagcgtgctcactctccacgctccacatgaggctgggaaccagaggagccaggtgcagcctgcttgcaccatttgcttgcccttgacctggaggggctggaactaggcctccatgggcttgcccattctaaaccacctctctctggcatctggtccataaggagagacgggcatcttggagcccatcccattccctcttcctgggtttcctaataggacagcctctggccagagcgggttttgtggggtacccccgccacgccctcttgcgttgttccaccccgaaggtcctggaaaaagggcaccccccactttgacggatctaccccctggcccccgggggccggcaaagctgc

SEQ ID NO: 527620 - DNA, 312 bp, Homo sapiens
tgagctcggtaccccagagtccaaacagggcccctccttgtaagttcatatttcaagttacatggatcatgccataaataaaccacacttgctttaacatggttcacaatggtgcatttaacaatcggacatacagctctgtaaacaattcagaggccattgagcttaccatgaagaaactgacacgtatgtaggaaccgtgtcctgctgcacacaagcacctgctctggctctggtgcggtgcagctcggtgcggtgcggtaaggtgaggtgaggtgaggtgggcaggtgtggaagggacaattcctgagg

SEQ ID NO: 527621 - DNA, 926 bp, Homo sapiens
gtagaaataaaaaagaatacacaagcctcaaataaccaaaccccaaacccaaccatttgggaaattacgaaatgctacctcttgaaaactttgtccatttatttgcaataagtctaacaaaccctctcaagaggtggtgctcaagggagctgtgcagtgggtttggatgaatgtgcaaccaacgctgaacaaacatccctattaaagggcgtgttgttccaggttacagtttctctcaagctaagggcagatcctttctctcaaagacacaaactggaaagccctgactcaggtgcccaaattaggtttgtggggtggtgggtcaaggattggaacggacccaacaggacagaagtatgagatgggacagcattcttggcatatccagagggagatgggttcaaggaagcaagatgaagttcgggcagagaagctgctacccttaagaaaaagctgaccgggcacagtggctcatgcctgttatcccagcactttgggaggccgaggtgggcggataccctggggtcaggagttgggaacaggctgaccaacatgagaaacctggactctactaaaaatgcaaaataacgtacggcgtggtggtgtatgcctgagatcccagctaactagggaggcggggcacgaaaataggtgaagcctgggaaggggagttgcggagctggaaatgagccatggatcaggctgggcacaacgagcacacctgtccggacaacaaccacacaaacagaaacaacacaaattggcgcggcacgagacataaaccactagtgcgcgggacaaaaagcacacacagcaacaaccgcagcaggggacacaaaacacgcgcggaacacaggggacgtcacgaccaacacagggcacggaagaggccaaacagaaacaaacagaccgaggacacagaggac

SEQ ID NO: 527622 - DNA, 264 bp, Homo sapiens
  misc_feature (140)..(140): n is a, c, g, or t
atttgcaactgactggattgatgcttgataattctcttaagtagaacacaatgaaataatagtggctggctaagttccatcaattgtttttaattctttttgactttttctcgcggtcttctgttatcctttctgcaggncgcttcttcaaccccttcattttcctggtttggaagttgcttaggtcttgcttctgcatatgaatccttccattaagtgtaccaaaagtatcatgggaaatatttttcttcttctttggcttga

SEQ ID NO: 527623 - DNA, 1256 bp, Homo sapiens
gtgctggtgtcaaggctgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggccatggccccagccctggttccggcaagccccaggccctggctctcacgcccgtggagcaggtggtggccaagaccttctcttgccaggccctgccctccgagggcttcagtctggagccgccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggaggtgaggctggcgtgggcaagcgtgctcactctccacgctccacatgaggctgggaaccagaggagccaggtgcagcctgcttgcaccatttgcttgcccttgacctggaggggctggaactaggcctccatgggcttgcccattctaaaccacctctctctggcatctggtccataaggagagacgggcatcttggagcccatcccattccctcttcctgggtttcctaataggacagcctctggccagagcgggttttgtggggtacccccgccacgccctcttgcgttgttccaccccgaaggtcctggaaaaagggcaccccccactttgacggatctaccccctggcccccgggggccggcaaagctgc

SEQ ID NO: 527624 - DNA, 1349 bp, Homo sapiens
ctcagacatcccctcaatcccccctctgttttgatgggtcttcaaaaatacctaagtcctgggcttggttcgggttggcagggcaaggactctagagtggggcagtgaggcactggcctgtggggcagaattttaaaggggtgccaaaacactcagtaactcagatcgatactattttaatgcagcgtgttttttaaaattaattttaaaaaaacatgttggacaaaatatccaagtttaaatcaagacagagtctgactttgtactgcacacttggcctcatttgccttaccctagtcctggacacgtcagctcctgcctttatttaaaatgttgatagatattttgttcatcagggattggagtacaaaccagtctgatatgggggtcacttggatttccctgtgaaaatcatgaatgactgtggctaccatgtaaaaccatccctgattctttggtgttcctcaaattggaggtctccaagccacagagcaaggggttgtagagagaggagtactggacagggaggcaggtgggccaggttctagtcccagctctgcctgtaatgtgctgagtgacccttcccttctgggcctgaggctcttcatccataaaaggaggtaaagaggtacaggtgtgtgtctgagggctcttaggactgagacccaaagggactcttagctctgtccctcacccactatgagctcctgctgctgactggtttcgttagaggaagttctgctgcggctgcagaaacccagaaggtagagtgaggcttacatggcattccccccagaatccatgttaaccccaattctgggaaagatatttctaatttttgaaggtcaattctggaaggagcattgggttcaatgtcaagaggactagattccagtgttagttctgccacatgaccttggtagcatgatcttggacaagtcacttcaccaccatgggcccatttgcttaaatgtttaggatgagactgccagctgcagggtgatgttggaaggagagatgcagattctggagccagaaagtctgggttccagcccagggcccaccactagcagctatgaagctctgggccagttacttgagttcttggtttcctcagctgttaaaaggaaacacaaataatacacccctcataggattactgtcataaatgcaaaacattagcacaacgcctgttaaaataattgcccaatacactttagctatattttcattactatcattagtattatcttctactcttatcaggatttgtgaagatcactgtgtcaaatggatgggaaattttattttaatataaacagtaaaatagcattgttttcacttgcaaa

SEQ ID NO: 527625 - DNA, 142 bp, Homo sapiens
  misc_feature (12)..(12): n is a, c, g, or t
  misc_feature (14)..(14): n is a, c, g, or t
  misc_feature (39)..(39): n is a, c, g, or t
  misc_feature (86)..(86): n is a, c, g, or t
  misc_feature (112)..(112): n is a, c, g, or t
ggggaaggcctnantctaacttgaaacgtgtgggagaanccgactccggaggtgtcgtggtggctaaccctaagagagaacgaagnacctgaacgcctcccttgggcttacngtagatagagcctacactggtagattttat

SEQ ID NO: 527626 - DNA, 207 bp, Homo sapiens
atggatatactattagtcgttgacgggatgcaacaaagtgtgtgccgcacgtaagcctgagaccagagatctgaagtaaatactatcgggtactcacttccggaccctcagacacaggactattataccttctgtgatcatcatttcctctcctatagacatttctgtaccagtcgacactgatcttgggaaacttgccccttattt

SEQ ID NO: 527627 - DNA, 152 bp, Homo sapiens
ccccattcaggaccccattcaggacctcgacctctctcaaagggttccttcttccctctagtgtctgtgagagattcactaggaattcctgtatcagttccctttctatcagttcaatcatttcttcatctcttcagttccaaagccatacc

SEQ ID NO: 527628 - DNA, 209 bp, Homo sapiens
aaaagcagtcttgcccactaaaaacgctacatagtgtgtatatttgttcagctaagaattggaaagtatttgcttgccttttaagttactgacatcagcttcaccagtgtaaaaattgagtaaaacctgaagtttttgccataaaaatgccaatcgggtgcctggtgctttgaaagggttggctagtaagaaagcaattctttttgtga

SEQ ID NO: 527629 - DNA, 319 bp, Homo sapiens
  misc_feature (23)..(23): n is a, c, g, or t
ccccccttttttttggggcctantgccctcctttgcccaggaaatggggggggtttaaccactcagtgtccccaaataaaatccagtgtggagggccctttggtgtgtagggggccttttggaaacctgggcaacaaaatgccccctgccccccgggcaaggggccccgtttagggtttccccccccctggttagccgatgtccacccctgggactttcctgtcagtttccacccgatttaaagctgggtgcctggccaattatttatactggggtttccttttgcctgatttaaaatgggatttgtttgcccccctta

SEQ ID NO: 527630 - DNA, 448 bp, Homo sapiens
  misc_feature (53)..(53): n is a, c, g, or t
  misc_feature (68)..(68): n is a, c, g, or t
  misc_feature (308)..(308): n is a, c, g, or t
  misc_feature (313)..(315): n is a, c, g, or t
  misc_feature (320)..(320): n is a, c, g, or t
  misc_feature (322)..(324): n is a, c, g, or t
  misc_feature (346)..(346): n is a, c, g, or t
  misc_feature (364)..(364): n is a, c, g, or t
  misc_feature (444)..(444): n is a, c, g, or t
tggtacttctttttctctatgtatgcaggtgtgcacaatatactgatctctcncaggtaatggtagcnaccggtatatatcttgggttgcagattttttgggggctgttagggagatgagcaagtgtggctggatccctccagcatttcccttctccacgtcccatcctgagggaatgttgatgctggcaatgggcacagtgagttccttcaggacacttaggatgctgtggaacggttcccgaacatcgcccttgaagctgaagccaaagatggcatccaccaccagcccatacagttcatcaatcntcatnnnctctncnnncatttccccaaggaaagggatnttcattttctgacactgngtcaccaatgcagttaagaggggcttgttaggccttttggggtaatagatggttggctcgtagccaaagagtttgaggtntcga

SEQ ID NO: 527631 - DNA, 435 bp, Homo sapiens
ccagggccctgctccccggggaccctcccggcagaggcctttgtctggctggctgtgatgggtcctgacaccccatctgtctgtctgtcggtccacctaggtgtttccccccgggccggcctgccgtgacgatcacagccctgccgtctcaggtcacggttttggattctgcgctaacgaggtctcccaggtgggctggaaacactgatgaagacggatagaaaaaacaccagcccaccggattattaataaagataatcacacacaccccttcgtcggcagccggcctgacactttataaagcacgttaggatataatccaattgaaactgcaatatcgagaacatctcatcttatcacaaattgaaattatatcacattcctcttttcttaaattaaaaagctaaaaccttttcgtttgctctcaaaaaaaaa

SEQ ID NO: 527632 - DNA, 228 bp, Homo sapiens
agagaaaagcggaggcagcagcaccaggagcagaatgtcctctaagaatgcggcagcagcctggcattgagcttcccgagacagaactgagttttagagtagggaagggacagaggaggaattaatgatgaactggtagtgtcagcctcctgtaaggaaccagagcaggaaccagtgccagcacagttccagaaagtaaagcccccaaagaactaatcataaacgctg

SEQ ID NO: 527633 - DNA, 422 bp, Homo sapiens
  misc_feature (19)..(19): n is a, c, g, or t
  misc_feature (21)..(21): n is a, c, g, or t
  misc_feature (37)..(37): n is a, c, g, or t
  misc_feature (39)..(40): n is a, c, g, or t
gcgtgtcaccgaggtccangncccagcgtctggcagnanngcagctgggactcgagggcgagctgcgccggctcatggccaagcccggtgtttccccccgggccggcctgccgtgacgatcacagccctgccgtctcaggtcacggttttggattctgcgctaacgaggtctcccaggtgggctggaaacactgatgaagacggatagaaaaaacaccagcccaccggattattaataaagataatcacacacaccccttcgtcggcagccggcctgacactttataaagcacgttaggatataatccaattgaaactgcaatatcgagaacatctcatcttatcacaaattgaaattatatcacattcctcttttcttaaattaaaaagctaaaaccttttcgtttgctctcaaaaaaaaa

SEQ ID NO: 527634 - DNA, 248 bp, Homo sapiens
ctctagaggactcccgggactgggacgatgtctgagtgacgacgctcacgtcaggggaagtttaagtcagcctcagtttccacatccataaaaggggacgatttccttacccggccaggagggccccgtgggtgggagagaggtgtatgggctctgtgggctctgtccttggttgaatggccccagaggggttgcagctgggcgtggcggggctgaccaacgggaagtaccttcatcagtgccagagc

SEQ ID NO: 527635 - DNA, 231 bp, Homo sapiens
gcgtatgcatggctggaaatgtaaattttttaaatagttgaacttgtgactctgatacctttgcctttgttatttgtcagtacagtggagtataatttacagaattgtcaaaaaggaaggtgtaaagaaagcagctccaccgattttttaaagatttttttccctctaaaagctgcaaactttacctttaaacaaatacacggtcttttcagactactgaaattgtcataa

SEQ ID NO: 527636 - DNA, 356 bp, Homo sapiens
tcagtggagggtggctggataaaatgtggagcccgagtcgggcaaagaagggcacctgtggggaagcaaagattggttaggaagggggatgaccaaaatagacaatacattgaagataatggaagccagatatgtcacaatgagtgagaaaacggatgcaggactatttgaagagcagcttcctgcaagctcccccaagaccccacgtagagtgttcaccgtgctgatgatactgcagcaaacagggccttgaggagatatgagaaagcctgtttctgctcatgctaactgctacatgctcccatttcaaggagaaatatttcttcaaaagtgggttcttgaactcacaaatttgg

SEQ ID NO: 527637 - DNA, 995 bp, Homo sapiens
gaatggatcaaggtcgaggtgcagctcagatggatctgatccttggctgactacggcaagaaaaacaatgtgaacgtggcatcactgacatcaatcagaaattgctgacgcacatcatcctggggtatggacgatctcggcatccgtcacacgggagcggcagcagatcgctgagatcgataagcagaccacggagacattcgcagactgactggcagacgacagattcgcactgtctaaacaaggctatgcgccgtatgaagatcatcacctccatccaaggcatgggaactatggagacccagagctttctcatccaagactgaggttggtagtggtcagggccatctctgctgcacagacctgacagactaatggaccatagtcatcatctatgtttcgatctgactgatcatcaaggtagatgtggtctaggacctatgatccttctgcaagaatgtgcttaagaagttcagctgtgtatctgatcttggggcccatgttgcgggatacctatctggggtgtgcccatcggataacccccagggtgtaggtgatccgctgcattgtgatggtgccgccgtggggctctcaccattaccgtgcggctctgctctggccagctggccccagcatgagtcctcaggggatggaatccttatgttggatccctactcagccgtgtgagtccccgtcggttgtcccccggtgtctgcgcccatgctagatctggtgacatccatcgtgggatggggaggtgaccctttcatccgtgcgttccgcagggtctgtcagtgagggcttagttgccccgggtcgatgggccgccgacccacaggcccacccaggcgactgcttccttgagggctggggtcgcggcctgtttcggcccgcctggctcttgggttggtgcccgtggtcgtgccattccggcgccccttccgggggggggggtctctttccccccccctttgtttttggtcgggtggtgttac

SEQ ID NO: 527638 - DNA, 386 bp, Homo sapiens
taggggcccccctttttaatggtctcggatggcccaacccgccttcggggggttttttgtcccacttttgactttacctgggggggggccctgttccttattatccccaaggagaaaaaaacccttgttaaaaaagccaaaatgccccccgaaaacccttttttttccgagccttcccgggaccttttttggggagggccctaccgggcccaaaaggagttgggttggatgagagggttaaaaaggcccaaaataaaagggttttttttttttccctttttggctaagaaggtgcggttttttttttttggcccgtttgagggatgggggaacccatgttggccccccataacccgggatttttttttgttggggtgttttcccca

SEQ ID NO: 527639 - DNA, 329 bp, Homo sapiens
ctgctggtggcttgggacatcaatggggccaaaggttttttgtccctgggtcaactgtgatttggctttcccgggtcttttctggggaagccctgtttggggttttgtgggtttgggtgggaaaagggccatttgcctgaatgtaacctgctagctttccgaaggcccttcgggcctgggttgtgttagggtgtggacaatggtggcccccctgggcctgcttgtgttgcctacatgtccctggctgtttagggggtggttcagcctgcccccctcccctgttttataaatggtccttttgacctttttaaataaatatggatggggga

SEQ ID NO: 527640 - DNA, 799 bp, Homo sapiens
cggccttttttgagcttttcaaggtcgatcgagtgatgctgcgcgccagccccgtggggcttccggtgtggtttccgctttcttggggaggaactgtagccgagaaggttctttcttttggcccaagtccttttccctccctttggaggatataggagccccaggttcctgggatgccccaatctgccatcccctcgttttgtgtggccacccacgcccgaccgttttcccatccaggcgcaccgtggtcagccccccttatacccaagtgcccgtattcagagtgggataaaaatatatctccctgaactccctcgctctgaggaaggtattttcttctcacgagctcccccaagcctggagttgagggacactggcttaagttgggaaccacgtatagcccaaatgtcccgcttgttgaaactgaaatttgtgagttatcttcgttttgcctgccagaagtcactttgagggctcgttgtatccctatctaaaggagaatttagagtagggcccacatataaagggggctgcaacgtagttttcacttacggagaaaagagagtgtgaggcacgcccctttagtaattgagtgcctcccagatgtggtattcaccccacgcggtgaagggaaaatagttggggctgctggattctgtgaggtttacaagaagacctttacccctcctgagaatcagattttgctggttggttttcagagaagatgtttgcacctgcctgagaaggaatctacacccctgcactttagcctgggcaacagagcgagactttgtttcca

SEQ ID NO: 527641 - DNA, 360 bp, Homo sapiens
tactgggttcctatactgacgagtaatcgttggctcctacttgattgcacacggtttcttcagcgtctatgcatgtgtgtggacacgctgttacatactgaaatataggaggacctggagaggaatgacggctcggccgagaggccttacttcatgtcttccaccctcaagaaactcttgaaacaagaacaacacgaaggcagcggagtcctgaaggccccgatgactaccccacctctcaaggagtctcatgccgcagggtgctcagtaactaggtctgttcccccagccccttgggctcacctgaagtcctatcactgccgctctgcccctccccatgagccagatcccaacagtttc

SEQ ID NO: 527642 - DNA, 404 bp, Homo sapiens
gtcgacctatctcatttgctccctttgcagtagaaattatttccattttacaactgaggcttagagaggaggtgattgctagaattacacaattcctaagagaattgctctaaggtctccaactgtcttttaggaaatctatatttagcagttgcttgatatagatttcctaaaagacagttggagacctatatcaagcaactgctaaatattcagttctctgtgtgttgctgccagaatgatactaacagttcctgtttctgtggcatctcctctgcccaggcaggtgttggccattgaacatacatgactttgtttcagctcctcgacaatgtttgaggtgcaagatgctacagttcccatcacatccaaggaaatgggcacagactgggaaagtgacttgc

SEQ ID NO: 527643 - DNA, 116 bp, Homo sapiens
gcagcgcgatatctgagtgaccttctttactcgaggcgacgtttttcgcatttattcaccctcgcccgtggcacgagtccccagctcggcgccgaaggccttcaaggctgggtcat

SEQ ID NO: 527644 - DNA, 126 bp, Homo sapiens
cctcaagtggcgcgtgtgatcccgaacacaacacctcaggcggtccgcaggtgggcggctgatgggcagcttccggggcgtttcgtacgccttctgggcggtggcaggtgccgtgatcagccatca

SEQ ID NO: 527645 - DNA, 196 bp, Homo sapiens
  misc_feature (56)..(56): n is a, c, g, or t
gagaagacccggatagttcctcccggccacgccgcgccggctctgggcactcagcntcgttcccttttcctccgtgggtgcgctatggcggcggggaagaccctgaacccctgtgccgtggtggcccgagcgctggcggtgctggcggtcttcctccgcgcagcgcgggctctgttggacgtgcttgggaccaccc

SEQ ID NO: 527646 - DNA, 459 bp, Homo sapiens
attctggaacagagtgatttacaatattggtgagctaccagagattagttctagtttcagctcttccactatatggccgtgtgactttcagcaagttattagttcttcatgggcccataattccctgatctctaagtgaagatggaagtaattaggaggtttaaaaattttaactaaaaaatcttttgtctttttcaaaattaatcttatatagagcccctaaatttagatcaggtaaagtcctgattgctgaggatatggtgggagcaggaaccaaatcctaagcttattgaacgtacccatgcatcatgatttcaaagtcaaggggctaaacaaatttagggacacttccatgtgtaaatttattgaggtctatttttcagtgggaataatctgatttactttcagtagggaaatctctatttgctcaaaaatgtcaagttgatactaaccaccaaa

SEQ ID NO: 527647 - DNA, 250 bp, Homo sapiens
agaacgggtccagaaacggttggttcaattggccatttaagtttagtaggaaaaggcgggggtatgaaaacaagggcctcggtaaaccttcccgaaggaaaggagaatgttttggggccccccttggttttttttttggggggggcaggtttaaggtattaggttttaaaaacaggactttttaaaggaaacaacttggccaaaaatttgtcccaaaattttgaggccccttaaaaaaggttaatgggga

SEQ ID NO: 527648 - DNA, 302 bp, Homo sapiens
tcttacaccccatactcacactactagcccactgattcagagagctagaggtctccaagaacatgggacaaacgtccctctacagctatagacatagctataacaacgtaacagtcactctgctaggcccagtagctttgttgttcgattcagacagtaaaagaaacattacagtttacaaacactattctcaactagagtttggagcagggcaaggagatactcaaatgttaaagtgtcaatatttactgataagtaggagaatatcgttataatgggattttgaaaaattaaaagtcaca

SEQ ID NO: 527649 - DNA, 155 bp, Homo sapiens
ggtcgtgtttggaaatttacgtgcccgtctggctctcttgtgattgccgtcttcttcaaaacagaccttccccacttcggctcccatgattgtctcagctcttccccctggctcacaagccctgcaggttgtccctgacctctccaagcaaggta

SEQ ID NO: 527650 - DNA, 1067 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527651 - DNA, 215 bp, Homo sapiens
  misc_feature (168)..(168): n is a, c, g, or t
gagcgcagtgccacaatcatggctcagtccaacctcaacttcttgggttcaagcaatccttacatctcagcctcctgagtagctgggaccatatgtgcgcaccaccatgcctagctaattaaaaaaaaatttttgtagggatagggtctcctatgttgcccaggctgntctcaaatgcctggcctcaagtgatccttgcaccttggcttcccaaa

SEQ ID NO: 527652 - DNA, 1211 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527653 - DNA, 249 bp, Homo sapiens
ttttgaaaaagcctgtccctcccagtttcgagcataagttcttgcacagtatgggatcgcatttcctttccaataaggtatcaagcatcttttgctgtgtaaggtccttctgcttttggttcccgtgctgtgaataggggatggctctcgtgtctgtatgaaagttttgctttcgtatggattttttattctgtgatcttgaagcaatacttggaattccctctgcaatattataggtcagaattatac

SEQ ID NO: 527654 - DNA, 1076 bp, Homo sapiens
  misc_feature (40)..(40): n is a, c, g, or t
gtgctgcgtcgtctctgaggatcccccaagggtccttaangctccaagggtccttagccctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527655 - DNA, 132 bp, Homo sapiens
  misc_feature (8)..(8): n is a, c, g, or t
  misc_feature (24)..(24): n is a, c, g, or t
  misc_feature (113)..(113): n is a, c, g, or t
gaggatgnctgctcaaccaggttnggtcacgcaggccctgatcttgctactctggttccatgtcctatggaagaccaaagtttaccaagatagatttttcccttcatagtggnagatggtgttaacccctgc

SEQ ID NO: 527656 - DNA, 1184 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtcatttgggaacatgactacacatctgtgtgcctcaaactcattaaagtatttgttcttacatcaaattttcaggcaattagagtgaccctaaacatcatggtctacttcttccagagtatggaatgggatgtctggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527657 - DNA, 428 bp, Homo sapiens
  misc_feature (47)..(47): n is a, c, g, or t
ttccgctcgcttatagcattgtagggcacagtggccagtgctactgntactggcccacgggcacgagttcattgttctcgtcttgaccacgtctacagggagaggctatgtacagtgcgtgcacgaagcctgccccaaaggcagaagtgaagtggccacgggaggtcatcctgtcatgcaggttggctttcaggcagcggcatccttgatgatggtcataggtcatcacctcagtacagttgacaatggcattacgagcaacattgggagaggtccctttccagaggccccggaacccttcctctcgggcaatggtcttgtaggcattgacggtgctttggtatctccgaccacctccagcccgggcctgagcttggaatcggacctttaccacatccgtgggctgggccacagccacagccagggca

SEQ ID NO: 527658 - DNA, 995 bp, Homo sapiens
  misc_feature (106)..(106): n is a, c, g, or t
  misc_feature (276)..(276): n is a, c, g, or t
  misc_feature (350)..(350): n is a, c, g, or t
cctggccgagccctattttaaatgaacttattacctgatacgttttatcagaatgcttgtcatcttgcaaactgtgacactgaaagtatcattttgttgttgttgncgttattctcttatagcgttagaattttttgttttctcctttgatattcacgggaatctccgcttgatatgaggagaaggggctcagtgttttgttgtaagtagaggctttggttctctaaaaatgtgtagatggaaaagtgggagaaggtaacagcatagattaataanaacaaacattgatttttccaaaaacagctttacaaaacaattcatactacccgaaatttacatgtcaatatcgnttcattaattctgaacttattggctgccttctcctttccagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527659 - DNA, 696 bp, Homo sapiens
caaataaggctaggtcgagcctgtggtgtaatcaggcagaggcaagcgtgtggcttcaatgctggtcaacggggagcatccactacatcacccttgatggccgtgtctacgacctgcatggctcctgctccatatgtcttggcccaagtctgccaccacaaagcctggggacgaggacttttccatcagtgcttgatgaaagaatgcacgctggacatctccaacagcctcctaggattactgtaggctggccaggttgtgagcctagctcagggagcagcacagtcaccgtaggacggcagaggctagtaggccctgcctgttggctagtgggccgcgtgcgggtgaccgcctgatgggccgaaacatggttctgctagacgaccaaggggctgcggcttctcttatgatggctgctgcccacctcctcatgtccatccccagccccttccgtggacggctctgtggcctctgtggggaacttacaatgtgcaactggagatgactgactttgtccctgcccaatggcctcagccagcgtccaatgtgagagcactctttcggggctgcaatgagcggggtgccacgagctccttccaaggtgctgtgaccgaaggcttgactaatcccaatagcttgcccaaagttgcttgtgcagcaggacaattgtaccctaatgagagcaactaaggcatg

SEQ ID NO: 527660 - DNA, 1103 bp, Homo sapiens
tagttttctctgagcattagtgtggccctctgtaatgtcatcatcctaattcttctccccaggcatgttcctacttaagttccacatccaccacaggtcctctcttctccaaacttgccttatgctctccttaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggtcagatcttttgtttctacttttcataagtgcatctgcttgtctgacaatcaattataatttatagttaggaaaataaggtcacatatcttgaatcacttgaaagccattaccctgtattgtattatcttatgtttatacttatctatgtctgtctggtattacaatttcatgtgtttatgcctcactctcccagcctgttcagaagtctggtgctgggagaggcatgccttgggttccttgtatccaccttaactcagggcctgccctagtgtcatgtcagttggattttcagcagaatgtggcattctaaatacatcctttattatcacattttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527661 - DNA, 1211 bp, Homo sapiens
  misc_feature (714)..(716): n is a, c, g, or t
  misc_feature (718)..(718): n is a, c, g, or t
  misc_feature (720)..(720): n is a, c, g, or t
  misc_feature (730)..(730): n is a, c, g, or t
  misc_feature (733)..(733): n is a, c, g, or t
  misc_feature (740)..(740): n is a, c, g, or t
  misc_feature (752)..(752): n is a, c, g, or t
  misc_feature (778)..(778): n is a, c, g, or t
  misc_feature (781)..(781): n is a, c, g, or t
  misc_feature (783)..(783): n is a, c, g, or t
  misc_feature (788)..(788): n is a, c, g, or t
  misc_feature (790)..(790): n is a, c, g, or t
  misc_feature (796)..(796): n is a, c, g, or t
  misc_feature (801)..(801): n is a, c, g, or t
  misc_feature (803)..(803): n is a, c, g, or t
  misc_feature (805)..(806): n is a, c, g, or t
  misc_feature (812)..(812): n is a, c, g, or t
  misc_feature (815)..(815): n is a, c, g, or t
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgtcggnnncncntatccccccnttnacccccngcccccccgccnccccctcccccccccccccccctgtnccncnccccncnctctcnccaancncnnaccccnccnctataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527662 - DNA, 940 bp, Homo sapiens
  misc_feature (106)..(106): n is a, c, g, or t
  misc_feature (276)..(276): n is a, c, g, or t
  misc_feature (350)..(350): n is a, c, g, or t
cctggccgagccctattttaaatgaacttattacctgatacgttttatcagaatgcttgtcatcttgcaaactgtgacactgaaagtatcattttgttgttgttgncgttattctcttatagcgttagaattttttgttttctcctttgatattcacgggaatctccgcttgatatgaggagaaggggctcagtgttttgttgtaagtagaggctttggttctctaaaaatgtgtagatggaaaagtgggagaaggtaacagcatagattaataanaacaaacattgatttttccaaaaacagctttacaaaacaattcatactacccgaaatttacatgtcaatatcgnttcattaattctgaacttattggctgccttctcctttccagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 527663 - DNA, 2657 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 527664 - DNA, 290 bp, Homo sapiens
caggactggggttcactttcagggtttcaggggacccataaaaaaaacttacctgggtttaccacccccaaaatggcatgtgggcctaccccctttttttaaagccttagggggtgggcatcacttaaccccgcttttgggataaactgggtgggagacattcaaagctcaagttttgagtgggtacaaacttggggaaaactttgctcctccctgggccttagtttccccatttgtaacaaggataaaatagaccctgcctcaaaggaataaatgggacgtggtaacga

SEQ ID NO: 527665 - DNA, 1922 bp, Homo sapiens
cagacagtttgtaaatacagacaggcacatgtgcacatagcattgcaatgcacatgcaaggtcagactcatagtaggataccccagggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 527666 - DNA, 174 bp, Homo sapiens
  misc_feature (126)..(126): n is a, c, g, or t
ttgctaatttctgcttctgcatgtctcacttactaatcacctccgaggctcatagactcttgtctctgtcttaggtggctctcagagtctgagactggtgagtagggaggagctgtcttgtgctgngacgttgtatgacttctctggttctgtgggtcaggagtcggggtgctg

SEQ ID NO: 527667 - DNA, 473 bp, Homo sapiens
  misc_feature (406)..(406): n is a, c, g, or t
tgcatacaaatgccagctatatatggttgtcgatactgttattatattcttctaaatccaaaattcggccaggtgtggtggcaaacacctgtaatcccagcactttgggagaccgaggcgggcagatcaactgaggtcaggagtttgagaccagcctggccaacatggcaaaaccttgtctctactaaaatacaaaaattagcccggtgtggtggtgcattcctgtaatcccagttacttgggaggttgaagcaggagaatcgcttgaacacaggaggtagaagttgcggtgagctgagattgtgccactgcattccagcctgggctacagagtgagactctgtcttgaaaaataaataaaaagggctgggcatggtggctcacgcctgtaatcctagcactttgngaggccaaggcaggcagatcacctgaggtcaggagtttgcaaccagcctggccaacatggtgaaacc

SEQ ID NO: 527668 - DNA, 508 bp, Homo sapiens
  misc_feature (7)..(7): n is a, c, g, or t
  misc_feature (207)..(207): n is a, c, g, or t
  misc_feature (258)..(258): n is a, c, g, or t
  misc_feature (286)..(286): n is a, c, g, or t
  misc_feature (320)..(320): n is a, c, g, or t
  misc_feature (380)..(380): n is a, c, g, or t
  misc_feature (385)..(385): n is a, c, g, or t
  misc_feature (403)..(403): n is a, c, g, or t
  misc_feature (424)..(424): n is a, c, g, or t
  misc_feature (435)..(435): n is a, c, g, or t
  misc_feature (445)..(445): n is a, c, g, or t
  misc_feature (455)..(455): n is a, c, g, or t
  misc_feature (494)..(494): n is a, c, g, or t
gcacganctgggcacagcaggacagaaggctttggagcttgtggcatgcatagaggaagtggggcttgcagaggaaacggccactgtttgtggactcctggccacgggaggctagctggctttacgcggctttagtttccctgtctggaaggctgcagatggattatccctgatccaaggctgtaggctgcacagggagcacttttncagcctgcggttcaggctggttctctcagataccaccgcataatggttgcnctaggtattacattttaatatatatggnacttatcatagtcttgctggtgtcgttatttttnccagttgggagttgaagagtagaaatcttcaactccattttatggcccttcacatttagnattancctttaaaatattttccnttttacatacattttaggaanccatattcagncagtggttantaatttttgntttttaagccacccaaaccattggttaaggaaaactttngctccgggagtttt

SEQ ID NO: 527669 - DNA, 674 bp, Homo sapiens
gtcacaggtcacttcccagccacatgccaggcaagcaggactaaactacctccaaagcaagcagtctttttcagttttgactgagtgatgtgagaaacttcttgttctttgtcttgttctttttttttttttgaaacaggcccccttattgtgccccaggactagatggcggacaaaaaaacaaaagtcatagagaacgggagtaatctcccaccctaaggtgacgagataagtactaggcagcgactcgccagtaatgacgaagcagcaggagacagggacccagaaagaacaagaatataggcacgcccgtgaatttctaccctctttaacgggagaaggtcgagacacttttgaggacaggggagaccatctgtgtgtctccccagtctaatcgcaggagatacacactactgtctccgagaaattaacgtagcaacactttgacgtggtgtgtagaaggctcttcgaataaagggaagtcgctatagccagaacgtctgtgagtaaacttgctataagagcgcgagttatattactcatctataaaagagtttgaaggcacaaaaatttggataccttccgacaaggggggtttatagaaaagggggtttacacgaaaaaacgtgctttgggagaaatttccaagtaagggggattcccaacaaattttt

SEQ ID NO: 527670 - DNA, 427 bp, Homo sapiens
tcaggtgctgcgatgatgcctcatctagtcaggactaaattgtgtaggaaactgcgttgggaagaatatgcttactgctcaggctacgagggtcactgctctgtccttagaaattcagagtaacatgagcataacctcagctaaaacccattttagtggcatggattgtgcatgatcttcgataagaattcctcatgtacttgtgcctagttttacaaggtataggctgtactatagatgcagtgattgtcccagctagctctgttaccagccttttggtgtagtctttatgtacatttggagagtcagggcgaaagacaggtgatgtagcacttctgtatataatcattattgcttaacatacctattaatagtttggggtcatttacagggacttgaggaagctacccaggattacagaagagtg

SEQ ID NO: 527671 - DNA, 864 bp, Homo sapiens
gtttttcctgcttgttgtagctccaggaaggcaaggcctatgtctgttgctctccaggctcttaaatccctggcgtgaggagtaggggctgttagggggaagataaagtttagccagaggtatctggatgtggggcctgtttctttagaacggctgtggctgtgcgactggtgctcccatgagaggtgatgtctccttttcagtgtgtggcgatagatgtgtcatcaccagtcccctgaatgactttcagccaggtccatggggtaagggctgaccgcaactgggtgcatgagtgaccctgtagagggaaagggttagaccgacatcctgctgtctagtgctgtgtatatgcctcagagccgataacatcattccgtttatccagactggtgtttattactgcactttgctgttatcctgaggtcttaacatgtgtactggtactatgccaaacacttcagtattccttcaatcagatagcctgtaagtctccgtgcgtgtgtgacagactactgttcgaatttctagggaataccacaatgaacaaaaccgcaagagattcctgctcccgttggaaaggcggaggccgacagaaacataaagcctcgctgatggcagaagtcccgcggggaaaacttaagtggggaagcgggaacagggagcccacggggggctacaatgtggaactttctgtttcactctcacaactgcttttgtgaggagtacataccactatgttacagaagaggacactgagtgcacagagaggttgagtgagtcgtataacggtcacgaacgtaatcggttgacgcttggccttgtgatttgttttgtaactacttcttccttcctgttaacaggaac

SEQ ID NO: 527672 - DNA, 169 bp, Homo sapiens
ctagaggaccctataaatgttggtcattgattggaacggacatttaccgttactatgccgcaaacatcgtaaaaatttgccgatctttattgtttcacacgtaacagaagggaggtttggcaatgaatttatatacgcgtacaggggatcaatgaccaacaatttattg

SEQ ID NO: 527673 - DNA, 143 bp, Homo sapiens
taggtgacttgaggatcttcccgactagccgacagtacagaaggaagtcatggttcagctcagcctggagctgttcaaggaagggtaagccagaggtctagaaccaagactgcacagagcaggcgctgggagcctgccctcgg

SEQ ID NO: 527674 - DNA, 638 bp, Homo sapiens
aaaaaaaaaaaaagatataaaaaaaaaaaaaaaaaaaaaaaaaaaacatgggattttaataaaaacaaaaaaaatataaactaaggcaaaatttaaacaaacaaacaaattaaaaaactaacttaaccaatctcaaccctataatgactcatattacaattcactgcccacctttttacaactttcatacttcaaaacccttttcgttacccaatttaatccccttgcaccacatccccttttccccatctccctttatatccaacaaccccacacctatcccctttcccaacattttcccaccctaaattgcaattgcaaattgtaccccttaatatttttttaaaatccctgttaaatttttgttaaacaacttcattttttacccaataccccaaaattcgcaaaatcctttataaatcaacatattccaccgaaatatccctgactttttccccattttctcaccaaaacccatttttaaaaaccttcttcccaacttcaaactcccaccctttacatccctttgccccattcctaaccatccccctaataacttttttgccacaattccctaaaccacttgcaccctataagtaccccccctttacactttcaccgaatcctctcttattcct

SEQ ID NO: 527675 - DNA, 514 bp, Homo sapiens
  misc_feature (395)..(395): n is a, c, g, or t
  misc_feature (452)..(452): n is a, c, g, or t
  misc_feature (479)..(479): n is a, c, g, or t
  misc_feature (492)..(492): n is a, c, g, or t
attacaggcttgagccctgcacccagcctgtaagatattttaaaatccacacttggccaagcgtggtggctcacacatataatcccagcactttgggaggccaaggtgggcggatcacaaggtcaggagttcgagaccagcctggccaatatggtgaaatcccgtctctgctggaaatacaagaactagccgggcgtgttggcttacacttatggtcccggctactcgggtggctgaggcgggagaatcgcttgaaccaggaggcggagtttgcagtgagctgagatcgcagcactgcacaccagcctcggcaacagagtgagactccgtcttgaaaaaaaaaaaatccacgctgttttatatttctaacatgggggtaggataccatccttccntgaattagggtgcaagtgttgttgaattgcagatggggattcttttcccagttagcntgacagagaagttgagcatttcccttnggcaatttttttnaggaatttttccccggggagaa

SEQ ID NO: 527676 - DNA, 202 bp, Homo sapiens
cccctttttttttcccccccccccccccccccttttttttgtgggggggggggggggggggggggggcccctccccccccagggcgggggggttttttcccccccctttgggggggggtttttgggggttataaaggggccttttcccccctggttttttttttttttttccccctagggggggggggggcgggggggggga

SEQ ID NO: 527677 - DNA, 587 bp, Homo sapiens
tgtacatgaacaaacacaggaacccaaagccccttttccccacaatcctccccacttacattatgggaagaaatgtctttaaatggacttggtctacatacatatagcaccgaacccgtgaataaaaatatctttatgaagaattttgttgtgctattatcttagggttgaatcagggccaagatggaggcagaggcaagtgaggtctggggatctcttagagatcagaatttgtctgagaggcacagagcctatagttcacccagaaagggggatatatctaagaggacaggggctagaactggctaggctgaaagttttttcaagtgtatgtgtgagggtaagggtagctataaatccattctctttccttccccataccttccctagctcccagatagaagggcaggggaccctgaacagggaacagagtcacaattccctcaagtttcatctgattcccacagagcttccagcaggcagtgagttgggcatatcccctggtgctgcatgaccccttcccccagctcagggctttcttctctccacctgtgagcaccagggcctgcaggatgtcagacagtgat

SEQ ID NO: 527678 - DNA, 732 bp, Homo sapiens
  misc_feature (55)..(55): n is a, c, g, or t
gcaagagggaggaggagaaggaaagagcttgaacagcgtggaagcgccatgaacncaatcggaaggacgagggaaaagggggagaggagagggaagggaggaaaaggggagaggttaaggaaggaaaaaagggattggaaaggggagggaaaaggaggaaaagaggggaaaaaagaagagaaggaaggggaaagagagaaagaaaggaagaggaaggagagaagaaaagagaaggggaaagaaaaggaaagagaaaggaaagagaggaaaagggaggaaaagggaaagagggaggaagggaagagaagggaaaaaaggaagaagggaagagggaggaagagagagagagaaaaggaataaagagaagagaagggaaagagagggaaaaggtggaaaagagaggatgagggaaagagaggaaaaggaggagagaaaaggaggaagaggaaggggaaaaaggagagtggaaggagggagaaggaaagagagaagaaggggagaaagtggggagaggaagaaggggggaaaaaaggggaaagagaaggggaaaaagaaggaggaaagggggggaaagagagaagaagagggggaaagaggggaaggggaagaaaagaaaaaagaggagaaagagggaaaaggggaaaagagggaaaggaggagaggaagagaaggagagaggaagaagggagagagggggggggggagaaagaggagggaagataggaagggggg

SEQ ID NO: 527679 - DNA, 359 bp, Homo sapiens
tgcttgaagaagagtactaaggaagtgtttgatgaactagtggcccttttgcagcccctgccctgtccttgctttgccccagttctgtcttcagaggtttgccttatggaacttccctttgggagcaacacttcagaccaggatctccatggctctggctgtggggaatggcctgaagacacctctctctatttgtacttcctacaggagcttcatgaacaactgggaggtgtacaagcttctagctcatgtcagacccccggtatctaaggtactggcaagttgacttgccctctccccttttccttctccaacccccagtctctcttcataaatgctaccacagtccatacaacata

SEQ ID NO: 527680 - DNA, 833 bp, Homo sapiens
  misc_feature (833)..(833): n is a, c, g, or t
ggtggctacatctgccgatctcattcgttccgagttatcgaactgcgggtttgcagtaacatcccgattgtactcatagccactctgctagtaccagcctgtactgctcgtcaagtagagatgaactgaagaagctttaggcctcatcgcagtctgagtctcgcaggggccaacccatgatgggcaaaccagccgttgtaaaggagccattgtaagagagcttgacagtaaagaccatgaggcgcatagagaaaatcgagaagatgaaagaagtcaagggatgcatggatctccatcttgtgaaattccgatctggtgatacgagactttagagaatcacagagatcagaccagctccgacgagaacgaaacgcttcgttttggtgcacccaatgcgctcacttcctgggccacactggtcgaaccaaaagggtcgcaaaaggcaagtaagggggtgcagagacatcgcttcggtttctggacgacattgatttgcaacaggcaatgcgattgaccaaggcgatgcgtacaagcacgaaatggatcgtcaaagaggttccttgcgtcacaaagtaacgcattgcatgccaaaccaagacagatgcgaagcaatggcataggctttgcacgtacaaagctagtacttaccatgcaaggcgtaacggtgacgcattgccagcaaggtgacctgtccagtctacggctaacgaaatgcttcgtacgtaataccagatgcttgcgataccaaattccctggaactggatatacaagaactgggaaacgattaactgccagcatctatgaggaatgctatcattggaggctccatggn

SEQ ID NO: 527681 - DNA, 306 bp, Homo sapiens
agtttgggggcataggatatgtggggtgtagaatggactggatctagtcacaatcccagagatgggcagagttcgactgtgggatggagttccagctgtgcagaatcctgaccctggagttgaaactgtcgctgtgctcccccctcagaccaaagatgtgaccaaggccatggatgagaagaaatttgacgaagccctgaagctgagaggccggtgaggagatgacgggaagctcactagctacagaaatcagaggcgtgaacgaagccaaagatctccatggctccaggcccaaaacatgagctt

SEQ ID NO: 527682 - DNA, 1750 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527683 - DNA, 1387 bp, Homo sapiens
ctcaattttcatgtctcttccccttccaattccccttcccctccccgccatcactgatcaactaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527684 - DNA, 1699 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaatttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527685 - DNA, 331 bp, Homo sapiens
  misc_feature (85)..(85): n is a, c, g, or t
aggaacccccatttaaccccttttttttttttgctttcatttttaaaaaggaaaaaaggacctgtcagataggcagccccctgcnacgtgattttttatggtggggtgttttgttttggaaaatggaaaattttttaaatctgggggttttaaaaaaaaaaaaaaggccaaaaaaatcttgttatggccttaaaaagggggtagggcatctttcaggggtccctttgccatggggaaaaaaaagctgtttccccaacagtttttttttaaaaaaccaaaaaccaaaaaaatccaaaaatcaaaaaaataataaacttctttttacccttga

SEQ ID NO: 527686 - DNA, 1662 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527687 - DNA, 665 bp, Homo sapiens
gcatggacgccggcgcgtgcctactcgcactatcacggcggagcccgcatcctttcggaaacggcttcggcgcgccttgcttcaccgctcgtgatcaagttcgaagagttgcgctcgcgcgacggctatgacccgcaaaaaccatcggataactttcccgtcgtctggcccggcggcgagtggcacctgcgcgacatcacgaactacatgacgaccgccgctttcgaactccttcgccacgccgccgtcaatcgtgaacgctggctccggcgcttctatgagatcggcaaagaggcgattcgcgagcgcaaagagggcgaactcttcgccttcgtcgttccgccagcaccggcaggctccgaccgggcgcgccgcaccgaagtgctgctcgcgacgctccagcgcggcggcgtcgagatcgaacgcgcatcgtcgtttgtcgccgacggcacgcgctatccggacggcacggcagtgatacgcatggcgcagccgtacggtagttttgccaaagctctgctcgaaagacagacgtaccctgatctgcgcgacgcagcgggccaaccgattccgccctacgacgtgacggcgcacacgctgccgctgttgatgggcgtcgaggtgcgtcctatcttcaagccttttcaatacacggcgcgcaaaga

SEQ ID NO: 527688 - DNA, 1209 bp, Homo sapiens
  misc_feature (14)..(14): n is a, c, g, or t
ccttgtgattcacncacctcggcctcgccaagtgttgggattacaggcgtgagccactgtgcccagcccatagtctctagttcttaacaatgcagtttggtgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527689 - DNA, 1585 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacagcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527690 - DNA, 142 bp, Homo sapiens
caaacgtataattataggctcgtaataaacatcttccgcttcccggccgagagtcctttcttacggtctcctccaacgagtagtttaggcctcttcaataagtaagatagaaaaggctcaatgaaacttacaatgaattgat

SEQ ID NO: 527691 - DNA, 169 bp, Homo sapiens
  misc_feature (169)..(169): n is a, c, g, or t
gtgctatcaggtctctcaccttagctggctagaaaaaaaaacttctacagcctttctttgaagcctctcaggtgccacttttggagatggccttcagagcttcctaaggcttgtaggacttcaaccaaggatttccaaagcaaggaggggtttatattcccagctcttn

SEQ ID NO: 527692 - DNA, 1696 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527693 - DNA, 623 bp, Homo sapiens
  misc_feature (623)..(623): n is a, c, g, or t
agccatgtaaagagatgatgatgctatacagatatatgagaggagattacacgaggatacacctaacacatgtgtgcacgagaagcgtaagatatgcgcattcgaaaagcgccacaggaaaaatgtgggaggcgcattcgggagctgaatgagtatctggaacacatttggtggagacacacagaagcctggcatgagacttgcagaactttacattaatgagacatgactatgccaaagcaggcttttggttagagagagactaatgaggactaattcacacaaccacttatactgtgagcagtatgctgaagataagtatacccaaggtggacttggaaacctcgaactcttaagaaagtgttttgcacaagcattggaactcggcacacacgaaatatgagagctttggttggactcttatatgtcggcaagtcatattgcgtttaatacgccagtgcgcaaacgatatcaatttgcaagtcgaagttagaaggagaacccatattctcttaaagctgtcgaagacatgttggaaacattggagatcacccagtcttaaagtgttacaaactctctgacactagatatcacaactgtgctgcttattgggccggactctn

SEQ ID NO: 527694 - DNA, 100 bp, Homo sapiens
  misc_feature (34)..(34): n is a, c, g, or t
  misc_feature (86)..(86): n is a, c, g, or t
tccaggagaaggaaaacttccacttataactgtntcagcctgactataatgaagagactagcaacacctcctgaacacaagcctantgagcccagtcttt

SEQ ID NO: 527695 - DNA, 976 bp, Homo sapiens
atgctcatagctgattctagagggtaaaattacggccagggaatccccgagaacggcagtcgcatgttgaacaggctgaaacaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtca

SEQ ID NO: 527696 - DNA, 345 bp, Homo sapiens
attcgcgggcgcgtcgacaaaaggttgttggcactttagtaggaatagcattgaatctgtaagttctttgggcagtatgacaattttaataatactgatttttcctatccatgagcatggaatgtttttccatttgtgtcttctctgatatttttgagcagtgctttgtaattctcattgtagaggtctttcacccccctagttagctatattcctagatatttgattctttctgtgaatgggattgcctttctgatttaactcttgtcttggctggtggtggtgtacaggaatactagtgttttttgtacggtgatttttgtatcttgaaacctttgctggaag

SEQ ID NO: 527697 - DNA, 113 bp, Homo sapiens
ttgcgtgtgatgcgcacaggatggtgtgaatgtgatcatacagtaaatagcttttcgctgccgtgacttcttttgctcttgcaggacaatgtttgaggtttatccacagttgt

SEQ ID NO: 527698 - DNA, 382 bp, Homo sapiens
agacgtaatctcgctctttctttctttttgttgagggggagtgtcgctctgttgccaagtctggaatgcagtggtgcaatattggctcactgcaacctccacctcaggggttcaagcaattctccttcctcagcctcccgaatagctgggattataggtgcctgccacctcacctggctaatttttgtattatcagtagagacaaggtttctccatgttgggcaggctggttctctaagagcacttgaccaactcctgacctcaagtgatccacccgctcagcctctgaaagtgctgggattacaggcctgagccactgcatttgcccagattattatttcttaagcatgttcactacgtaattgattcctagatgttgaaa

SEQ ID NO: 527699 - DNA, 878 bp, Homo sapiens
ggcggtggctcacgcctgtaatcccagtactttgggaggccaaggcaggcggatcacgaggtcaggagatctagagcatcctggctaacacagtgaaaccctgtctctactaaaaatacaaaaaaattagccgggcgtggtggcatgcgcctgtagtcccagctatgtgggaggctgaggcaggacaatagcgtgaacccgggaggtggagcttgcagtgagctgagatcgtgccactgcacctccagcctgggcgacagaacaagactccatctcaaaaaaaaaattttttttccaacaaatttgtttttgataagaaaatatctgataacttattaattatctgcccccatccaatgcaagatggaagtagtgctgaacattaatctagaacaattcagactttttaaatatatccataagcttgtatgtttgacatcatgaagaaaaccacatattccctaaaatatattatacctttatgtcctaagcagagacagactatggcgtgaatttaggtccaaattggaatttagcttgcccatagcctttttttttgagcacatttttcaccacgcttattagttttcatattttccattcaactccctctgggtatctaagactagaaattgaatgttacctttcaatacaccttgtccaagttaaccccctgtaattagggcttcagtgcagacctggggaccctagaaattcccagaaacaattttcgcaaacaaaatcccttaaaatatggtatttagacataatctcatagtggccggacatcaacggttacgttgtgctctcccaattttcgtagagcggtctagaagggtcgggtagctcagagacacgaggaacgcgggagaagattc

SEQ ID NO: 527700 - DNA, 184 bp, Homo sapiens
acaacccaaggcattacggacaaagtggtttctcttgcctctctctgttggcaagatcagaaatcggagaagtcattcttgtgaggaagaccacgctaccctagtgaatcaggaaagtgagcaatcagatgatgaccttctgccactttccagtccgcatggcaatcccattggtgacaagcct

SEQ ID NO: 527701 - DNA, 156 bp, Homo sapiens
gccctgacaagattatacacttcctttaccgaaccaatttcagacagccatgttggcttcagccctttggcctggcatttgtcctgggagtcgtcatcgtcaccctcaacatccactcaagaaagcaaactcatcggtgtagtgtgggaaatgaac

SEQ ID NO: 527702 - DNA, 166 bp, Homo sapiens
actctatgagtatcccttcgatgtggtactcagagtacacacatggaaggagcagctcaaataggggcttggaaagggccctgtgaggtcacccgtgtagaagggcccatcagacctcagcagccccttcctctctgggacacgagtcccgcctgacggagcgagg

SEQ ID NO: 527703 - DNA, 130 bp, Homo sapiens
tccctcctttccgaactggagccccatcctctccagagtatccagggcttcttcactcccgggtacctgcccttcggccccttttcaccacagctgtgctactgtcaaccagtctttgctgcataggcat

SEQ ID NO: 527704 - DNA, 1096 bp, Homo sapiens
ggagaccacaagcttagagagcccatgtctctgatggtaaaatattgtcgatttatgcgctccgaattttctacacggtgaagctgcttgcagaagtttgtaacaactgttatcttccgtgtaccctatggtagaatctattctgtcagggaagaccattgcataagtacaattgagtgcgttcaaaagtataaacgcagctgggctacggcctgtaagagccctgatccccaacaggacttccagagtttctggtttactcatcgttcagaaaatgtggaccatgctgagtgaaattagtccaggtaagctactacttctggtcttgtagagagattatgtgctagtcttctaacattacttatctatggcattttttaacgcactatcactgggcattgaaagattgcttcatagtgggcggaagggcactttctcttgaccaggacctcagactgagcagtcctgatctcacagtgaatggtctgaatcacagtggggctgtccatcgctgtcttttgcagttcttggctggaaatgcatgggcgcttacagcctgatcctatactttcaaatcaagttccttttaacctcttgtaaagcgtctgttgtcttgcctgctgggaaagcctatgaatacgattccacgagcccatcatctgtcttactgtggatcgctgatgtagtgcagcgaaagggtgagggcaggatgaccagagcagaatgaattttgaagggatgagctgtgtgtttgtttgtgagtagtgtgggtacacacacatctcagtgaattttttgaacaagttgctaatattttctgatcatattctctgagaaaaaagtgtctacttttttttacagaaaagaggccaggcatggtggctcatgtctgtagtcccagcactttgggaggatcaaggtaggcagatcgtattgagaccatgctctgggcagcatcgcgaaatcccatctctacaaaataatagaaaagttagctgggcgttcgtggtgtgcgccatgtaggtcccaggtacttgggaggctgaggcaggaggatcacctgagccgaggaaacgaggctgtggtgagtctgtga

SEQ ID NO: 527705 - DNA, 389 bp, Homo sapiens
actagcataacactatctgtatgtctatcctcgtcagacccgctgctcctttttcaactaagtttaagtcatattctaagtccctcgttgccagttgaataatgctcacagcatcttcaccaggactagattctacctcaagaaaccacgttctttgctcattcattaaaagcaactcctcatccattcaagttttatgagattgcagcaatccagttacatcttcaggctgcacttctaattctagttctcttgctatttccaccatatgtgtagttgcttcctacactgaaggcttgaaccccttaaagtcatccatgagggttggaatcaacttcttccaaactcctgttaatgttgacactttgaccttcttcctgaatcatgag

SEQ ID NO: 527706 - DNA, 274 bp, Homo sapiens
tgggatctgagccccttatgttcttctggcagtagcgtgccctccagacacagccctctggctgcatctcctgcctcctgcccactccccaaacccagtcgcccatgagcccagcctcctccaggaagccctcaggcttccggcatgtccatcaggaagctgcaggtcccgggctgactatgaaggaccagctgagagtcgaagcttcctgaatttcaatctgctgtgtagcttcagagcacgcacctgtgggctctctgaacctatttcccca

SEQ ID NO: 527707 - DNA, 857 bp, Homo sapiens
gaacccggaaccatggacagtgtccgctcagggcctttggtacatctcttcggcctgagactttcctctttggtcagcagtggggccggcacaactgggccaagggtcactacacggaaggagtgtgaaaactgctaactgcctgcagggcttccaagctgacccactcgctgggtggcggcacgtggctccggcatgggccgttgctcatcagcaaaggtgcgtgaggaatatcccgacctgcgataatgaacaccttcaagcgtcgtgccctctaccccaaggtgtcgagacacgagtggtgatagccctacaacgccatcgctgtccatccaccagactggtggagaacacggatgagacctactgcatcgacaacgagtgctgctctacgtacaatctgcgttccgccatccctcaagctggccacgcctcgactctacggggacctcgaagtcacctggtatcggccgaccatgagcggagtcaccaggctccttgcgcttcccgggccagctcaacgctgacctgcgcaagctggccgtcaacatggtgcccttcccgtgcctgcacttcttcatgcccggtttcgcccccctcacagtcccggggcagccagcagtatcgggggcctgagcgtgcccgagctcacccagcagatgttcgatgccaagatcatgtatggccgcctgctatccgagccacggactgctacctgacggtggccgccgtgttccgggggccgcatgtccattaatgacgggtggaccgacagatgctgggcatccaagaagcagaacagagttactttgtggagtgggatcccccaaaggtgaaggtggccttgtttaatccgc

SEQ ID NO: 527708 - DNA, 162 bp, Homo sapiens
atggcccctggtattactttcccgtgttcgtcgcgccatcattggtatatggttcgtgtgttggttagtcggcctagtatgaggagcgttctggagtggaagtgaaatcacatggctaggccggagttcattaggagggctgagagggcccctgttaggggt

SEQ ID NO: 527709 - DNA, 142 bp, Homo sapiens
tagccgaggaggtaacgtacatctcaatgtatcccagcaaagatacaactctagtaggtcaaggagggatagctatccttgtattgcgatctatatagcctatgacattactacaataggtagtacactacaggctaccact

SEQ ID NO: 527710 - DNA, 604 bp, Homo sapiens
  misc_feature (42)..(42): n is a, c, g, or t
  misc_feature (60)..(60): n is a, c, g, or t
  misc_feature (70)..(70): n is a, c, g, or t
  misc_feature (78)..(78): n is a, c, g, or t
  misc_feature (84)..(84): n is a, c, g, or t
  misc_feature (95)..(96): n is a, c, g, or t
  misc_feature (102)..(102): n is a, c, g, or t
  misc_feature (117)..(117): n is a, c, g, or t
  misc_feature (320)..(320): n is a, c, g, or t
  misc_feature (376)..(376): n is a, c, g, or t
  misc_feature (394)..(394): n is a, c, g, or t
  misc_feature (554)..(554): n is a, c, g, or t
  misc_feature (565)..(565): n is a, c, g, or t
ctgtgcccttccgctgactcctactgttcctgaggtgcaatnctgttgtaacacaagggncaggctccantctccctncctttncaccagtgccnnagcctngtctggaaaaaggancaggggttccggaggaacccatttgtgctttgcttggacagcaggcctggcactgggaggtgggggtgagccccttacaaccttgcccctccccaagggtggcaacctgccttccattgcccaaagagagggcagggaacagggtactgtcctttcctgtggaaatgccgaaaaatttagccccttgcatgctggatttgggntgcggggaggctttttttttccctggcctccagtgccccccaggaggatttgggcncggtgcacagccccccanagcactacagccttttatttagtggggtggggcaaatgctgggctgtggttgtgccctgacagcattttccccaggcaacggctttgtggaggaggccatactcccctagttggcccctggggccccccccctgaccccccctgtgcccctcattgttantaccttgtganataaaaactgatttaacctttgtggctgtggttggctga

SEQ ID NO: 527711 - DNA, 282 bp, Homo sapiens
cgcaagaagcttagtatactaggtacagaatatataaataacttaaataatttactaagagtagtaagcgttatttgcatcagtaagacagggaacacagtgactgcttttgcttggtttggtgagacagggtcggctctgtgcccagggtggagtggagtagtgcaatctcagctcactgcaacctcgatcacccctccatcgccgctccgaagcgcccgcaagctcggtcaagcgatggtcccaccacagcttccagagtagctgggattacaggcgcct

SEQ ID NO: 527712 - DNA, 780 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggcccccccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527713 - DNA, 270 bp, Homo sapiens
gaggccttgtggagaagggctcagaaaagcctgactagagtttggttaaggagagaatcttggtcagcagctgtgttagttaagaggctattgcagagtccaggaggaagatcatgggggtttggactgtgggtagcagtatacatggagacaagtagatgattatgggagatattttagagagggggctaagaagacgtgcttttgaattggtatactccctgtggaattgattgaaaatggtttctttttccttgactgaaaaagact

SEQ ID NO: 527714 - DNA, 3107 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527715 - DNA, 195 bp, Homo sapiens
tgtcaccaagttgttattgattaacgtacggcagtttctgtgtgtcagcactattctcaatgcagatgctgttgaacagctcttatgaatttatttctcgaggcagtcctatggggcattaccattatccccattttgcagatgaggacaattgagacacagagaagttgagtaatttgcttagggtcctttaca

SEQ ID NO: 527716 - DNA, 2805 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcaccaagcaccagcacgaattccctt

SEQ ID NO: 527717 - DNA, 2426 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagcaacttggtcacacgcacttggtcacacgcaatttggcaccctctaaatcaccacgatcaaaagg

SEQ ID NO: 527718 - DNA, 1741 bp, Homo sapiens
  misc_feature (1679)..(1679): n is a, c, g, or t
  misc_feature (1727)..(1727): n is a, c, g, or t
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagcttnctcaccaggttcagcaaggaggcctagagaggtcacatgacttgctanagagagatgcgcat

SEQ ID NO: 527719 - DNA, 332 bp, Homo sapiens
gtagagagtatgaagtttctgacctgagtacgagaggtgactcgtccaggggtctgtccagttgccggaaattcagtgcatgaagataagaacgttgctggacgaaactacatgccccacgttcctgacaaccctcttcattactacgaataacttgctgtgacgcactgttaaacgacacctgtgcagaccgcctggtactccacgacagaactactgacaatttgcaaccaaacagaacgggctgcttcctcactagggccaccttgactgagcacttacgtgacacggcattccccatatggcctgaccgggtacccgacgctcgaact

SEQ ID NO: 527720 - DNA, 1656 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttcttctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527721 - DNA, 318 bp, Homo sapiens
  misc_feature (314)..(314): n is a, c, g, or t
agaaaaatcaacatgggtgggtcaggctttacgctgtggtactgcctccctttctgatacagcctgatgttgggagctgcataaaggctcattaggacccatggcagtttggtttgtaagagtgttttaatgaatcataaaacctccgtgaatttgccatccactgacatggtgcagcctggaaaatttccgtgcctcctgacttgagtaactgtaaggcatattgtggtgtgatacagttaacataggctatggaaagaaaaaatattcctttcaatctgcagcaatcctccttcccccaaataatataatancccc

SEQ ID NO: 527722 - DNA, 1639 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527723 - DNA, 369 bp, Homo sapiens
catcataccatcagagcccagataggtgtgatgactcacccatgtagacaggtatgtatgttgacagctattgaacaccagaactagtgcttcagttgcgacgtgtatcgtcgatcctttgagcgacctcacatatcctcagatacatcttctccagagccaatcttgtagtagctagaacttcatggggggttctgtcacaagcttagaataccatgatcttggtgtcgcaacgcttcagccatgctgtcggtggtatctcgggtaccgttctcgagaactgcatccttggtgcttatcttgttgcagcttgaacatcataaagtgtacttacacaaacctagatgggataatctgctgcacacctag

SEQ ID NO: 527724 - DNA, 1525 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccaccccccccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527725 - DNA, 1435 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527726 - DNA, 1307 bp, Homo sapiens
cgtgacgtacccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccctcccctctgtactgtccccagtggtatgtatgtatgtgctaggcagtctggggaccccctgtgtctctgaccaccccccccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaaaaaaaaaaaa

SEQ ID NO: 527727 - DNA, 407 bp, Homo sapiens
acctttactcacaggcggaggttacgccgacgatcatctggtctgtacgacaatcgaccagtgtgcaaacagtgggaagaattccgcgaacagtacacaccgtgggtgggtacatcagcaccgaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgac

SEQ ID NO: 527728 - DNA, 180 bp, Homo sapiens
aatgcgatatcggtgaagcaaatggactcgttgacgtggcagataggccttgaccacaaacataggtggtgctgtgcatcttggactcctcgaacactgtgtgcccgcttcctgttcaaatacccctgtacgatgccacctgaccaccgtgctcgtggacactttgatctcgcacacagg

SEQ ID NO: 527729 - DNA, 1018 bp, Homo sapiens
cggcacgaggtctttttgtataactaatctcaaatgttatttggagtgagaaagagtttaaacaaatatcactaatgaccctaacttcactttcttgtgaggtgtggcagtccctggaccctgattccctgtgggcaactggatgcgctggagcttctggtcctacagagctgggattaacccagctcttttgatatgttgctcagggttcttggttccacaatcagactaactcaagctgtaagcagaaaacaaatttattgaaaggaggtcaaatagtttacaagagagctaagaatgctggtgaatgaggcctggtgtatgggaaaaaacacaggaagcaaaatagacccaagatggcatgtgaagtctgtttaagaggctaccattggcattgtcaccatgaccactagctatgatttcaccagccacacctgactctaccctccatcagaggcaccaaccttaatctctaaaggttcactggaaatttgcattgctcagtgaagaatcaaatcctagccagatgttcctagtggcctgagcttccggggaaggaaatgtctaaccctttgggcttgggctttctttattggtatttcctgaaataggagggcagggcaggcaaaatagtcaaaagtccacttcacttggtgaccctgtgaggctctaccagagcagccagccaactcatgtccctggtttattgtcacctctttttttttttttttttttttcttgagacacttgttgcccagactggagtacagtgagccaatatcgcaccactgcactccagcctgggcgacagagtgtgaaactctgtctcaaaaaaaaaaaaaaaaattcgccagttcttttctctgccctattgaaccatatatgccagagaaagagcccccaaactgtgttttttaaatgctgcaggtaatcattttcatctggaagttctgggaaaattgttctaagccaacctgtgatctcagcaaataaaacactaaacaaataccaaatttaa

SEQ ID NO: 527730 - DNA, 180 bp, Homo sapiens
aatatcttcatccaggattgatatctagtgtagtctatactcttctaataccatattatcctaatgtgcttctagttcgagataaactcttttcttctattagtaggctgtgtggcgaggccacaataaccgtgagtaggagatgcaggtttcccatacaagttcctgattagaactagg

SEQ ID NO: 527731 - DNA, 495 bp, Homo sapiens
tgtataaccttgatggtatgcccctttaataccagttgagctcgagggttgaatcatgaagggatacggatatgacaaatgctagtctgagtctgttgagatgatcatatgatatcgtcttataaatagggtgtatgtggtgtatcacatttattgattgagatgtgttcaaccatctgtgcgttcctgctgtgaacaccatttggtcatgctgtatcatattgaggatattcttttggattgggttagctcgtatttcgtagaggatatcagtatctgtgttcctcaggtatactggtctgtagttgtcttgagtatgtcatgtcctgtcctggttacggtattggggtgatgtcggcttcatagaatgactgaggatggatttcctcttgctctgtcttttggaatagtgcactaagatgggtacatttcttcttgcagtgtctgatagagttcaggtgtgaaaacctctggtcctgtactacttgagttggc

SEQ ID NO: 527732 - DNA, 202 bp, Homo sapiens
taaatttatttatgggtgtaaaaccacctttggaaccagcaattatcaagtctgaaaagcaattgatgttcccattaatcttttctctggggggaaacccttatttctaaggattataccatcctgtaattgaagttaccataacagtattccataagcagccttttattggtcaggaccattgccgtgattttattttaat

SEQ ID NO: 527733 - DNA, 788 bp, Homo sapiens
gaagacagttgatcatgactcaagatgcattggtgataatatgtgggctcttagctcttatgtatttagggatctactcactacactatttccaagatgtccctgatttgtatttacaagaacagtcaatcagagaacccactcgattaaccaatgaatcctcgatttatcattctaacaaaagcagcaacttaagagttgggttggatattagatacgattcatataaacttagaagtggaaatttgaatgatatctgggaaattgcaattcaatttgccaagaagaccgatagaggtataaatatcgacaataatttaattaccattggatatattaattattgtattgaaaacctacaattgggttcacacaaagttatttccattcctaaagattataaaattgatagtaaatggttggttgtgttatttgtgggtttgttaaacaattgactgttgagttttatattgataagccgattgctgatgatgctattgatatttcaaaaatatgtttaccatcacctccgcaaggctcttacaagtttattaacaaattatacaccagagaaagatcaaggtattgcatcagatttacaccaatcaaatttctcaaggaataaagtcgatagtttgattttacaccaatttgaatatagtccagtggggttgcatctacaatttaaacactttggccaaattctgatactttacaggaattcaaacaatggtgatgtactcggagcaattccacacaagaaggatatcacttaattgattgttaac

SEQ ID NO: 527734 - DNA, 157 bp, Homo sapiens
ccttcctcggaatgtgcgtatgctcggttcagaacatatcctctctactggcgctgcaggtgtggcaagtcatcctagctgaacgggagctcagctgcatgcttcgtgtcgcactgccacgtgtcagtgttggactgacctgtcgggctagtcgggg

SEQ ID NO: 527735 - DNA, 305 bp, Homo sapiens
  misc_feature (6)..(6): n is a, c, g, or t
  misc_feature (29)..(29): n is a, c, g, or t
  misc_feature (33)..(34): n is a, c, g, or t
  misc_feature (36)..(36): n is a, c, g, or t
  misc_feature (49)..(49): n is a, c, g, or t
  misc_feature (64)..(64): n is a, c, g, or t
  misc_feature (109)..(109): n is a, c, g, or t
  misc_feature (114)..(114): n is a, c, g, or t
  misc_feature (116)..(116): n is a, c, g, or t
  misc_feature (123)..(124): n is a, c, g, or t
  misc_feature (126)..(126): n is a, c, g, or t
  misc_feature (131)..(131): n is a, c, g, or t
  misc_feature (146)..(146): n is a, c, g, or t
  misc_feature (161)..(161): n is a, c, g, or t
  misc_feature (172)..(172): n is a, c, g, or t
  misc_feature (184)..(184): n is a, c, g, or t
  misc_feature (186)..(187): n is a, c, g, or t
  misc_feature (196)..(196): n is a, c, g, or t
  misc_feature (201)..(201): n is a, c, g, or t
  misc_feature (210)..(210): n is a, c, g, or t
  misc_feature (236)..(236): n is a, c, g, or t
  misc_feature (241)..(241): n is a, c, g, or t
  misc_feature (243)..(243): n is a, c, g, or t
  misc_feature (274)..(274): n is a, c, g, or t
tgtaanatcttttatttgtatacaattanaaannanaaacttgttttantaggttttttaaaanttatttttcgtcaacttagtcccttttatttaccagcagtttgcnctgananaaaaaannanaaacnattgttttgtttaanccctttaaccaacangtcaggcacanagggtggagaanannagcccccantttanggacagagnggaaacactgtacccaaatttagggnaagananagcggggaaaaaagccttgggcttccaaagncacaactgcttttttgcaaaactttggaaaa

SEQ ID NO: 527736 - DNA, 522 bp, Homo sapiens
gcacgagattcattcactccaagaaaagtaacagacaaggctataagaaggtcatagtgacctagtctgagaagtaaaagccaaggcccagaatgtggcaaggcaaaggttaaaaagaaaggaagagcaagtttttctctgcctagcaagctcacttcaaagacaattataagataatgctcttcgagaagtcgaaaccaaaggaataggctccagacatcccccgtctggagcaagggtgaaggaaaaaaaaaaaaggacaaatgtctgtctgtatttagccagttcttgttttttctttccacgcagctacaaggccaccagctatgcaaagccacaagttatgccaagtcatcagttatgctatagattatgtgacctgtcattatatgattaactgcctgttttgcttctgtaagcctgcttataaaaatcctgctcagtctttgttcaatgctcagctttttggatgtgaatccactgagctaatgcctaccttaaaataaacatcgtcctgttttt

SEQ ID NO: 527737 - DNA, 613 bp, Homo sapiens
gagtcctcatttctgtggaatctgaagaagcccatgcagattttaattcccagtctagattctggcttcatcgtctatgaagcactatgatgatcccgtggatagtatctagatcaccatggcgactggacagaagttgatgagagctgtcagagttgtcgaatctggtggaccagtgagtcctgaacattgcgatcagatattgcagtaccgattccaaaagaccatcaggttctaatcaaggtccatgcatgtggtgtcaaacccggtggagactatacattcgctctggtacgttatagtagaataaccactcttaccctatactcctggctcagatgtggctggggtgatagaagctgtcggcgataatgcatctgctttcaagtgcctgtgtgaaagctggagagagtgttctgcgttcatggtggcaacgtggaggacgtcggattatgcagcatgccaaattgctagagcttcatggcttcccacgattcttgggcactgctggtactgaggaaggacaacacgatagtttggcaaacctggagcccatgaacgtgttcaatcaccagagaagtgaatcacatcgataaccttacgaacgtatgtg

SEQ ID NO: 527738 - DNA, 816 bp, Homo sapiens
tttgcatccgaaaccggaaagaaatacagcggtgggaggcagggccaaaaaaaaaaaaaaaaaaaaaacaacaaaaacaaaaaaaggggggggcgccccccgcggggcttttttctattcttattttttacttcttatatatatatatagtttatgatagatcgatacctgagacaacacaccacctacctctatgtcacccggaacagaaacatcgacggcatagacctctaaaagactaaaagcacggacgcaactgaaggctaatacacaacacgatagtttcaagacacaaagcccagacaccatattactcaccgattccacaaccacacaaccacacaagcaaccacacattataaatgacacaacacgcccgcggcgtcactcccacacacaatcaaaacaacaccagagtacaagaccaagcgtagtgcaggccaggacaaaccacagatgaacaaccaccagaagaaaccacgcgacaaaacaaactccaagaacacgaagaacacaaacaacacaaaccaacaccacggcacggcacacacgcacagccgcgcaacacgcacagcaccacacacaaacaagcaaaagagagagacagaaggacactacctcaccaccaaccccgcaccaccacccacagcaagaaacgagccagcaggagcagagtgagaccaacccagacaacccacgtccgccccgaccgaccaagacagcccaccccacccacccccaccagggcggaagcaacacaccacacaccaccgcgccatgacaaccatcaacccgccccggccacacacgcaacac

SEQ ID NO: 527739 - DNA, 796 bp, Homo sapiens
ggtcccctcagagggttcctgctgctgacggtgccttggatcctccccctcccttctcgattctactgccctcagtgagcccggcgggtcgggactcccgtccgtgccggtgcgggcgctcggcttgtgtggtgtgggatggaccagggacggctctcctggggccctttctccttcctgttgctagtgctgctgctggtgacgcgcagcccggtccaatgcctgcctcctcaccgggcagtctctttcgttctactgcgcgtcttcagtctttgagcacaggtgcctctcttgcaggggccctggtggtgctccaagccccgggaccgcaatttctgccatcgcccaccgtggcggcagccgacgcacgcgcccgagaacacgctggcgtgccattctggcagcttagaatggagcaacaggcgtggtagttggacattgagtttacttcttgactgggattcctgtcgttaatgtcatcgttagtagacacagataagatagcgcacgacctgatgtggactgggagactcgtgtgatatgaccctgagccccggtggggacgctgagtccgtacggccagacctagtgtcacgagactgctgtttctttgaattcctctgactcgatccccctggaggtgaagcatgctgggtgcgagtggggctagtacataatcttcaccaggtgattcctcgtgagtggtacggatcgccgcgctagagctaaggcgtaggtgtcctgcctctatgtgggggctcgccttttggcccctagacccctagtggggttcccc

SEQ ID NO: 527740 - DNA, 323 bp, Homo sapiens
catggcttgatatagatgaagatgcagctgccatatttgatggaaaccacagtaatatgtgaagaacagttgttcatgtattctagaggaaaagaaaggaatatcattatatactgcttatggtatctgagcatgagatctttaggagaggacctgcatcacagctaaaatgatcaatggcattggagtcacagaattcgagctggaggcctaagctaagtggtggaacaatgatcatcaagccagccacccaacagcagagaactaataagggattctgtgctgcggagatcattacggaagcaacagtagcgaggtggcct

SEQ ID NO: 527741 - DNA, 657 bp, Homo sapiens
atcttcaaagattttaggagttgtatgccaggggaactgggtgatgagtgatagatggatggcaattacctcgtgcggtgaggggagaggggctgatggttaagctgattaccaaatgggccagagatttagagtcagatcatgcctatgtaatgtaagcctccataaaaacgacaaaaggtactaggggttggacgaagctggtccagataagcgcgaaatacaaggaggtctctcagtggcgtggtgcttctggaagaggaatggaaactcgcatgctcctttctcgcgcgataccgttgccacatagtgcatctcttcatctaggtagacatttgtaatatccataaggaagcacgtagaatgtgagcatggcgtatggtaggcgtgagtgccatgtaatactctagcacttgggaaaggcgtgagggaggcagattgcggtgagttcatgcgacgttccaatgatacatgccctggggccacaaacattggggtcgataaacccccaatcggtcagaacatacatggcaaaataaataaggggcggggccggcctctataaaaaagttagttccccttacgagagtggtaggcgctcaaacgttcgattatagcccgctggttaacccctatggagttatctttttgtcccaa

SEQ ID NO: 527742 - DNA, 456 bp, Homo sapiens
atgcctgttgtgactaccggttggggtcagatctggggtgaagaatgagtaagtttctgcatgcttcgtctctacctgagacacttctacaacaagccaagtataatctctccagtcctgcggatttacacctgacttgttcaggcccatgcgtagactcccgctgcaggcctctggcctgatggctcactgcatgcatcccctggcgtgcaagtacatatgtgctccgacaggctgcgatgtgctatcgtagtcccttgctactgctacctaggctcagggttcaaaactggccaggcgccgaaaaagcctgactgccttcttatcgtggaaaaacagcactgtcaccccggtgcctgttgatgcactgccaccccatttacctcttagctgagctagttccctcaatatacccaagagggcaatgccccctcgtcggtgccctcggcgggcgat

SEQ ID NO: 527743 - DNA, 904 bp, Homo sapiens
gtggcgggcgcccgctagtcccatttactcgggaggctgagacaggagacttgcttgaacccgggaggtggaggttgccctgagctgattatcatgctgttgcactccagcttgggcgacagagcgagactttgtctcaaaaaagcaagaaaagatattactacccatacatgatttcttgtgaatattctcgcttatattgtctctctagtaaccttatacctactacccgagacttttaggcaacctaacacactacacatgtattactaggtagcatatagtttaacaagcccacaataacaggtatatagtataaaaaaaaaacaaaaacacaacaaaaaacaacaaaacacacaaaaaaacacaaacgaacacaaaaaaaaaaaacaacacataaacaccacaacacaaagcaacaatacacgcaccaccaacaaaaaatatctactatactcatacagaaaaaacttaagccactataagaaactcctcaaaaacaaacaaatcagtatctacacaaacacacaaacatactacacaagaacacacggaggagcggggcgacgagaacggagcggaggggctcgcgagagcggacagggacgcgctggcagacccgacagacaggagcggatcggaaggaggtgcgggagcagaagcgcggggccgcggtaaagtggcggcggagccataacagaacaatatatacaactaactcatatacaaatacttctacttcacaaaacactacaaatcaacacctacactagacgcataactactctcaactacaataaacactaacaaatacacataatccaactaacaactacgactaattccaccactcacactaacggacaacgatgtggtcaacgagtaccgactgagccagacagac

SEQ ID NO: 527744 - DNA, 461 bp, Homo sapiens
tccattgtagtgcatcagtgattaccttccagtgccctgtagtactaggcccctctgaatttacccaaacctgcgctagagtccatgattgttaccatccagtagatcattcttgtcatagtgaggagaaatgtccccctatgcgctttcctaactactacacgtggtgcatggcgcgagcattagcagtaccactactggccgtcgaacacaaagaaaagaagtcataatatgaaaacgatacctgcacacgcatgttaatagcagcacaattcacaattgcaaaaatgtggaaccagacaaagtgcccatcagtccaaacaaagtggataaagaacttgtggtgtatctatacgtaccatgaaatactactcagccaggaacggaataatggcattcaacagcaccctggatggattcgcagaccaatcattctacataagtaactcaggaatggaaaa

SEQ ID NO: 527745 - DNA, 151 bp, Homo sapiens
ccgcccgcccgcccgcccgccaggggttgccctgcaggtgcttttgtcctcccgggccagcccccgcccgcccgggtcccaaaatgcactgttgaggagcatgcccccccccccccccccagtgggcagattaaagcaagtcagttcttca

SEQ ID NO: 527746 - DNA, 329 bp, Homo sapiens
gtggacacagcgtcgtgtcgacctggctatgccttgccctctgtttctctcatatacccttgtacgtcacttgcctgaggtctataggccctttaaggttgccagcccagagccagaagagattggtgtccctaaagttcagaaagccacctttgcctacagatggtgttcacagtgttggtgtggagtcacagcttgacttttggtaagagcagcaagtattctgactgtaaagagtttattgtaactaggcactggtggctcatgcctgtaatcccagcagttagaaaggctgatgtagagaaagatcgcatgagtccacattaatg

SEQ ID NO: 527747 - DNA, 393 bp, Homo sapiens
  misc_feature (49)..(49): n is a, c, g, or t
gctatgaggtacaaggctcatattgtgatgggtatatgaatggactgcnaaagaacgtgtaattgcaatggagtgcgaattatgatggaagaagaagagatgcctaagatgaagtcacaaagcagaaaagatcacttaattggaccaaatgataatgactttggaaaatatagttttttgtttaaagatttaaactaatatgctggctggtacgtatgatatttaatcagagcattgaccagaaaaattgaaagtgttctgaggcacatagcagaggagctgcagatatcctgcttgtattggcgtatatcgttcctcctgagcagaaacccacagtaggtaggaaaatgggctgtctcacaggcctggccacgctctcacggaaccactggc

SEQ ID NO: 527748 - DNA, 303 bp, Homo sapiens
tgacctagaggatcccatccagcactttggaggtgaggttgtggatacctgagataggagtcatgacagctgcaacatgcaaactcatctctactaaaaatataaacattagctgacgtggtgccacacctgtaatccggctacgctgaggctgaggcaggagaatcacttgaacctgggaggcagagattgcagtgagctgagatcgcgccatttgactccagcctgggcaacagagcgagactgttcaaaaaaaagggaatttatttttctaatccatcaataattaattacttttactta

SEQ ID NO: 527749 - DNA, 229 bp, Homo sapiens
gcttgaggtatattcattcaatgtctttggttcacatggatataaaacctagtaatattttcatatctcgaacctcaattgcaaatgctgcctctgaagaaggggacgaagttgattgggcatacaacaaagtatgtttaaaataggggatcttgggcatgtaacacggatcttcagtccacacgttgaagagggcgatagtcgttttcttgcaaatgacgttttttag

SEQ ID NO: 527750 - DNA, 177 bp, Homo sapiens
tagagttacccaaaagtgcactcttctactatctacctaggaacaggcgttttggcagggtgatgtcccagctttgcgcgcctgatgtctcggccttttcgtcgttcaaaatgcggatcagcaaaccggccttggcgtagttcacgtgttctgtagatatagaagagtgcacttttg

SEQ ID NO: 527751 - DNA, 438 bp, Homo sapiens
actccaacatccgataggctcaaggggagttctaggtacctgtcatctaggtagcacccatagacctcatttgactacagacctgtactagtgtacacagagaagagaactgctctcaagaattaggctttgaacctgtaacctacataggtagcacctgctaaaagttcctaggaatggggcagtgtcttcaaaggattactaggacctcggtattctcaccagcagggaatacctctatgtccacacagtccttcactgtgtcctctgtgtgttgttctttctcagtattgtgccagatttctcttttccccacattcgccacgattacatttttcacctccacttcactggctcttcctagggtcccatcccctgtcgacttgagggcatttaactcttcttttgtcatcatggtcgaaccgactggggatcctc

SEQ ID NO: 527752 - DNA, 178 bp, Homo sapiens
  misc_feature (107)..(107): n is a, c, g, or t
gaggatccaacaaccatagagcacataaaaaccgcccaacgatctaactaatatacaacggctaaccgggccattcaaaagctcgcccagattaaatgcctgccganagcaagtacatggggaggattactacttcctggttgccaaccacccttccggctgcccttgtgttgacttg

SEQ ID NO: 527753 - DNA, 649 bp, Homo sapiens
agcacttgtttaatcacatggtagtggactcaatccacgtaaatggaatcgataaccagctttagctatcccgatcacccaggacagagaacagctgatgttcccttaccactttgttgaccgcgctgggaaagcacgacgtgaacagtacactctcacggtgagccgggtaggttcgggcagctaggctgggcatgcattgtatcgaactaggcagatggctataacacgccttgtgacttgcttttgtcctacagagggagcagacgagtccgagttgagaactgagaacaaatgctggaaataacttactacttgaattccaaccgttgtgtaggaggcccacggtagagaaaagtccacgccacaggaagtgggcagaccctcggcacgccaaaagtcataacggtttggacaggaaagatcgcctaaaggggttattgcatacccagtgaaagcgccgcaggagacgcatgctaatgcgtactcttgtttaccgggcaccctgttggggcaagaccaccacaatgggtgaaacctttaactttgagcttttgaaccccggggggccaccaatatttttttttggggccaacaaacacgggagaagaggggacacaaaaagagggaacaataaccattggctcgg

SEQ ID NO: 527754 - DNA, 357 bp, Homo sapiens
  misc_feature (36)..(36): n is a, c, g, or t
  misc_feature (39)..(39): n is a, c, g, or t
  misc_feature (41)..(41): n is a, c, g, or t
cacaagtgtccagtgtttcgattccattggcttcanagnanagaaagcctagatggcctaaacagaaatgtgcgatatttgacccttgatatttttgctggcccccctaattatccattttctgatgaatattaacatggagggcattgcatgaggtctgccagaaagccctgcgtgtggatggtgacacaaaggatggctttatgctggtgactgggcacatcgcctctgggtaaatctcttctggttggcgactttagtaagcttcggctaaacccatccggcggaaaagaaaaacaataattttggtttttattttgaaaaaataaaagctctcttctaaagattcttcacccc

SEQ ID NO: 527755 - DNA, 136 bp, Homo sapiens
cccctgttattacaccgaggattgttaaccccgaagttattgagcgtagcctgggcacacagcaagaccccatctaagaaaaaaatgttttttaaatcagcttagcccaaagcggttgtgcactgggggctatacc

SEQ ID NO: 527756 - DNA, 600 bp, Homo sapiens
ctatattcatgctctattcttgtacttaatactagaataaattgtagccatggagtatattagtaagtattcagagacaagtatcagaataccagtaagccagatctctggaaagtagtagtccctttataggaacaagtggtccagtctagcctagcttccttaggcactggccaggtaggtttgccattgagagcaagtactgaatggaataccataccacttttacatcaaacaaaatagtggtgcctaattggaggcaaacgcaaataggtttaaggacagtgacaagccattcttatgattattgatgtaacaattcttagtgaaatatcagcatatgtaatcctcctcaaagtcatcatatttctctattggctcatctcttagtataattcacaatataagtcaaaaatttggtgattagtctaatagatcattttcactgtcatccacatttctcaatttttactctaaatcttttatgtcggcgccaactgtattgcggtaactgattttacagaggctgtatgtagtgaggtatgtatctgtcatcgatgtatctcccgttctcattccatatagctaacatatgaatgc

SEQ ID NO: 527757 - DNA, 860 bp, Homo sapiens
  misc_feature (196)..(196): n is a, c, g, or t
gcaacttcttgtaaacgggtccctcctattcattcctagaagaaggttcaaccctgttcctgccccccttccggcagtttttcgtgctccccggcgttccctcctgggtacttttcccccgcggtcacttaacacccacaaaagtcggtcccacccccgtgtggtccccgagggtccaccacgtgcgcggccactntgtgtcttagagacaagccaccccctgggtttttctgcacggcaattttcttcaccgcacatcctccgctcactctgctgtgctccccgcgatgaacctgtgaacatcgggagtgtgtcctctcccccccccgctctgttgccacacaagcgtctgtcccaccactaaaattgtattcgccccgcacatccttcacacctcccggatcaaggttgtttcatcatgaacccccacccgtcgtgaggaaatttctttattcaccctctccaccttcaactcctcccccacaacgaccctttggcgcgccaataatatcatcttgcttacaaccagttctacacataagacagccaatactcgggtccccccttttgtcccccaaaatatcaagcataatgtcggcgcccccgtatctaataataagaatactcacatgtgagcaacactggccacacctcgttatatctctgtttcttggccactctatgcgtaccctgtgccctgaacccttgtaaaagcctcccctcctcctaatgttctcttgaaaatatactacccccccctttctcccccctatcactaaagaacccaaacttcctcccattgctactggacagtagttctctcaacaaaaaaaaagcgggggtttttctcccacataaca

SEQ ID NO: 527758 - DNA, 914 bp, Homo sapiens
  misc_feature (3)..(3): n is a, c, g, or t
  misc_feature (6)..(6): n is a, c, g, or t
ctnccngccgtgtcgtggcggagcaggggggagtgtatgctttatctgtttcacggaggttgtatgccggtttttcctggttgcttcctaatacctgcgaacattccgacgggcacaatggtctcggcgttcaacttttcgcgttttaaccgggggccaccccccatgtggcgcacgacgttatgccggacattatcccttcctggttaagggacggccttgccctgctggccccccccccccttgctgtcggaacattacccgcgttaccaaatcctaatcggggacgggcacccacctttccctttaggggttagaaaaaaaagttcggggctttggcaccgacccacaacgggtttttttaaggggaaaccagaacccctggtccaggtccccgccccaaacaggggaaataagaaaggcgcgctcaaacaacaagacccaccagggctgaccgccgggcgccgcaacccccctgaaacagttgacaagcggggggagaaaaaaaaaaaagtggcaatcaactaccttcgtgaccaacacgccaaagcgaggagcctccaccacgatgcgcccccgctttaatacagttcacgagggactgcggtataacccccccgggtgcgaaaccctgtctatcgcacaaaatcatagcgagtaaacgcgcttcaggtggaaatttttcagacaccatttcgtcacaactttcgtcgaatagtcatccagatatggttcttcgtacccccggccacggacggtttcgggccgcacacagctaagacgggccttccattgcccatacaacaattggtagcacgctatggtacacccgcatgatttgttcgggcgcagcgctattcaaaaacgccaccgccccacaaaaaccaacgtgggtcttacaaccaacaaaacaa

SEQ ID NO: 527759 - DNA, 291 bp, Homo sapiens
ttaggatatatatagtacttgaccatacaaaggcattatgtgtcccctttattgtcaagttattaaccataggctatcatgcatgtatacgtatatatagagaccacggcatgcgtaaatgtacatgcacatttgccaagtctgaacaaaggatatatagaacttcgtctgatgtgcatcgcttagtatgagactatttctacctggatcaagcacgaatgatccaccaaaacgtatgcaccgcagctgtctttcgcatgcgcagcgatgttcacaatatggtgctctcag

SEQ ID NO: 527760 - DNA, 147 bp, Homo sapiens
  misc_feature (11)..(11): n is a, c, g, or t
  misc_feature (14)..(14): n is a, c, g, or t
  misc_feature (81)..(81): n is a, c, g, or t
  misc_feature (95)..(95): n is a, c, g, or t
tttgtgataantcnatggtcgcattccgatgcactcggctaggcatacgcgtttgtgtcgcaggtcgtacttcaggctagncgtcttgcttctcntcttctgcagttcgctttccgtagcttaatcgggctctttagttcgattagc

SEQ ID NO: 527761 - DNA, 818 bp, Homo sapiens
gtgtatgtatgtgcatgtatgtgttcaatctaatttaattcttttttttttttctagcctgtgtgaaagcaccttgggttccaccctccattctgagcactctttggaagggattagcactcccagactctggactcgggggctgggaaaagctctataggttggagatttactgtggttccaggagctgagagataggccagcctgagtcagggccggaagaatgtcttctatggtctgttggggggacaggcactctggcagtcatagtatctttcactctatcgctttcactgcacgggtctggttggcgaggttgtccccagcagcctccggcttggtggcccatcactcactccacatggtcctccctgtaatctggtcttctggtgccagccatccttgaagtgaccttccttttttggtcggtggtttggagacagagtctcactctgtggcctaggctgcagtgcagtggctaatctgtggtcatgaaaatctgcctccttgggttcaagcaattctcctggctcagctcccagagaaggtgggatttacggtgatcgcaccaagctggtaaatttgtgattctcagaagggagggttttggcatgtgtgacaggtggtcttcaaatcctgactcaagtggtctgcctgctgggtcccagtgtggatcacggggtggcccattcagcggatggctttaggtggttttacagggggctccctcgcgggccgcggacccaggcttgtctttgtttccaccacccgtgtttgcccacgcggtccttcaacttgcgcttttctctggttgcggc

SEQ ID NO: 527762 - DNA, 234 bp, Homo sapiens
ctatcactcgaccgttacgtggctgtgggttgacgtggcttattcttggactctagcacctgcctcggcctccaaaagtactgggattacaggcatgagccaccgcacccggccaacaaataattattgaatagctacttactgtatgctccaggcatgtgctagagtccaagaatacgccataatcaaccaggcaaggttcctgccttggatgtcacaatccggtcaagggga

SEQ ID NO: 527763 - DNA, 86 bp, Homo sapiens
tgagaaatcagacaggaacagaccttggtggagaaaacgttttttttctttctttctaaatggtataggagctttaggcatggctg

SEQ ID NO: 527764 - DNA, 315 bp, Homo sapiens
cccttagactcgaaatttcgctcctatcgtcccatccttgtagtaagaaagtactctttctaaggtttaataacaaattttactcttggcaattacaaggaaatcgactatattaaaatagctaacgagaggaaattactgaagctacaaagtcaaagtctcataatcaaagttatccttgacaactgacaggagttgttagatcttctattggtctttctgctaattcaaccctagtcttaaaacaaaaatagcctcctattgcctaatcccttgtacacacaaaaccactgcacttcggtatttctaatgtcg

SEQ ID NO: 527765 - DNA, 254 bp, Homo sapiens
gtagtaaacaaggagcacctgttgcccggcttcaataacaagaggtagcaaggatgtggaaaaattggaaccttcatacactcctgggggaatgcaaaatgatgcaggctctttgaaaaacagtctggcagttcctcaaaaggttaaacatagagttttcatgtgacccatttcctaagtctatccctaagataatgaaaacatacttctacacaaaaacttgcacatcaatgttcctagctgaatgatctcaa

SEQ ID NO: 527766 - DNA, 306 bp, Homo sapiens
aagagaatggtaccagaaattggtatttctagctagtactatttaacacaacttcacaatactaaaacaaatacaaataagaaagggttaggtagtggggcttcatttacttttttccttttcttttttttttttttttttaaaaagggaagccctgggttggatttcaaaggggtggggaaaggagggggggggaaaaacccccaaattacagggtaaattcatatgttaatttcacccaacgggtttatcttcccatttaccttttctcattaagcagggttgtacttctcaaacatttcttta

SEQ ID NO: 527767 - DNA, 284 bp, Homo sapiens
gggccatccggctttgggggtcaaggaggcctcggccctggactttgatgtgtccagcaaccccatttattggacagacatcagcctgaaggtagggtgggcccgaacatgcccacgtgcagcctatatgggaaaaccttccctctggacctgcctcaaaggtttcaaacattttttttaaagccctataatatttattgtaacccaattccagctaattaaatatgagcaagcctatttcaaaaaaaataggcgattataatgagcaaatccggtggacccca

SEQ ID NO: 527768 - DNA, 179 bp, Homo sapiens
atagaggatcccctgagtgcttgttgggagatgccagacgactccaaggcaggtcaactggcttatgtcagtgagtggaatgcttggccataagaatggagacaaacatgttaccaataatcttgtgcagcttgttatgcacagatgctaaaactatcttcatggtatggcctactacc

SEQ ID NO: 527769 - DNA, 193 bp, Homo sapiens
  misc_feature (19)..(19): n is a, c, g, or t
  misc_feature (31)..(31): n is a, c, g, or t
  misc_feature (83)..(83): n is a, c, g, or t
  misc_feature (152)..(152): n is a, c, g, or t
cgcaatcaacgacaatgcnatccgcgcacgntcacctccggaaatacatccaccggttcaaaggcacgatctcaaggaaaatnccatttacccaaaaagtcgcgtatggattggattggtgcttgcggcgcaagggtacggaaatgatcaancggcgattgtccctcgtgcagtgattcaaccgtgtgctgtg

SEQ ID NO: 527770 - DNA, 800 bp, Homo sapiens
  misc_feature (687)..(687): n is a, c, g, or t
  misc_feature (695)..(695): n is a, c, g, or t
  misc_feature (705)..(705): n is a, c, g, or t
  misc_feature (712)..(713): n is a, c, g, or t
  misc_feature (721)..(721): n is a, c, g, or t
  misc_feature (730)..(730): n is a, c, g, or t
  misc_feature (732)..(732): n is a, c, g, or t
gcccctaaccctgaggctgccgcgcggggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggaagcaacctgctgacagagaggatccacctccgaaacccctcggggcgttcttctgtgtggcccgcctgcaggcaagaaggggttaaaagtggaatgtatgtggtaatagaagttaaagttgcaactcaagaaggaaaagaaataacctgtcgaagttatctgatgacaaattacgaaagtgctcccccatccccacagtataaaaagattatttgcatgggtgcaaaagacaaatggtttgccgctggagtatcaagagaagttaaaagcaatagaaccaaatgactatacagggaaaggtctcagaagacacttgacgacatcatcaaaaaaggggggaaccacaaactctttagaacataacagaatatatctaagggtatctatgtgctaatataaaatattttaaacacttgagaacagggatctgggggatctcccacgtttggatccaatttcagcagtgctctgaaggagtatcttaacttggggattccntggttttnagatataaanaagaaanngggatggnagttagacnanttaaaagggggtatgagggctgaatattgtgtaaaatggatggtgagttacccctttgtgagcattga

SEQ ID NO: 527771 - DNA, 219 bp, Homo sapiens
gactgacaatactctgaggctctcaagatgccaggagaagctggagctggcagagaaaaggccaccgatgctgaagccgacgtagcttctctgaacagacggatccagctggttgaggaagaattggatcgtgcccagaagcctctggcaacagcttttcagagctggaggaagctaagaaggcagcagataaaattaaaaaggcattaaagtcattta

SEQ ID NO: 527772 - DNA, 441 bp, Homo sapiens
  misc_feature (1)..(1): n is a, c, g, or t
  misc_feature (73)..(73): n is a, c, g, or t
  misc_feature (108)..(111): n is a, c, g, or t
  misc_feature (116)..(116): n is a, c, g, or t
  misc_feature (160)..(160): n is a, c, g, or t
  misc_feature (226)..(226): n is a, c, g, or t
  misc_feature (235)..(236): n is a, c, g, or t
  misc_feature (239)..(240): n is a, c, g, or t
  misc_feature (249)..(249): n is a, c, g, or t
  misc_feature (317)..(317): n is a, c, g, or t
  misc_feature (346)..(346): n is a, c, g, or t
  misc_feature (348)..(348): n is a, c, g, or t
  misc_feature (352)..(353): n is a, c, g, or t
  misc_feature (358)..(359): n is a, c, g, or t
  misc_feature (361)..(364): n is a, c, g, or t
  misc_feature (381)..(381): n is a, c, g, or t
  misc_feature (440)..(440): n is a, c, g, or t
ntgaaattccatcatcgcccagcgcccaccacgcttctgtttccctgcagtcagatccaggtctcccggccanggcttttgggtgcagcttcctctcaccagctccannnnggggnactgtctgtccctccagcaaagccacctccactgggtgtctgtnctcgttttctctctccagcccaaagagccctctgggcagcgcacagcacccaactgcagacacggnggcctgggnnggnntcctctgtnaggaggctgccacctgtttgccagggggaagcgggcagcgctgcagtgcaggcacggatgggtcaggnctgctgcccagagcttctgcgtgggagcncngggnnctgcnngnnnnactcactaaaatccggnccgtctgtactgccccagcccagcttttgtgccctctgcaccagcgggtccagacagana

SEQ ID NO: 527773 - DNA, 950 bp, Homo sapiens
  misc_feature (277)..(277): n is a, c, g, or t
  misc_feature (283)..(283): n is a, c, g, or t
  misc_feature (309)..(309): n is a, c, g, or t
  misc_feature (378)..(378): n is a, c, g, or t
  misc_feature (382)..(382): n is a, c, g, or t
  misc_feature (391)..(391): n is a, c, g, or t
  misc_feature (837)..(837): n is a, c, g, or t
  misc_feature (845)..(845): n is a, c, g, or t
  misc_feature (855)..(855): n is a, c, g, or t
  misc_feature (862)..(863): n is a, c, g, or t
  misc_feature (871)..(871): n is a, c, g, or t
  misc_feature (880)..(880): n is a, c, g, or t
  misc_feature (882)..(882): n is a, c, g, or t
gcccctaaccctgaggctgccgcgcggggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcctacggaagcaacctgctgacagagaggatccacctccgaaacccctcggggcgttcttctgtgtggcccgcctgcaaggatttaagcttgattntggcanttccccaagggcaaaacaagtcaaantgtggcatggagggatagccaccatttttcagagtcctggcgatgaagtgtggggagtagtatggaaantgancaaaagcantttaaattctctggatgaggcaagaaggggttaaaagtggaatgtatgtggtaatagaagttaaagttgcaactcaagaaggaaaagaaataacctgtcgaagttatctgatgacaaattacgaaagtgctcccccatccccacagtataaaaagattatttgcatgggtgcaaaagacaaatggtttgccgctggagtatcaagagaagttaaaagcaatagaaccaaatgactatacagggaaaggtctcagaagacacttgacgacatcatcaaaaaaggggggaaccacaaactctttagaacataacagaatatatctaagggtatctatgtgctaatataaaatattttaaacacttgagaacagggatctgggggatctcccacgtttggatccaatttcagcagtgctctgaaggagtatcttaacttggggattccntggttttnagatataaanaagaaanngggatggnagttagacnanttaaaagggggtatgagggctgaatattgtgtaaaatggatggtgagttacccctttgtgagcattga

SEQ ID NO: 527774 - DNA, 282 bp, Homo sapiens
tcgttctgtgaaagaaaatccagcagagttgttgcctccgttgtagttggtgggccccgtagcattggatgcctttgccaaatggttcagtgtggacacagcaaaggcaaacagactctgccactcgattcgcagaatgttctgtagaaatccggatgtgcatgtgcagaattcccttttgcaggtataaaatagtaataaaaatagtcctgcctgaggttgcagtgagccgagcttgcactactgcactccagcctgggtgacagagtaagactccatgtc

SEQ ID NO: 527775 - DNA, 138 bp, Homo sapiens
ctacaggatcccgcgtcagtacggaatgaagggagctagtgtttaggtagcactcaccattatgctcaatgctggtgatccttattgtatggccctccaaagggaactcgtcttcagacctttgctcttttgatggtg

SEQ ID NO: 527776 - DNA, 420 bp, Homo sapiens
ggggttacatcactggttctcatgatctgcctgcctcagcctcaagtgctgggattacaggcgtgagccactgcgcccagcctattagttcattttcatactgttgataaagatacccaagactggataatttataaagaaaaagaagtttaatggactcacagttcctggtggctggggaggcctcataatcatggcagaatgcaaaaggcacatcttacatggcggcaggcaagagagaatgagaaccaagtgaaagtggaaaccccttataaaaccatcagatctcatgagacttattcactaccatgagaacagtatgagggcaactgcccccatgattcaattatctcccaccagttccctcctacaacacgtgggaatgatgggagctacaattcaagatgagatttgggtggg

SEQ ID NO: 527777 - DNA, 1001 bp, Homo sapiens
ggcgcgcgggttagaacgcgccagaggtcggggcgcgcagacccgtaccgacccgaccccaggtagtgagggcagctgattccgacgtgtgtgagggagcggcagtggtcggcgggcaggagggggctggcgtgcggtgggggtcgggggcggggtatgcgcttccgccggcacccgtctagcgcccgttggctggtacaacagcgagaggttgtgggaaggccgcgaataaagccggatactggcagcccgacctgtgtactacctccgggcttcacattctcgtaacgagcgcagcaggatgctgtactggtcaacgggagcgtggcaatctgggaacttttggcgccggcgtcggtatgttgaggcatgaagcatacacgcaggccaccgcgtatgtcagtgagcagtgcatcatgacacattgtagacacgctcgaacacgtagcagatgtactccatgactgcctgacgactctctactcaactgtgtgaacaccgtgcggcgaaccgtgatgcacgatctggagtggggctgccgctcataattcattccaactaccatgcaatctggaatccctggagagatggcacgcagtctgcgagagcttgggactccagagaactccttcactgtgtcgtgcgctcgcatgatgtatgaggctcccgtccgtggtcactggaacccgctgttagtactggacccgtggtatcccatggtgcagctgcgatactgcggtccccgatgctccctgcatgtgtaccccggggatgccgggagggaatctccagaccagaggggctctactcactgaggggaaggaagcagcgtagctggtaaatcattcacccgtgtactgggaatctaccggtccatcttggactggctacgtcatcgaatttacacagaaaactatgggaccactccctgtgtcatggaggacgcatggtatgatggaaacacaagatggcccaagatgagggaatccggaaaaggaagc

SEQ ID NO: 527778 - DNA, 146 bp, Homo sapiens
ttgacagtcggattgggggtgaactcggtcagaggtaagaactcggtcagaggtgagaactcggtcagaggtgggaactcggtcagaggtgagaactcggtcagaggtgggaactcggtcagagtgtgagaactcggtcagaggtg

SEQ ID NO: 527779 - DNA, 222 bp, Homo sapiens
tccggaaatagcgacgcagctatcctcaggagctagacagataaccaatccctcttccatatgactaattttaaaaggagaaccatcaggtaatccttcatcttcttttctctggggttaatattactagtcccttcaatcattcctctttagtaagtatataattccggtatctggttttcacatttggatggttctccttctggagattatcccaatggc

SEQ ID NO: 527780 - DNA, 218 bp, Homo sapiens
ctgcggttgagtctagaggatccgcgtgcggtgcttacagaaattaaaatgacaaaaaaaaggaaggaagggagaaagggaagcagcttcactgctcaggggagctggcccaagcctcatgttaaaatgagtgatgtgtctgcaaggaccccacgcatcatgtgtgctgcacccgcagtgcagagcagcacctgatatccgtctgcaaggaacccacg

SEQ ID NO: 527781 - DNA, 527 bp, Homo sapiens
  misc_feature (22)..(22): n is a, c, g, or t
  misc_feature (338)..(338): n is a, c, g, or t
  misc_feature (419)..(419): n is a, c, g, or t
  misc_feature (423)..(423): n is a, c, g, or t
  misc_feature (442)..(443): n is a, c, g, or t
tctttacataaaaatataaaanttagctactcaggaggctgagacatgagaatcgcttgaacccaggaggtggagtttgcagtgtgatgagatcatgccacgtgcactccagcctgggcgacagagcaagactctgtctcaaaaaaaaggaagaatgagaaagcaccttatgtcatgacatgacacaaacgttcaacatataaagtggccgggcacagtggctcacaccgtgtaatcccagcaacgtagggagactgaggtgggaggatcacttgaggccagaagttggagatcagcctgaacaacacagcaagaccccatctctaaaaaagtaaatnaataagtttgaggctgcagtgagctatgattgtaccacttcactctcagcctgggtgacaaagcagaatcccatctctaanaatnaaaatagaaaataaaaatnnatagtccagagaacagaatatgcatacacacagagatacagataaaccaaatatgggtaaaatgtcagcaattgaatgaatcct

SEQ ID NO: 527782 - DNA, 188 bp, Homo sapiens
catatccggcctcaaccatggatggagagaagctaaagtctcccaacagaggtgctggcttttataccaaaggcaaagaaatgggagaaccgaaatggctggagaagggcagtgagggaggcgagtgttaccctttgagattaccggttccaggatccagtctggcttgagacccaagggtgttaacg

SEQ ID NO: 527783 - DNA, 256 bp, Homo sapiens
cccgatagcccgacagtggtgggctcccgtaccccgtgcatcctgtgtgaggagctcttcaagctgctgaatggagggcatcgctatgattcaagcccgctcaactgcacacacgatctgtacatgatcatgcgggagtgctggcatgccgcgccctcccagaggcccatccttcaagcagctggtggaggacctggaccgtgtccttaccgtgacgtccaccgacgagtacctggacctgtcgggctagtcgggg

SEQ ID NO: 527784 - DNA, 501 bp, Homo sapiens
gcccccctgtggatagctcaataagatagtggtcatataatgctacgcgtcccagtcagcatatttattccagctaaaatcaatttgctctatttagttgtggttgtgtttacaggcatctcgatggtccccatttatctgcccgttgatacagcactttttaaaggtcgtgacttggagagtccttgcgcccgtcttatcagagaagatataatggatctgcccgagctgttcattgagtgtggtggttctagcttttgcgggtgtgtccttctcagcatagtacatttgcaggtcccagttgatgaagtgactctgtccaagacgaatcacttccacgctaggaagacagaagattattttccgtagagagctcggatacgagtggcaagtagtagagattttattctcattgtacagacgagagcaagctgcttatttactgctatggtctgaatgttagaatccccctccaaattcatatgttgaaacccaatcccc

SEQ ID NO: 527785 - DNA, 92 bp, Homo sapiens
  misc_feature (63)..(63): n is a, c, g, or t
ggcgcacagcggacaaggctgcagagaaccatggttgttgtgccactgcactttagccttggngagagagcgagcctctgtctgagaaagat

SEQ ID NO: 527786 - DNA, 542 bp, Homo sapiens
tgtacccacgtttgtgtggaggactggggaatacagaaatgagtgagcaactagagaggtttaactaaaacaatcagctgagggtcaaggggaagttgcctccccaccatcacagaaggcaatgcccagtgtaggagtctggcaggccagctgactgctactaagagctagagtctgctacttagagtaatgattaaagacagaaccacccaagttcagacagaaatgacagtggaaaaatttcaagctggctgcagtcagagtagacctcaagaacccagtaaaaatctctactagactttgtattctgcagaaccctccctccttgaaccacaaattgcttctattcaacaaggcgaaaaaaacaaaggaacattttccttaaccccccttaaaaaaaaggggggggggtttctcgcgggttctcttttcgggaaacccttcaactctaaaaaaaaattaaaaaaaccccccaaagggccctttccccccctggaaaaaaattcgaagaacaccctgaagacccccacaacacagggaga

SEQ ID NO: 527787 - DNA, 602 bp, Homo sapiens
ccaggctgagatggaggtaatagcttatgtcatgctctagcattcaaccccattacatagggtgagtcacagtgcagcggtggcgcaaggtgagagctgacatgagtgagacggtgacgacccctgtgctgccgcagagctacagctctctccctagcacagaaaccaaatgggggcccactgaaatctcaacctcaaacacctgctggctcaaccacgtggccagcgccaggggttgcctcactcacgccaggggtcgcctcactctcaccaggggccagattcccggtttcaacacaatgacacttgcatccaaagtcccaagaaaggaagcgccaagctgattagagatttctgtttccctagtgaggagaacacggtttgaggaagtgcactggagagaggacacgtgtcagggacctgataggcccctagagcaacagaatctatctgaaacgcaatcagccgcagaacccacgtagctgcagcaatgggaatatgagactcatggatctcaaggtaaaaaaggacatggtgataaaacagaagaggccaaattcgctccacaaatgaaaagcctaacccctaactgatgagacggc

SEQ ID NO: 527788 - DNA, 159 bp, Homo sapiens
gtacgaatatcgctgccataagcatctctgtctctgtctgtaatctgttcttcagttgtctatcctgtttggctctctctttctccaatcgatgcatctcccattgttctgccacatactccatgaatatctggacattgactataagtgcctctgctt

SEQ ID NO: 527789 - DNA, 1411 bp, Homo sapiens
  misc_feature (421)..(421): n is a, c, g, or t
  misc_feature (643)..(643): n is a, c, g, or t
gtgtcgcgtgtgggatatcttgcgggactacggtgacagatcacttccgatcgttcgggcctgtgtgtcggtgcacactagctgggcttcgcatcgccgagacccctatgacgacactggctagctcattcttcgcatcgtgcctagcgggcatgctcggcgctactctccgcagtggttggtctacctagcagggtatcctgcgtcggtgcacctgtgcctacgtgctgacgttgcactcgagcgtaaccagcagcgcagtacaacacatcgatctggggctgtcacgctcgtcccgaacggctgcaacataccaagtgcactacatgactgcacgcgctctcggtgcaacatatgcatgtgatgctatttcacattctaggtgcaatcctatcagaagcacatgggccatgtggcacanacgtatgtgtgactccgaatggtgcatgctgttatatgatgacgttcggtggcatgtgtctgacatgtagtatgatgtagacgcaagagggacagccaggtggtaccccagtctaggggtgatgacaaggtaccacacagggctcgtggtagcgtgtatgctagagcagtgctggtccgagccaagggaacacttcgtgcgtgcgattgtgggaagagcgangcatatcgtttggggacacgcttgtcggttgttacacaagctagtgtgctccctagtgccagcccgagggccccatgcgtgcaagggaagctttgacacccagcatagcactcacttgtggcaataacagcctcgtccgagacgttgtgtccctccaaccggtctcagccgaccagaccatcaaaccgtgtatgctcgtacgagtgtcgttcgcttcccctgtcggcttgcatgagaacaagtttcgacttggtcttacacgtggacggaagtgtttctggcgattgttcccgggttttccttggggggcccccggaaggaacttccccacagtttggttcggtaggccctgtccacataaggcccctgtcccttaaaaaggtgttttggagtctgcctggaccgttctaggccctgccagtaatccttcccgcggggcaccagcggggattattcgttcctggggccctgggatgtttgttcccggaagagggggggggctcttttggcccacgcttgtttgcgccaggggagcccgaaaacggttcggaattctgggaggaacgtggaccaacggggtggcccaggggaatattccctgggcatacaggagatcccgggtcacccagcaggaggttgggtgtccgacatcagacattacgcgctcagggagaactctgggcgaaaaacgttccagagagtcacgtgctccagtgggcgctctcgaacacttgcttttccacaaagcggtacacgtgatctatcgtg

SEQ ID NO: 527790 - DNA, 762 bp, Homo sapiens
  misc_feature (187)..(187): n is a, c, g, or t
tcttacaactagtcatagatgaaggcactcacagtagatggtgatatggtgacattagtggctgaaattctaaataactagaaactgtttagtaggcaaccctgtgaggcgagtaaaattgctcctcaagactctgtagtgaggttcttatggggttaaatttgactgtggggcaccctgtattaanttgtacttagtcgtgcatgctataacctaaggaaaataagccagcaacatctggggtgtgcttaaagagaccagacatcagcagtttgaatgctacttgctgatcctgagagggccatgaaagtctaaacactgacgattacatcctgggcgcgttgcagttcatcctgggcacaggctcttgctgcctcatgaagagtgtgtccaatgactgctgtcccattagttcaagtgttcccccgagttaagcccacaggccagtgccaggtcttgcagttgttcaccctcactaaggtctaggcgccccctcattgtgactcgcttcctgatgagtacgagtctcgaaaattttcttcttccgacttattttgaactaaataagacgtggctataaatccggagcaatagttgaattttccacgattgcccagctacggagatttgcgatcctattaccaggttcatacgaaatcccaggtcatgtcgataccaacggagttttccagaacgtttgtgccagctcccctcattttagcctcaacccgccgaaaaggtaaaacccttgtattgacccgg

SEQ ID NO: 527791 - DNA, 337 bp, Homo sapiens
  misc_feature (33)..(34): n is a, c, g, or t
gcagcgtgtttcagaggtttgaattagagaaanntttgcaggacagaataccctctgcgattctggtattgtgctctgagaaggtgcccatgtcaccgaccacactggaggccaatgtatatactgggggaaggttccatggtagctaagtgtggacaagctaatcactgaagttctttgttgcagagttgagggtctcaatagagttggatgaaagactgtgctgccttgaagctctgagagatgccatgccaattcaaggcagggtctttattgctgaaactcttgcgtaacgacatctttattgattgcgtatttcaggatgaatttcaactat

SEQ ID NO: 527792 - DNA, 366 bp, Homo sapiens
gcgcgaggctatgtgctttcaatgacaatttgactgatggctatcgtgacattacttgctatcttgagtcctcctgacatgttccatcctccattttgaatttctccaaagagttttgtgactttggtcttgttttcttggagacggagtctggctctgtcacccaggctggagtagagtggcacgatctcggctcaatgcaacctctggctcctggattcaagcgattctcctgcctcagcttcccaagcggccgggaccacaggcgtgtgccaccacgcccagccaatttttgtattttttagtatggaaagggtttcactgtatgttggccaagctggtcttgaacttctgacctcagatgat

SEQ ID NO: 527793 - DNA, 149 bp, Homo sapiens
tgccccggtgatgccaatgggcatttgcaaaaggagcccccaatgccccccacctgaggccccggtcacacagttttttggcttttcctccccggtgccccccccgaccctaccttgaaggcccccccaaataaaggcgctgcccctca

SEQ ID NO: 527794 - DNA, 288 bp, Homo sapiens
  misc_feature (117)..(117): n is a, c, g, or t
ggaacccccccaaaatttggggggcccccggcccccccttgcccaaaggggggggccccatttttggttggggggatatttttttttcaccccccccccgggggggcgggtttaatnaaaataacccccgggggtttttccccccccccgggggggggtttccctgggcccccaggggggggggggggggggggggttcccttcccctttttttttggggggcccccccccccccctttgtttttttttttgggcccccccccccaaaaaaaaattttggggccccca

SEQ ID NO: 527795 - DNA, 652 bp, Homo sapiens
  misc_feature (10)..(10): n is a, c, g, or t
aacggggggnccgtgcaatcctgcttaagagacccgcagtggggcgcctcgtccgaagccaggcgcgtccgccatagtgcctggcttggaggtgtcgccgcgctcggtgagagcccccgagcggagggggccaaacaaagggggggagaagccctagccgctgccagcagcttgcgggcgtgtctcgcggttcgggctcaaggcgacggaaacgaaaggcgagcgaagcgcggagatccggcgagaagaagcgtcagggagcctcggcggtgtcccggggtccgcgaagccaaccggcgcggctgggcccggggtggtgaggaagtgctccgaggcctcgccgaggcctagcgccggctttgtgtccgaggcggcggcggctgcggggggaggcggagccgggggcggctgcgggaaggctctcctccgcgacgcgcgttttcggcctagccgtggggccgctcgtggcctccggggaacaagcgccccgggggtctgtgtgcggtgggggcctggcctgggctggggaagctgacgccggtcgtcggaagccaggaggaggcgtgagggcgttcgtggactccgggcctaggcctctcccctcaacttctccggggctgggtcacccaatccaaggaagagaaccgcggag

SEQ ID NO: 527796 - DNA, 466 bp, Homo sapiens
  misc_feature (6)..(6): n is a, c, g, or t
  misc_feature (15)..(15): n is a, c, g, or t
  misc_feature (47)..(47): n is a, c, g, or t
  misc_feature (83)..(83): n is a, c, g, or t
tttggngtacccctncaccccactttccctatccatgtccgtatctngcatagcccatggtatagttatgcaaactgaaaaancattggaatattattaaccaataatctttcttagaagttgcactgtgtttacttgttatgtcttcttagcgttctccaaactgtgaccatttctcagtcttgtcttttatgactgacacttttacagagaacagataagttattttactgaattaccctcagtttagtgttgtcatgattagattgagggtatgcattattatgatgaataccacagacatgataggcttttctgagtgcattgtatcagtggctacgttgtgttggtatgtctcactcctggtaatgttaaccttgattacttggttaaggtaaaatctgacataattcatgactgagctccaatttttcccattgtaataaataaatattgggatgagata

SEQ ID NO: 527797 - DNA, 889 bp, Homo sapiens
agcggaggagagcatgccacgctgcgcccgctccgggacgcgccgccgacttactggtcctgcgagaaatccatcttcggcaaccacaattcgtgccagcggaatctggtgcagacgctctacgtataactacgagtggtttgagtcctctctattcctgaatgtgggatactatcgggaagacgctgacaaaagcatggtcatgatagcaccgtggaccctattacttcgtgaaccgaattctacctctgcatgaagttcataacacctgaattcatcagctacctttataaagaagcaggttcttgcttgtagcactaacgagtacaagtacactattattttgatctgaagtgatcaagtactgtagtcttgcgccgtgcctaacccaatagttgcgtgaacattcacactgtttagtccgacctggcagtaagattggacccacattatttgaaagggaaaactttgggacctttccacggggtcaattccgatctccaagttaaccttggccagaaagaacaaattccacttggccaccccttgtagacttacggctcaggcacaggttctgaagttctcggccactgggccacatttcaattccccgtctaagacaacttattggggagtatacccttaacacgaaacaccggtaatttggagtcacggaaaacttactttcattattggggctcccttattccgagagacgcacgcagctggaggaaaagggcccgcagtttggcacaccacgtctctcgaacatttacagccctctcacccgggacgtatggggcccatttaagaaacgcaaggcgggttccaacgaaaccgaaactccgtagcctaacgtgacgtgctccctaatttttttttcccaaat

SEQ ID NO: 527798 - DNA, 113 bp, Homo sapiens
  misc_feature (112)..(112): n is a, c, g, or t
tctctcccctccttcctgttcctcttatataccagtttctccccattctttttttttttcttactccaaaataaatcaaggctgcaatgcagttggtgttgtccggtttttna

SEQ ID NO: 527799 - DNA, 105 bp, Homo sapiens
cggacctatggcagagagccattgtcaacagcagagatgctagttgaaactaatcccaacttagccaaattattcagtcctttcaggctagctgaataatctcaa

SEQ ID NO: 527800 - DNA, 183 bp, Homo sapiens
ctggtgaatgatgaagtaattcaaaatacagtctcatcccttaggaaggcagtttaccattcaaaagaagagttatttgtaatgtcactatattgacaagagcagaaggctatagtgtatcaaaacaaaacaaaaaaaaaaggccaggaccaaaacacggaagccaaaaggtatcctccgggt

SEQ ID NO: 527801 - DNA, 342 bp, Homo sapiens
cgcaaaccggatttcactggattaggcaggcgcaacggcttgtcagtaggacgatttggtggtaggatgcagatccagagcctcaagtctagcgatgagattccactggacattgccataccttacgggtttactttccatctccttgtataccaatgtcatgttacctatcttggctccagactatgtttgtctatcccattccaaccacagagaattggacacacaatgcctacatgtgttcgggagttgtagtccaaattttctctaactgttaagtgtctgacattccgtttaccaatttcctacatactctcttctggactgtcacggtggcccagc

SEQ ID NO: 527802 - DNA, 246 bp, Homo sapiens
tgattaaggatcccatccccggttctgggtacaagtgattctcctgcctcagcctcgcaagtagctgggatcacaagtgtgtgccaccatgccgggctaatttctgtgtttttagtagagactctttcaccacgttggccaggctggtctcaaactcctgacctcaagtgatccatctgcctcggcctcccacgatgctgggattacaggcgtgagccaggcgcctggccttcccctttgctttta

SEQ ID NO: 527803 - DNA, 100 bp, Homo sapiens
cctttaaagaatccccttttccccggcagaactatttcgccagagccctagatgggtaccgaacttttattgctgattggtgatactaatccattcaccc

SEQ ID NO: 527804 - DNA, 113 bp, Homo sapiens
tttctagcctgccagtgtggtcagcccttgcgacagagcgagagtttatctcaaaaaaaattaaagaaaaaaaaatagccaggcatgatggtatatgcacctgtggtcccagc

SEQ ID NO: 527805 - DNA, 1110 bp, Homo sapiens
agcggggctcggcgggcgctgtgagggagtcgggccacgaatgtggtcgtgtgtataccttcccgcgcggacgccggtgctggcaagcggcaatgggcgggcctctgttgcctatgaaaggtgagagattaacgtgctggaatccggcagtgtgccacattgtgctctgggtgcgtcgaacagatgagaacgtgtggcatctgcaggtatggccatataacggatgctgccctgactgctaggtgaccggctgacgactgcaccagctcgggtgtgcgggccgatgtgctcccacacatgacgtatgcacaccattgcacttgtcgattccgtcaaacgttggttagttacgacaacaagcagggttgcatgacagtcacgtagctccgcgatgttggtccggcacggaaatgtgagacgtctcaaggcatggtcgagggggccacgaccctagggcttctcagactcgcgcagaggcgtcagtccgtgaagcagcgtcctgtacctctagtagctaggctggcccgataggactttgctttggagtggactaagtcgccaccactgaaggctggcaaactaaaggatgtgaatataccaatacggcgctgggcagtccttgctggttgttgcttcggtggcgcaatccaccatcaattgttttgacgaggctttttatacgttcccaaaactatatcgtggaaatatggctttctaggtgtgagacatcgtaccctttcgaccaactcgattaagtatccatggctctcagacacacgaacaaagtttctgtaccgcaaagtgtgcccgtgtgttgtcacggagacacatctagaggggcgcggcttgtaggttgcctgtttcgagcgggtgtggcgggggtcctcgcctgggtttaccccagcgctttatctgggctacccccgcgtctccacagggagaggcggcgagtttggcgaatcttctgtgagcgccttgtcagcggccctacacgttcggcgcgggtggcctaaggggccatggttggcggcccttgtgtgtggtttgggaacaacgtcgtcgcgtgtgtacttcgcgcgggatccagacgtgtgtttcgactcgcgcatt

SEQ ID NO: 527806 - DNA, 370 bp, Homo sapiens
gtatgtttttgctatttgtatacttcatgctctgtcaattttgaatgtgtggcacctttttcaacttatgtcatagctcacaaaagtatcattgtctaaataaaaactgtcttccctgtactataagttttcactgatatgtagaacaaaaagttgttgagtacttttaccttatatactgtatatgtgtcaaggactgatttatattttctccacaggtagtttgtccaattgtaaaacaaaatatatctaaagcactcaacatgacagtaattgctcttctatattgtgttgcatgataatatagcatgataatatatgacatccagtagaatcatttaataaagaattttggtcaataaaaaaaaaa

SEQ ID NO: 527807 - DNA, 887 bp, Homo sapiens
caagttgttgcttaatttattgtttcttaactaactaatccagataacaagtagtggggcttcagggtgacctggtcccaaagtttctgaagggcagttccgtggcagccccaggctctgctgtgggaatggggccgctgcctgcctctttctcatctattccactggggtgtgtctgcctgggcccagtctctgcatggagaggcctcgggctgggacagtctcgcagtcgtcgaccctcggtgcccttcgcttgccaggcccatgtctatgtcgtgtgtctgaattgtggagtcgtgcagccatggttattgtggcgatacctgctggaacctgcagaccaataagtcaatatgggactaatactcgttcgagtcggagaagacctttgctggtgacatcaggccatgtcccagtggttgggcggccatttactgtcacaaagttaaaaggcgggatccatttgattgaggaaggtccaaacattgcattgaaaagaaaagcttgattgatagtgttggttccccgcctgaaaaggccttgtattatacagaaatggtttgcatggaaaccacatcttcctcaccttagtggagagcacgtaacggttacacatgaatgtactgttagagcacaatgggtgaatagaatgctttgtgcccagaaaatgggtgcttcaagatctcagctgggataccaacgaaagtgggaactacacgaccattttaacataatgcgtcggggaacagtattccgtagcaagattgttccctccacttacttggttgttgacaactacttaggcagtgataaaagggaaattaggcaccatcgaggcctccaaggcaatcttgactccttaattttacgccgctgctgcgcggaaa

SEQ ID NO: 527808 - DNA, 318 bp, Homo sapiens
gaagggttcgcatcccattccagacttatcccagccttggtctgattgtagcaatgagccaaaaacaaccatatccaagagcggagggtgggggaagataaaggaagaatggatctcaggcagagatgactgcttcggagcagagaccctgggaaaccaaggggagcgtcacagctgggcatcaaccaagcccaggacagactgcggaagaccacagtggggctgtgctgaccaactggtgggggatgggagcactgcagcaatgaactaggacagtcccacaggtaccttcagatcatctatactctccataacagt

SEQ ID NO: 527809 - DNA, 216 bp, Homo sapiens
ataccacctttcttaatcaggctgctttgtaccgcctcagtggagactggaatccttacacacattgatcctaactctgctagtctagcaggttttgacagcccatatacatggattatgtacatttggatttctgccagcgtgtgtacagcaggtttgcagatattgatgtgcaaggttcaaggcagttaggttcgttttgcaaaccagtatatc

SEQ ID NO: 527810 - DNA, 427 bp, Homo sapiens
  misc_feature (5)..(5): n is a, c, g, or t
  misc_feature (30)..(30): n is a, c, g, or t
  misc_feature (120)..(120): n is a, c, g, or t
cttgnactcttggactcaagcaatccttcnacctcagcctcccaaagtgccatcattaccagatggattacctggcccttggggaaatgtttagtgaaaaatttagggaaaggattatanagtaattaaggttttgtcagggttgggcacaaggtgtcacgccaaaatcccagcactttgggaggccgaggtgggaagatcacttgaggccaggagttcgagacgagcctgggcaacatagtgagacctcatttctacaaaaaataaaacagccagggttgtggcacatgcccgtagtcccagctactcatggggctgaggtgggagaattgcttgagcccgggaggtcaaggctgcagtgagccatgatcacaccactgaaacccagatcctgggtgacagagtgagatcctgtctcgaaaaaaaa

SEQ ID NO: 527811 - DNA, 332 bp, Homo sapiens
atacactaggctaggtagcgaggcgggtgttgctcatatcatcccagtgggcataccttcttcaaggacgagaccaccgccctgtggatcgtgttcaacgtggtctcggacaccttcttcctcgtggaccctggtgtgaacttccgcacctgcattaatgaatcggcagcgagcgcagatgaaggaggacgcaggaaagaacggcgacgagatctagcagatcacacagagcaagaagggcgcgaggcaagaagcagatgatgagtcagcatgacgctcacgtgagcacagcgcagcgtaaaagcctttatacaacacacaacaagaccacc

SEQ ID NO: 527812 - DNA, 386 bp, Homo sapiens
caacagcttttacagagtacatcaactcagagtcaacaaaatgttctgagtgggcacagtcagcaaacattttacccagtcagacacagagcactcttacagcccccctgtataacactatggtgatttttcagcctgcagccggaagcatggtccagattccatttagtatgccccaaaacagcccccagagtgctgcagtaactccattccctcaggacaggcagataaggtagttgtcatatttcctttgttatttttaaaattgtaaaccgattgattagaaaccaataatttgattttttaatcaaattttttaatgtgattttaatgagatgccccctccagccaatgtttttaaatttgaaataaaaaccctgaatgta

SEQ ID NO: 527813 - DNA, 984 bp, Homo sapiens
  misc_feature (771)..(771): n is a, c, g, or t
  misc_feature (899)..(899): n is a, c, g, or t
gagtgaaccgggaggtactaccaggtcgccgtcgttgctccgttcgctctgagagagcatggtcctgagaggcgtctccgtgcggtgttgaagctgcggaccccggcctgcacgtcttcgcacgtggtctcgtcgggtggcgcagagcggagaatggcggggagaacacagagccaaagtgtaaagtcctcgcgtccggagtttgaattggcaaggacccggttggtggtggagaagcagttgacccacagatgaagatccctcataagggacacctttctgcacctagtgccaggagagatcattgcctcgtattcctggttgtggcaaattcgggaaccgaaagttttctccatcggcggagactccattcggacgatggggggggatgttgggttgttcggctggccccaaccattcaaaagggagattattgggctgtcgtggaggggtccgtcttgtggcctattggctctgtgggccgtgaagaggcttgcacgggtgtgggccacgtgctacaaaggtccgcagatggatgtgtccagtcctccctcagttcattggcacctaattttatgcttattggcagcgcggcgaaaaccagcggcaagaaatgtaccttgccccagttggccaaggggggaccttcctgggtgtttcgggctacacaggaggccaaaatgtgatgttgcccctggcaggtgtggaaccaagagcccattaaaagttatttcaaaaaggagtttaccctttaatgggcccaggcctggnttcggaatcggctattggccgaccttgttggtttgggtcgtgtaagatgcagcttcggtcctgctcgagaagggttgggtctttggcccaggttctggcatttcctcgggccccacgtgtcacatggngtggggccagaatgtcctttgcacggggctccggcgacccagcgactggtagttattcacagacactttggtaaaataggtcatt

SEQ ID NO: 527814 - DNA, 292 bp, Homo sapiens
  misc_feature (1)..(1): n is a, c, g, or t
natgagattgcaccactgcactccagcctgggtggtactgagtaagaccaggtctcccaaaaaaaaagaaaaaaaaaaacagcgtcagttccatctattttaataggtttctgtaaaattcacgcctgaggtgctgttttagttttttttgttctccaagcccacgggtcaacccgactgcgttgctgggccacaggcttccgtgctggttgttcgccatttaattgtaccggcagagttttcaatcgaggttggcgcaagcttcttcacgccagatttctgcgggttcaag

SEQ ID NO: 527815 - DNA, 1136 bp, Homo sapiens
gggccgacctggtggagaaggtgcggtcgcgagggtcgatggcagcgcgcgcgcgcaggaaaaggagcgcgagcgctgagcgggaacgcgagaaatgagcgcgaggcgcgagaaggagcgcgagcttgatagcgctagctgtgaatgttggctcaggaggtgccgtgtctccgagtgtgaatgcccatctctgggacccagtgcgccctatcgctcctccagtttggaaccgggcaggtggcggtggcgtacagttgcccccgcgtaccttgggtccttgacactccagtcattgcgcactctcagtgaatatgcccggcctcatggttcatgtcatccatggtcaatcgcaagcatccattctagcgtgtcccctgggggcttgtggacgcctggggctcctgggttacaattgtcccgggcctgtacagcagtgatccagctgcccgggagagggaacgggaagcccgtgaacgagacctccgtgaccgactcaagcctgggtttgaggtgaagcctagtgagctggaagccctacatggggtccctgggaccgggcttggatccctttccccgacatgggggcctggctctgcagcctggaccactgtgctgcaccctttcccctttcatccgagcctggggcccttgagcgagaacgtctagcgctgggaagctgggcagccctgcggctgacatgtctatgctgagcggtggagctgaaaggcagacggaaaagggttggggacctgggcaatggaccaattggcccggttggagatgtccaatgtgaatcccaataacaacaagaagtccaaattcactgcacttgcgttggcagcaagatgatccatggagctttgctcggtgacccttatttagccctggcgctcagaggtgcacataagggaaccctatacaaggggaatttccgtaacccggtgttcaccgtagcaaaaggaatttgctaagcgttttgtgccttgggaaggggcccattgaccatgagaaagagggagaccaagagataagagacgaaagaggggatcaccgaggtctcgagacacagagaggagcacatcgcacgcgctgggtgggatgtagacacaccgacgccgagagacagaggaggagaa

SEQ ID NO: 527816 - DNA, 290 bp, Homo sapiens
  misc_feature (253)..(253): n is a, c, g, or t
gtctactctatgagtatccccatttgtcctgtgactcacttccaacagcagacagatatctcccagggaggctgctacttgtacagactgactggaaaggaaccgcgagaaagtgccgcccaggctctgggttaccaaagttgagagcctggggacctgaaactagggtgagagactccccaaccaccccgtgtaggtaccagcacccacaggtgctttttgcacacatgaccctgattccagaaggctagantagagggccgcggtgtacctctccctcttgccgccca

SEQ ID NO: 527817 - DNA, 726 bp, Homo sapiens
  misc_feature (434)..(434): n is a, c, g, or t
gggtgttccccggaaaacccttaacagttagtttagttattgcccctaacccttgtggttaggcccttgtgtaaggccaataaaagagtggcccggccttgaacagggttgtttaaatcagcagaaggaagcctgtccagttgaagtgttccggattgttagctctcacaggggggcaatgttaaccttcaccttgatctggaaggtctcatcttataccgggagatgtttgtaggaggtgcacgaacagataagaactccaggcctctctctctcaagtgaggaattgctgtgatgtttccacaggtatgacatttatgatggagaagtatagcctctgttatagtttatgttttcctgcatatagatcttgctgtgttgagcagcctggtctagaatcgctgggctcaagccatcatcatagttgagcctcntgagtagctggagatacaggtatccggtgcacccatgcgtgtcatttatggacattttaaggttggtccgtgtgttttcaaggtagcatggggagcaggctgtgggtttttgtccaccgtctgtttttggatttgaggacgctagtctttggtgatgggactcgaggtgcttagaggtggtcgtcatagtaggtctgcatgcagcacagcaaggtgctcggggtccagatgtagttcatatccgtctctggtcgtgtgtgtggtgtgtctacagcccctcctcactgatgac

SEQ ID NO: 527818 - DNA, 276 bp, Homo sapiens
tggcgagaggatccctccataatgtgtgccaagctcaatgatgcgatcattcccattttaacttcccacacttaccatactacaaccagattacagtaacaatctatctgccttctctgcctttaactagctccttcccctaaactctacacattgctgacagattactttttcctaaagcattactctgaatactctatcccagagacactgacctgcagtggcttttttttttttggagacggagtctggctctgtggctcaggctagagcgca

SEQ ID NO: 527819 - DNA, 305 bp, Homo sapiens
tagtagtagattcgcggccgctcgacgttgtgttttttttgtttggatgtggccgtcatgtccgttagtggctgagctcccctctgcctgcacgaagtcctttatggctttgtagatcagtttggatattttctactaaaaatgattttcttcttcatcttcagtttggatattttctaataacctgttttgacctatctttcatcttttctgctgtgactaatcatctgttctactgttctacttgttattgtagtgaaaacgcataaaatttatcttaaccattcgaagtacacagttcacta

SEQ ID NO: 527820 - DNA, 536 bp, Homo sapiens
ccccacgctgcaccggcagtcaaattaaacactatttaatcttccagatatcactttttgtcaaaactcaagagttatgaatggaccttaccatactggtgctctctgactgagctcctctctactctgaatgcaagagaccctcataggtaggcagaaatatcgcccctattcagccggaagaagttatagaggatggatcttcgtccctctgcacacccttagaattaagggttctcttcataaacagggacagggggaaaatgtatggaggcgtgtgaaccagagctccatctttaacaggcagcagggtaaaatgaggctgagcactaccatgcagcattcccagagaggaattctatgtcccaagatgagatgggaggttagcacaagatacaggtcataaagatcttgctgctaaaacaggttgcagtgaaggagctggctaaaactcgccaaaaccaagatggtgacgcgagtgacctctggtcgtcattactgctaacctcccatcagcgccctgacagtttacaaat

SEQ ID NO: 527821 - DNA, 801 bp, Homo sapiens
agagatctttctcttcaagatatttggcgcctgatcaaaatagcattgtcttgcatggtacatacctggtcaaacaacctaattcgtcgaatcctgttaaatctcaaggtaattcttctagcacagatgttttacaccgcgttatgtgatttagcgatgtgaaagtgccatttcttgtcagctggattcacgaccgatcatacagtgaaatcaggtcaacacaagagatgacacaactctggtagttgctgactgtgcttgattgccgaactgggcttgaacaagctctctgcgagaagacagtgatctagactgcacagacagtgttgctacattacaagattgtgttcctcaatgacgtcaattagcaaagtaactatctcaagagtacaacctttctatgacaaacaaatacagctgtcacaaaaaaggaaatcgtaggttcacttctacattcgggcaacactgggcaattgacagagaccattttcctaacaccatatatgtgctagtactttaactttataaaattccacttctacgtttggtcaataataacaatttctatcataagttcacgaatgttatacgtaccgaaagtatgcagccaacactcgatcagatcgaaaccattttacctgggacgtttggtaactgggtctacaacttgctctgacatctgtcatcacgaaacactaacagacacaattgaactttgccagacgacaaacgacaacccacaaacacacgacaaatacactgagggccagagccacgaccccacgaacagccttctcacac

SEQ ID NO: 527822 - DNA, 135 bp, Homo sapiens
  misc_feature (124)..(124): n is a, c, g, or t
caaggtgctgggattgcgggcgtgagccgccacactccgccttattcaattttaaaaataaaaataggctgggcgtggtggctcacgcctgtggttccggcgctttgggaggccgaggcaggtnggatcacaaga

SEQ ID NO: 527823 - DNA, 310 bp, Homo sapiens
  misc_feature (46)..(46): n is a, c, g, or t
  misc_feature (219)..(219): n is a, c, g, or t
attttggagcttgatagggctttatatattggaatcactggttgtnagtgtgtacttcctaaggagttttatatttgtattcacatggtgccccaggggtattttcagtccaagattactacttaaattcatttcttaggctgggcatggtggctcatgcctataatcccagcactttgggaggtaaaggcaggaggattgcttgagcccaggagtttnagaccagcctgggcaacatagcaagaccctaccttacaaacaaatataaaaaaattagccagggatggttggtgtacaagtagctacggat

SEQ ID NO: 527824 - DNA, 496 bp, Homo sapiens
atgagagccccttcatggggggcgcgcggggccacgccgtgtacgtggagccccacggccacggcccagcctgagcgtgcagggcctctcgcgcgccacgcccgtgcgcctgctcagcctggccttcgcgctgtcggcccactcggtctttgagggcctggcctgggctgcaggaggagggggagaaagtggtgagcctgttcgtgggggtggccgtccaagagacactggtggccgtggcctgggcatcagcatggcccggagtgctacgcatcgtcgatcagccaagctggcggtcaccgtaagcgccatgatcccctggcatcggctgggctgggcattgagagcgccagggctgccgggcagcgtggcgtccgtgctgctgcagggcctggcgggcggcaccttcctcttcatcaccttcctggagatcctggccaaggagctggaagagaagagtgaacgtctgctccaggtcctcctcctggtgcttggc

SEQ ID NO: 527825 - DNA, 386 bp, Homo sapiens
  misc_feature (17)..(19): n is a, c, g, or t
  misc_feature (40)..(40): n is a, c, g, or t
  misc_feature (54)..(54): n is a, c, g, or t
  misc_feature (56)..(57): n is a, c, g, or t
  misc_feature (84)..(84): n is a, c, g, or t
  misc_feature (91)..(91): n is a, c, g, or t
  misc_feature (93)..(93): n is a, c, g, or t
  misc_feature (106)..(106): n is a, c, g, or t
  misc_feature (180)..(181): n is a, c, g, or t
  misc_feature (250)..(250): n is a, c, g, or t
  misc_feature (303)..(303): n is a, c, g, or t
  misc_feature (325)..(325): n is a, c, g, or t
  misc_feature (327)..(327): n is a, c, g, or t
  misc_feature (343)..(343): n is a, c, g, or t
  misc_feature (371)..(372): n is a, c, g, or t
  misc_feature (381)..(381): n is a, c, g, or t
cagggctttactatctnnncatctcattaattcaattaanaccattaccttaananncccctctttcgaagtgtggtgtctttnatatttnanttaactgtatgangtcatagataatagtacatgtcaccttaggtagtaggaagaattacaatttctttaaatcatttatctggattnncatgttttattagcattttcaagaagacggattatctagagaataatcatatatatgcatacgtaaaantggaccacagtgacttatttgtagttgttagttgccctgctacctagtttgtnagtgcatttgagcacacatttnanttttcctctaattaantgtgcagtatttcagtgtcaatatattnnctatttagngattg

SEQ ID NO: 527826 - DNA, 323 bp, Homo sapiens
tcgacgggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccttccccgaatagaggaggaccggtcttcggtcaagggtatacgagtagctgcgctcccctgctagaacctccaaacaagctctcaaggtccattgtaggagaacgtagggtagtcaagcttccaagaccccaggtcgacgcggccgcgaatttagtagtagtaggcggccga

SEQ ID NO: 527827 - DNA, 435 bp, Homo sapiens
tcgacgggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccttccccgaatagaggaggaccggtcttcggtcaagggtatacgagtagctgcgctcccctgctagaacctccaaacaagctctcaaggtccattgtaggagaacgtagggtagtcaagcttccaagaccccagaccatcctttagtagacaaagagaaaaccataaacactgcagctgcttttgtggcaagtgagagagcaatgaaaacataattaacagccgtggaacacctgcaaggtcaaaggtcgacgcggccgcgaatttagtagtagtaggcggccga

SEQ ID NO: 527828 - DNA, 1086 bp, Homo sapiens
agatttggatagtctaaaacagattttaaaaaataattcagatggggctttatcataattaggaggggtggctagtactgctcagccccagttgcatgttaggattatctgcagaccctgggtcacgccctgagagattccattttatctgtttgtggtaggacccaggcatttacagttttaatcaaattaaatttaatctacttttaaaaattaaaaattcccaggttattctagtaggcagtcagggttgagaaccccttatgtaggttataattatgcttctgtaactatttctgtatatggggggagagcacatcataattttttaacaacagtttgtcgattacattatagtgtgcaaagttttacataatttaatgctttttcccagggactactattatacagtgggaaccggtcttacagtgactggtcttagattatacaacagttaggaggaattgggattggaagccaagacatctgacctttaatctactatctttctcaccacaccagtattttgacctcagagtcctcaactgaaatgatggatcttgaattatttcatcttcagaactttatgtattgtgaagtactttttgcctgtggctatgttctgtaagttagctttacacaaaatactaaaggcacagtgaacttcattcaaatgcagtgtggaactctcaggtttccttggtctgcctcagtcttctactcatcagcaccacactgtcaaaatgttggacattacaaggggcgaacatagacataaataaaaaatattggtattgcatagacacttgatgcctaaacctaataattattaacttttatgtgcaagcttgggttcttgactaattggtaaatgataaatgaactagattagatccaattattagaaaagcactcttaagagtgcaatgaatgtgatttgaaaacttgaaagcagcctagattttactatatttgttattgttatcaatgggggtttgtcaaccttaaaaattattttttatgtaaagatacctaggaatttctagtaactgtatttgttttaataaactttgactttgctgtaaa

SEQ ID NO: 527829 - DNA, 645 bp, Homo sapiens
  misc_feature (173)..(173): n is a, c, g, or t
  misc_feature (180)..(180): n is a, c, g, or t
  misc_feature (182)..(182): n is a, c, g, or t
ggttggaaacaatatcaggaaacttcatctataagaaacaccgtgggctgggcgcagtggctcacgcctgtaatcccagcacttgggaggctgaggcaggtggatcacctgaggtcgggagttcgaggccagcctgaccaacatggagaaaccccatctctactgaaaaaaanaaaaaantncgaaaaagatttagccaggtgtaggggtgcacgcctgataatcccagccactttgggaaggctgaggcgggagtatcgcttgagcctgggaggtggatggttgcggtgagctgagaatcagtgccattggcactctccaggccggtggggcagacaagaaggtggaaacctccattcttccaaaacaaagagagaaaaaacaagagggcggggcgtggagggggactcaacacaccggttagaactccgagagccgcacctgtgggagagaggccagagaggagagagcgcgggagatcctcaagagagaggcgctcgagagagagagatctgacagagacccgcactcgcgggggagcataacacagcggggagaagacacacgctctcaatctctctctcaatcccatacaatatcacacacaagaaaaaatctacgcgcccggggggcggaagtggcgcg

SEQ ID NO: 527830 - DNA, 179 bp, Homo sapiens
  misc_feature (145)..(146): n is a, c, g, or t
tgaggggagaaatgcaatcacagaagatgccacaatgcccgtgcagtccatcccagacatctaagaccgatgtctggaagctatgcagaggtgtgtcctccttatttattgttttcctaataagaaatcctaacaagctcagagnnctgactcctttcccagaccggaggagaccaaag

SEQ ID NO: 527831 - DNA, 573 bp, Homo sapiens
agttcaagaccaaactaggcaacatggcaaaaacctcatctctaggaaaaaaaagaaaaaagcaaagaattaaattagctgggcatggtggtgcatgcctgtggtcccagctacttgaggctgaggtggaaggatcgcttgtgcccaggaggttgaggctacagtgagccttgatatcaccaactgtgctccagacgctgggcaaataggagacgagagacccatctctaaaaaaaaaaaaaaaaaaaaaaaaaaaaactttttgggggcgcagcacgaaaaaaaaattctcgataaaccacatattgaggtggacggcgcggcgcaactgtaacacaaactcaagacacaggtgggacaacagaggggcgtcacgggaagaatcacggggaggacaaaaagacgggatgggaaatctagcccacaaaataaagaagacgccgggaggagaaacaggagggttactgaccaacactacatgcagcagtgccagagaaaaaacaggggacgtcctaacacacaagggaggacaagcgagaggagaacaaatataagccccgacgggagcacaca

SEQ ID NO: 527832 - DNA, 187 bp, Homo sapiens
cgtcgacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagttagctaaattatctgtcgacgc

SEQ ID NO: 527833 - DNA, 856 bp, Homo sapiens
  misc_feature (312)..(313): n is a, c, g, or t
acatgcagcaggggcccgggccacctcacgttccatacctagtgcctgagtgggggatgggatgctctgcttgtgatgtggccctgaagccagccgtaccgtccattgcggttgaacgtggccttttcccacagtgcttccttctcactgcgcacgcagagttcgtccccttgtgcaagatagatgtggtgtgggccatcgtggtccccttgagcccagccaagcttggacctcccaagtgtggggtgctttaccagaccacccttaaagtgacttcatcgtgttcctctttcaccaaaatatactcgtatnntaatattctccccagtgtggctggcatatttccaggaaagaggcatttaaaattatccatgggtatctttcttttttcccctcattgtgaatcagaatttttatataaaacaaaacagtgtgtgtctacacagaatttcatattcgtgcaaagaggggatttttgttggatccaatcatgatgtgtaggtcttccagtgcttgacaaattgtgcgtgtagacaacattatttaaaaatttaataaatccctacaattgaggaatatttattaaccttgaatattcaggaatattctccaaaatctaagttggtaatgtggaattctggagttttgtggtagcaacaaagtgaggcaagtaaagtgcaatttaaggtattatacctttgtgtacagaattattggcttgtggggaactaggatatagggttatatggactaattaccggagtatgaggcttggtttgggacagaaagcgggtccaaacacacggggacaacttgcgcccagtattcagaaattatttgggggcacaataatgat

SEQ ID NO: 527834 - DNA, 261 bp, Homo sapiens
  misc_feature (64)..(65): n is a, c, g, or t
agagagggtccaagggtgatggagaaggaagcatggcctgggagcttggaagggaggctctggnnccctgactgctgtaaacttctgtgtcccccgctttaaactgtctgtctagtctggcatgcctaaacctggccttgtaagaggtcccctttggtattaaggagctctagaactggctggtggagcccatatggcatactcactgctgttcactaggccaatgagatgccaataatccattacatgtctttggcatat

SEQ ID NO: 527835 - DNA, 235 bp, Homo sapiens
tgtgagaagactccatctcaaaagaaaaaaaaaaaaaaaatctggaatttataaccttctacaaatgggatggtcaggttccacttttttactggtagggattgggtagaagggactggaacccaaggttactagcgggtaagtgggatggcgatttcggggctacgctccacccttcggctattctcttcattggtgatttttggatcttggtggaccattccccattttcata

SEQ ID NO: 527836 - DNA, 453 bp, Homo sapiens
  misc_feature (327)..(327): n is a, c, g, or t
atgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacngcaaagcaccatgggggtggctggacaggcttgttggagtcgtataatgcaatgaataaaaacttacggctgccttaaatgcaaatgtcaagcccttaaataaaatttaacaaagtcaaaaaaaaa

SEQ ID NO: 527837 - DNA, 131 bp, Homo sapiens
  misc_feature (14)..(14): n is a, c, g, or t
  misc_feature (18)..(18): n is a, c, g, or t
  misc_feature (83)..(83): n is a, c, g, or t
  misc_feature (88)..(88): n is a, c, g, or t
gatcgggcggattnaggntgtcacccccatcccctctgaacagcactcgcaggaaggggggtcgccgtggtcgccgtctgtanacaanattcctcaaaatattttctgttaataaattgccttcatgtaaa

SEQ ID NO: 527838 - DNA, 844 bp, Homo sapiens
agcggcctttgttgtcttcgtgctgagtagactgagaaggaggaagaggagggattggtcttgctgtctcaatggtggcagaggcagaagaaaatctgcatataaatggacccacttgattcaaatgtgttgttcaagggtcagctgtatattggttggctctcattatctaatattttacgtaagaatcttctctgtcataaataaaatgaacttaaaattttcttttgttgtactgacttggttttacaaatcaaggttatactagcctcagaaatgactagaattgcttttattcttttctattttccgaagcaatttacttggataaaaatttctaattaataaattaaataatttgcttcctgaaattctatgagaacccatcctccaaaaccatctagattgaaacttttcctatgaaattaggataatttctatttcaatctttttcatattagtggctattaatccatttggagtttctatttttaaatctgagattaatggttgcttataattttactattttatgccagacatggtggctcatgcctgtaatcccaacagttttgggagacccaggagggtggatcacctgaggtcaggagttcgagaccagctggcaacatggtgaaaccccatctctactaaagatacaaaaaattagctggcgtggggggcgcatgcctgtatccctgctactcaggaggctgaggcaggagaatcacttgaacctgggagacagaaggttgccagtgagctgagctcgcgccactggcaatccagcctggtgacagaatgagattctggttccaaaaaaaaacaaaaaatctccagcgcg

SEQ ID NO: 527839 - DNA, 590 bp, Homo sapiens
tgaatttagaattatcaaagagcaagcttgaatttgaatttgatactattattgtgttataaagaaagaatctattgtgcagtgttaaaacaccagaaggaagatagtatgtttgaatatcttttaattgatacttatatttaaaagatgctaaactatacaataatgtcgtagttggcaaaatatcatttgagtctgaaagatatcactgacaatttgactgcttttagattagctttaatatagtttccatggtgcgtatgtgtgttccccattttaggttatagtgttgttggcattgagaatatctcccaattgatgcatgagtaagagactaccagaaataaaaagtatatcctaatctgatatgcatttagcgaaatgtttttgattagtattaacattttaaatgttactactgcatcataactgctgtaatagtgtaattaatatttgacctgtaatgagtatttttcttaaaaacctttatttaccaccagaattaatgcctgagtttccccttatatagacatgtatctgaacattgttgaccccaaatgttaaaataaattaagagatttttggttaga

SEQ ID NO: 527840 - DNA, 99 bp, Homo sapiens
actacgtcacggttgctagtcgtggaagggagaaaggtgaattcaccgaatttacaaggtgtgtcggcagccaaccgtggactagtgggtaccgagctc

SEQ ID NO: 527841 - DNA, 290 bp, Homo sapiens
atattgtcatcgtccaatgagtacgaggcggcagatatggcattatttgagcgcgattaagccataacttaggcgtctgaggtagctcaggattatccgtctagatctgatgagttctatctatgtacagtcatatgagtctgcatgtcagtagtcttgcgataacgaatagtcaagtcctgctaggacgcatcatgctgacgagaagtaggacgtcgatatctcctcaggcaaccatagtgaatggtatagggagacggctgtgcgaatggtagggtagtgcactgcac

SEQ ID NO: 527842 - DNA, 212 bp, Homo sapiens
cgcttaccatagataaatgtacacgtgtattcacacaggaagctattcagagacgtacaccagctctattaaagaaaaaaaaaacaagacaaaaccttgaaatcaaccctaatgtccttcacctggaaattggtcacctcctggtaaaaaataagtgaggctgagccccgaataacctaataaccggatgtgcatgtcggagagtaaaatcc

SEQ ID NO: 527843 - DNA, 426 bp, Homo sapiens
  misc_feature (306)..(306): n is a, c, g, or t
  misc_feature (312)..(312): n is a, c, g, or t
  misc_feature (373)..(373): n is a, c, g, or t
  misc_feature (379)..(379): n is a, c, g, or t
  misc_feature (416)..(416): n is a, c, g, or t
  misc_feature (422)..(422): n is a, c, g, or t
agcagcaggacgaagtggactgcaatatcaaggaggctcatgagaagctggagatggagatggaggttgctcgccttcatcaatgccaggtcatgctaatgaggcaggatttgatgaggtgtcaagaagagctgtggaggatggaaaagctgaacaaccaagagatgcaaaaacgacggcaactggagcccatgcgagaggagtgcaggcactaggaggaagcaatgcacttggtaatggcaggaaagattcacttggaaccttctctgatatgagacagcaggaagatacagatgggccagatgnttgttnggaggtgcctataggcataaccggaggcaccatgccccctgcttcctgtgccagctggaancccaanttcctccaagaacctgaaacctatgatgcctagaatnaccccnccca

SEQ ID NO: 527844 - DNA, 236 bp, Homo sapiens
  misc_feature (139)..(139): n is a, c, g, or t
gcggagtatgaacagccagaaggacctcctggtagcggaggcgtgccgcggtggacacctacggcagacacaactacggggtgggtgagagcttcacagtgcagcggcgaggttcacacctcaggtgactgtgtatccnttcaaagacccagcccttgcagcaccacaacctccttggtctgttctgtgaatggtttctatccaggcagcattgacgtcaggtggttccggaacgg

SEQ ID NO: 527845 - DNA, 112 bp, Homo sapiens
cacagttcgtttgatttccaccttggtcccctggccgaacgtccacggggtattgtaactctgttgacagtagtaactgtccacgcggccgcgaatttagtagtagtagacc

SEQ ID NO: 527846 - DNA, 537 bp, Homo sapiens
  misc_feature (16)..(16): n is a, c, g, or t
  misc_feature (47)..(47): n is a, c, g, or t
  misc_feature (284)..(284): n is a, c, g, or t
  misc_feature (400)..(400): n is a, c, g, or t
aattattgatcccctngaagtcttccctgaatgatccagccacaganggcatcatactgattggtgaaattggtggtcacgctgaagaaaaatcgtgccgcgtttctgaaggagcataactcaggtccaaaagccaagcctgtagtgtccttcattgctggtataactgctcctcctggcagaaggatgggccatgcaggggcaattattgctggaggaaaaggtggcgctaaagagaagatctctgctcttcagagtgctggggtggttgtcagcatgtcccncgcacagctgggaactaccatttataaggagtttgaaaagaggaagatgctttgaaggacacaacaagaaattctttaaagctgtggaagaaatctagacgtgagggccagtccangctgtcagcccatgcagctgacactggttggtctctcagtatgtgggaaatccaggcaagttttagaatgtcctaaattgagctattttcacttactgtgtaacagagacagataataaatctatcatttgatttga

SEQ ID NO: 527847 - DNA, 855 bp, Homo sapiens
acacgctctgtaccagcacgatgccgcctgccgtgttattgcccgtctcaccaaggaagtcactagctgcccgaaaagctctggctaccctgaaaccacaggctggtcgtcgattgtgcccccacggctgctgctcaagttcccaaaccgaagtgttagtggcgtgcggtgtgagcctagatggaattcgcggctgcgctggtgggaatgatcccgagagattattcacaagcttcaagacaatagccactgtgctagacacgagtaggacgcacgaagagacgggaaggactgtgcctgtagggagctgagtgaagccagaagagctcagcaaactaccggcatggtggcatctcgcacgtggggttgcacagtgccagcattcctgggatcctgggcccgtggacctctgtccctgtccgaggaccaacaagatcctcactggtggggcgcgataacaaatgtcgtggtgttggacaaaagttctgaacaaatcctggactaccctcaaaggccataccaagaaggtcaccagcgtggtgtttcacccttcccaggacctggtgtcttctgcttcccccgatgccattatcaggattgggtcggtccccaatgcctcttgtgtacaggtggttcgggcccatgagagtgctgtgacaggccttcagccttcatgccactggcgactatctcctgagctcctccgatgatcagtactgggcttttctctgacatccagacagggcgtgtgctcaccaaggtgacagatgagacctccggctgctctctcacctgtgcacaagttccaccctgacggactcatctttggaacaggaaccatggactctcagatca

SEQ ID NO: 527848 - DNA, 168 bp, Homo sapiens
ggcatctcagacacatcaatcatgtatccatattatagcttcttcgtttagtataggttttaggtatgctgggtttgccttttaaaatgggacatactttttaagttattcataagctgtatattcacccaatgtggccaatccatggatattttcaaatcacagcat

SEQ ID NO: 527849 - DNA, 500 bp, Homo sapiens
  misc_feature (86)..(86): n is a, c, g, or t
  misc_feature (88)..(88): n is a, c, g, or t
  misc_feature (338)..(338): n is a, c, g, or t
  misc_feature (342)..(342): n is a, c, g, or t
  misc_feature (353)..(353): n is a, c, g, or t
  misc_feature (360)..(360): n is a, c, g, or t
  misc_feature (367)..(367): n is a, c, g, or t
  misc_feature (427)..(427): n is a, c, g, or t
actagtccacgctgggctggaagacctggattttttcccgaacatgtggattgactggaagacctggatttggtggaagacgtagntntttctggaagacactgactgactggaagacggatctttctggaagaccgatgactggaagacctggatttctttctggaagacactgatgactggaagatctagatttttctggaagaactagatttactggaagacttggatttggtggaagacacagatttttctggaagacatggaggccattggaagatgtggattttctggaagacatggcttgtttggaagacgtagattggcaggaagacccnaatnatccggaaganttggatngttgggnagacgtggattttctggaagactgggaggttactggaagacatggattttctggaagacntggattttctggaagacgtggatcttcaggaagacatatatgctggaagacctggagcccaccgtggactagt

SEQ ID NO: 527850 - DNA, 371 bp, Homo sapiens
  misc_feature (86)..(86): n is a, c, g, or t
  misc_feature (88)..(88): n is a, c, g, or t
  misc_feature (209)..(209): n is a, c, g, or t
  misc_feature (213)..(213): n is a, c, g, or t
  misc_feature (224)..(224): n is a, c, g, or t
  misc_feature (231)..(231): n is a, c, g, or t
  misc_feature (238)..(238): n is a, c, g, or t
  misc_feature (298)..(298): n is a, c, g, or t
actagtccacgctgggctggaagacctggattttttcccgaacatgtggattgactggaagacctggatttggtggaagacgtagntntttctggaagacactgactgactggaagacggatctttctggaagaccgatgactggaagacctggatttctttctggaagacactgatgactggaagatctagatttttaggaagacccnaatnatccggaaganttggatngttgggnagacgtggattttctggaagactgggaggttactggaagacatggattttctggaagacntggattttctggaagacgtggatcttcaggaagacatatatgctggaagacctggagcccaccgtggactagt

SEQ ID NO: 527851 - DNA, 201 bp, Homo sapiens
gtataatcacattgcactatgatgtgatggagaagaggtcaataaaagtcaacaagctcacagctgccaggagtaaaaagaagaaaaaaaaaaaaaaaaccccaaaaaccattataatttggcttggaaaataaaagtccaaaaggaaaaaggcccttttttttttggttcctaagggggaaggaataattctttccctaa

SEQ ID NO: 527852 - DNA, 172 bp, Homo sapiens
tgaccttttggacgatatgatttctctttggaagttatttgatcattttccgttttatgtaaatactccttggtgagggggagtaaaataaaacccgacacacagttacggtctggtgtttattagaatctggtgcagaggtacacgtctagtctagaggtacaaggatagg

SEQ ID NO: 527853 - DNA, 156 bp, Homo sapiens
tgaagtcaaaactgtttattaatatttggagacacaagaacttatgttggccgaaaatcataagttacattgccttggtacaatgcacctgagattgtcaacgatgacgcaacatggctgtgaaatacaggacaagacagcttccttctgggaggt

SEQ ID NO: 527854 - DNA, 430 bp, Homo sapiens
acagcacatcgaggggactgtcggtggactccacaagctatcggatggcgagcatgctagtaacccgacaaattccgtcgttcaccgcgagggagcgtcatatagagaggaagagctggggcagcgacttcatgcccggtacctacaagcgacaccagcgtcggcaaggcactgtatggcaccgggatgaacacgtataaccgcagaagaacgacaggcgtatcgacacaaagtttcgacaaaaattttgtcgaaactcgcaggaaaatacgacctaggtcgagaataatacattacggagttgttcatctgggatatcgtattcccgaagaaacgattgaggaaatccgtcgggctgttgatctagtcgatgtcaatagcgattatgtccagctcacaaaacaggacgccattattttggactatgtcc

SEQ ID NO: 527855 - DNA, 256 bp, Homo sapiens
catacccatgtttcctatcctgatgtctcaaaaatcaaagaacaggatatagctcaagtccttcatcagagcctcctaaaaaacagaccacatatactgaagggttacgtccagagtctatcgttactagtttcaggaagcagttcttcattttggaaacaggcagtgatctcaaccaagtcggtaacctggaattgtaagctccagagatgcgacatagacccagcccatcagagactgcacctcttgaaagatc

SEQ ID NO: 527856 - DNA, 353 bp, Homo sapiens
taagtgtaggatttaatctagagtgatgtgcatgtacatctgtgttcatagaagtgtgtcctgtgataattacacatgtaaaaatctcagtgtgcacacacattgtaacatctgtttcatctttaggtctggcaggcagtatcccagctatataattgaattttcttggtgattgataccttaattaatctgtcctttaaaagtagttcctccactttgttctagaattatttaaatattttgacaatgcattatatatttcctgtcagttaaagctgaagttcttaatactctgtagcagtaccataaacctgtgtcctttttcacaattaaaaccttttttttttaactta

SEQ ID NO: 527857 - DNA, 274 bp, Homo sapiens
atagtgagatgagtacagtagtagtgttctcataaaccattctgatggcataataaaccaagagaacgttaacacaatgccagaaaaggcattaaccgtgtaacacacatatacgccacacatgcacacacacacatacacgcacactaaggttatattctgaacacaaaagtgatagaaaaaagctttgaactgcgctaaactcaaactaaaaacccctttattataataaagctgtggaaactacctgtgagcggctcgactggggactcct

SEQ ID NO: 527858 - DNA, 468 bp, Homo sapiens
atggcatgtatgtgaggacattcattcatttagtaaatatatactatatgctagacattgagattagggagggagcaaaacaaaccatctgtcctcatggaacttataatctaattgtgactaacaataaaaaagcacatcctataacacaatgcagcaatgacgcagtaggttctgaggtgtagtaacaggaagaaaataatttaccacatcctttatgcattgggtgtaacaggcaagcttgagcagaaaaagctttttttttttttttccgagactctcactctgtcgcccaggctggagtgcagtggcacaatctgggctcacggcaagctccgcctcccaggttcacgccattctccggcgtcagcctccgtgagtagatggcagtagtgaggacattttccatccagttagtaaatttttactatatgctagacttggagatcggggggggagcaaaacaaa

SEQ ID NO: 527859 - DNA, 156 bp, Homo sapiens
tgcgtaaccactctaagggcgttacctcagcaatcagagacctccagctccggcgtggctcctccggtcaccaggtccgtatcaggctgaggatattgtcattgaagtacgtcgcgctcatgagtgagtccaggacactgacggcaaatgctgtcc

SEQ ID NO: 527860 - DNA, 309 bp, Homo sapiens
ccaaactaaggggaaagccaaagaagtgggggcaaaataaagaacaaaccacagggccatgtgggaaaagaaagcaaacctgtaagtcaagctgagaactcttgctttgtggggcccggccgctcgggccagaaccccaagaacttcttcttccatccacaaaagacacccctcagagcccacaccagcccccgaaaaaaaagggcgccgacacggggttaacaaaaaccaaaaaaaaaagagacgactataataatatggttacggttctgacgcccctggggggcccgaaaaaaaacccaaacaacc

SEQ ID NO: 527861 - DNA, 817 bp, Homo sapiens
aaactaaacaacagaagaaggtgcggcgcgcccgcctggatgagcccccgtgccgccaagggctgccctggcagccattttggggacaatgaagaccaaacgggttccgaccccagccgtagatctcaaaagggcggtaaacacacccagaccaaaggccgggtctttacaaaaccaggccaggctagaaagctaagaactgcgcgcctaaaatatacggctgggtgaaaatgaagggacctgtctcgggaacaattccagggtcaaggggtgatgccccaacaaaaggtgcggcccacgggacgtcggggacaaacataattgtaaaatcccgcgggccagccacatgccgcccgcacccccgggcggtaaacccacaagggaacccgggtattctttgggcgagcgtccccgcgcgctttcccggagaccactggttggcgacaaccacttgcggagaaaaacaaacaatcttcgaagggggagaaccgtggaagaccataaatcaccgggagcctcctcaacgatatctaggacaaatatgcgggcaatcttccagggaagatttataccacgatcgcgctttgaggaataaaagttgcgatgttctatacctcgtccatacttgggcggccggagatatataaggcacgtcttgggcagaccaccaaaagctcaaaggcgcccaaagttcccccactagcgagaaaaagtgggaaattccagaccccgatcggagaatgcgaaaacaatagtctccaaaagtgtttcaagaaagaaagactatcaaaccacttaccaattttgggaaaatata

SEQ ID NO: 527862 - DNA, 375 bp, Homo sapiens
  misc_feature (2)..(2): n is a, c, g, or t
  misc_feature (112)..(112): n is a, c, g, or t
  misc_feature (236)..(236): n is a, c, g, or t
  misc_feature (299)..(299): n is a, c, g, or t
  misc_feature (324)..(324): n is a, c, g, or t
cnagaagtataaaaaagcctggtaaatccactgtctgaaacattcagtattacaggaatgtaggtgacaggaggtagagcaggaaatgaagctagcagagggcagagccctnagaagtattaaataattacaaatgtaaagtgctgtgaagggaattacctggatccctgagaagacaaaatgaaagtctaacctcatttgaagctctttggggaagctcctgagcatttcagctnacactgaataggaattaaaaatcactctggaatgagtgagttgagagataggaaataaagttnacaggacatggtgtgatcagaaatnagggattagaaaaaaatatcagggatgacttctacatctttggtttagtgt

SEQ ID NO: 527863 - DNA, 771 bp, Homo sapiens
  misc_feature (450)..(450): n is a, c, g, or t
  misc_feature (491)..(491): n is a, c, g, or t
  misc_feature (503)..(503): n is a, c, g, or t
  misc_feature (537)..(537): n is a, c, g, or t
  misc_feature (544)..(544): n is a, c, g, or t
  misc_feature (548)..(548): n is a, c, g, or t
  misc_feature (560)..(560): n is a, c, g, or t
  misc_feature (578)..(578): n is a, c, g, or t
tatcttaatgggtgtgaccaatcctgtttcctatgctctgggtgaatagagccggatggtatactactgcttgggcaatggcatacaactgtgcattgacaaagtgaatatggtaaatgatggtctggggtacaatggatgttacagatataaaagttaggaacagtagaaatccaaagaactatgtaaacaagaaaagctgtttgttttgtttacaaagtatagtttaaggattattctgctgaagatgcagtttaggagtgtccttgggaagaactaagtaagaaatacgattgcctaacgatggttggccaggtaataagtgttgtgcacttcatgtccattacgtcaggtttctcatgagttcttaaaattagtgagattaaaaatctaaaaattttgcatttcatgctatcagaaacagtattttcttcccaaatcaaaataaangaaatatgatcagagcttgaacacaggcttatttttaaaantaaaatattttnaacatgggtttccttattgaaaaatcagtgtatnagtcatnaaanacatcattaagnatattgacataaagttgntttcagtgcagtttcaattatatctcattcatttatagcgtctcagtctttgtatattgccttttcatgtagttaatatctcattatcttttgcctaagttttctaatactaaatgtattcttaagactcaggggatataggggacaatactggttgggagaatgttgttgacaaataaaaattttttgggcc

SEQ ID NO: 527864 - DNA, 154 bp, Homo sapiens
aagtcttaggaagagggtgtacggagcagaggtttcaggagtgatacggaaaatgagtgcaataaccctcccacttatactcagtggtatctttagagaattacatggatcacgagactccatcctctgccagtgcagacggcactggtgggag

SEQ ID NO: 527865 - DNA, 101 bp, Homo sapiens
tcagcaagcgttccgcccgcagctgcgcgtgtggtaggtgacagtgcttgctgggttcccgcctagttcgatgcgggaacttgtggtcacgtgcctccgcg

SEQ ID NO: 527866 - DNA, 338 bp, Homo sapiens
tgacagcagagggatggggccagatggggtaaaaaggaatggcacaggccaggtgtggtggctcacccctgtaatcccggcactttgggaggccgaggtgggtggatcacctgaggtcaggagttcgagaccagcctgaccaacacggcaaaaccctgtctctactaaatatacaaaaattagccgggcgtggtagcgtgcacctgtaatcccagctacttggggaggctgaagcaggagaatcacttgaacctggaggcagaggttgcagtgagccgagatcgtgccactgcacaccagcctgggagacagagcctaagactctgtctcaaaaagca

SEQ ID NO: 527867 - DNA, 421 bp, Homo sapiens
aaaaagtggaaacaaccccaatgtctaccaactgatgaatgggaaataaaatgtggtctgtccacgcaatggaacattattagactctaaaaagaaatgaagtactcacacatgcccccacatggatgagccttgaaaacttggtaagtgaaaaaaaccaggggcaaaagcccacatattgtctgactgcattgaaatgcaatgtctaaaatggacgaatctatatagagtgaatatagattagcgtttgccagggcctggaggctgtgaaagatgaggcatgactactaagggtttggggtttctttttcgggtgatgaaaatgttctgaaattagtggtgattgtgcccgattttgagaatggactaaaaacccatgaacttttaaaaataaaaataaccaaaaaaaattccccagatg

SEQ ID NO: 527868 - DNA, 102 bp, Homo sapiens
ctctcctattgtatctagcactttgggaggctgagtgcaggtgatgctgagtcaggagttcaaaatcagctgggcaacatggtaaaaccccgtctctgcaag

SEQ ID NO: 527869 - DNA, 143 bp, Homo sapiens
agtggtgggtcgacttgcttgtgccctctggttcgaaatgtactcgatctgctggtcaggctcttgagggtggtgtcacctcgacgtcacgtgtcacgaaccagattggcatcatcagccctggtagtagcggccaccatggc

SEQ ID NO: 527870 - DNA, 323 bp, Homo sapiens
gtcgacagactcctaggcgacccagacaatattatctagccaccccttaaacacccctcccacatcaagccgaatgatatttctattcgctacacaattctcgatcgtcctaacaaataggaggcgtcttgcctattactatcatctcacctagaataatcccatcctcatatatcaaacaacaaagcatatatttcgccactaagccaatactttattgactcctagcgcagacctctcattctaactgaatcggaggcaaccagtaagctaccttttacatcattggcaagtagcatcgtactatattcaacaatctaatc

SEQ ID NO: 527871 - DNA, 161 bp, Homo sapiens
ctacaggatcttagcggcggcctttatttgggctggctagtctcggacgcaagggttcaaggttacttcgcgggagctggaactgcgggccgcgcaggccctgaagggctcgcgagcccaggggcgcggccgcgatgcgctccatggcatctggaggtggt

SEQ ID NO: 527872 - DNA, 233 bp, Homo sapiens
cggatcctgcagctatcggttcatgagtcacctctaatcacacgatcaaagggacagcatcagcacgcagcaatgcagctcaaaacgcttagcctagcccacaccccacgggaaacagcagtgattaacctttagcataaacgaaagttactaagtatactaacccaggttggtcatttcgtgcagccaccgggtcacacgattaacccaagtcaattgaaccggatagcttg

SEQ ID NO: 527873 - DNA, 102 bp, Homo sapiens
acggccgtgtattactgtgcgagagatcggggctactatgatagtagtggttgtaccaactggtccgacccctggggccagggaaccctggtcaccgtctcc

SEQ ID NO: 527874 - DNA, 869 bp, Homo sapiens
gctggctagtatgcctatcttcaccaataacacacagccaccctgccgcagctgctggcacagaagaggacggaagcactcgtggagtaccacaagcacgagtgggaggcttgagtgggaccatactgaccactattacgattgtaattagctcagcagggtgggttgcggttagggcgacactatacagcctctgactcaaactcctcccttttagtcttctagtccacaggttctaagacccaaacgtggagtgggtggactacaagagagttcccctagtgcacggagatagtgatggctgttgcgggcagggtgtgtcaaatatatttcctatactctagtttggcacatgcagtgtagtgtggtgaacagagagaacccatgagggtaccttgcaggaggagggacctactgatcccagagtctggaagagatttacacagctacatagattcctactctatgccgggcgtggtggcacgcgcctgtaatcccagtctacccaggaggcgtgaggcatgagcaatcgcttgaaccgggagagtggaggttgcaagtagatgctgtagcatcgacgccatatgtactccatgcctgggtcgacacgactcgagactgccatattcactatgtaaatgtatccttcccgtcgtatatatggtgagcccagttcaagggtccagtaacccaggtgctcttcatgcagactccatcattttgcaaaacctcaatcagggctaggggcgggtgaacctatgcttgaccctgaactttggttacgccgtgctgccactaagtgctttgaagtctgagatccggcaacaccaactgggggaactccgtccgtgcccaggaataggtttact

SEQ ID NO: 527875 - DNA, 173 bp, Homo sapiens
tccgctcgcaaggatgaggaagtgaattaccacttgttttacatggctaaatatagcccttggactttggtcttctcctttctggggtacatttggtaatatgttagttgatggtatagctggcacagtgcctgaagtatctacgattgcttgacctatgtttagtccaattt

SEQ ID NO: 527876 - DNA, 580 bp, Homo sapiens
  misc_feature (580)..(580): n is a, c, g, or t
tttgccagcaaaaaaaaaggctttttatttaaaacatgcaaaaaaaaaatgcctttgaattttaatacacaaatcatttttctttttttaataataacatattaatacctcaacattagataagtttgagctttttgggacagtcaatgcaactgttacagagtttggagaatagcaaatttttttgcccagggaaacataggaaactttccgtaagggaggtcgaatgttcactaaatcttcagggaagggaaaatgggagatgacaggtgaaaaaaggctttacagatagggaaagatggataatgccccaaaggaaagagagctgcagggactgcacagaagcagccaggccatttgtttttttttagacaggaatgaagcacagctggtaaaagggcggcccagaggcaaatccattgacaactggaggggggtcaaggttctttgggtcaaccagagatttcaggttaaagttcttgaaaatggaggtcaggaataaaaacagttccatgccggccagggcttctccacacaaatccgttttcctgttgagaaaggcatgaagtatttacttttn

SEQ ID NO: 527877 - DNA, 346 bp, Homo sapiens
tgagatggagtttcactctgtcacccaagctggtagtgcagtggcgtgattctcggctcacagcaacctctaccttcaaggttcaagcgattctcctacctcagcctcctgagtagctgggattacaggcacgtgcctccacgcctggctgattttggtatttttagtagagacagggtttcactgtgttggccaggctgatctcgaactcctgacctcaggtgatccacctaccttggcctcccaaagtgatgggataacaggcatgagccaccacacccagctaagttttctttcgaacactcaaatactaacaggtgcttaaacagaacaagtacaaggctat

SEQ ID NO: 527878 - DNA, 1975 bp, Homo sapiens
  misc_feature (1456)..(1456): n is a, c, g, or t
  misc_feature (1464)..(1464): n is a, c, g, or t
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggtaaatctgggccagggcccgccctgagccaaggcaggtgggaggcttggtaccctaactgcagttctcatncctgctcnctgccagtggtgctcttcattaggtgatcggggtgccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagacatgacggtggttggcgtggtgagatgccccctcagggcatg

SEQ ID NO: 527879 - DNA, 1875 bp, Homo sapiens
  misc_feature (1356)..(1356): n is a, c, g, or t
  misc_feature (1364)..(1364): n is a, c, g, or t
gaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggtaaatctgggccagggcccgccctgagccaaggcaggtgggaggcttggtaccctaactgcagttctcatncctgctcnctgccagtggtgctcttcattaggtgatcggggtgccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagacatgacggtggttggcgtggtgagatgccccctcagggcatg

SEQ ID NO: 527880 - DNA, 1499 bp, Homo sapiens
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccagtctcaggggccagccaagcccccaccccaaggaagccactgcctgcgaccccaggccggtgccatcgggtgactgcccggccaggggctgaatcccgcctagtggtacctccaga

SEQ ID NO: 527881 - DNA, 1496 bp, Homo sapiens
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaagtctcaggggccagccaagcccccaccccaaggaagccactgcctgcgaccccaggccggtgccatcgggtgactgcccggccaggggctgaatcccgcctagtggtacctccaga

SEQ ID NO: 527882 - DNA, 287 bp, Homo sapiens
  misc_feature (46)..(46): n is a, c, g, or t
  misc_feature (83)..(83): n is a, c, g, or t
  misc_feature (119)..(119): n is a, c, g, or t
gtggaagagggagacaagacagaagggtagtccggtcttgagtttnctttgtggggagtggtgaagaggcaaaaacggatctnagagtgaccttcgagtaaagaagacatggggctgtntggagtggctcacacccataatcccagcactttgggaggtggaggtgggaggttcacttgaggccaggagttcaagacccacctgggcaacatggcaagatcccatctctataaaattttaaaaaattagctgggtgtggtggtgtgcacctgtaatcccgggtactt

SEQ ID NO: 527883 - DNA, 2055 bp, Homo sapiens
  misc_feature (1384)..(1384): n is a, c, g, or t
  misc_feature (1536)..(1536): n is a, c, g, or t
  misc_feature (1544)..(1544): n is a, c, g, or t
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcagtgaccccaggagggcacaagggcagtggtgctcagaatggccttccgtaggcccaggtcaccatgttagaanggctgcaggctagtgctctcagcttcccggcccccccttccaggccgctgccgcctgaccctgtgtccaagagactccaggtaaatctgggccagggcccgccctgagccaaggcaggtgggaggcttggtaccctaactgcagttctcatncctgctcnctgccagtggtgctcttcattaggtgatcggggtgccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagacatgacggtggttggcgtggtgagatgccccctcagggcatg

SEQ ID NO: 527884 - DNA, 184 bp, Homo sapiens
tctggacatgctcctgaatggcatcaaaagtgatggactgcccattgctggagaagacttctctcctactgtcatatggagccctccagactgagggctccccttgtctgcaggattctgacgtctaaatgtcgtggatgtgtggcttggatgctcctacatctatgatgcagcttggaagccc

SEQ ID NO: 527885 - DNA, 1426 bp, Homo sapiens
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagagtctcaggggccagccaagcccccaccccaaggaagccactgcctgcgaccccaggccggtgccatcgggtgactgcccggccaggggctgaatcccgcctagtggtacctccaga

SEQ ID NO: 527886 - DNA, 856 bp, Homo sapiens
cctggtacgccccggatttacgggatgcggagcagtgggctggctgcgctgaagcggagctgtctggctcggtacgcccccacctcgtccaggaatctaggagtcggggtgtattccgaagccatctccttccgctctcccgcccctgcaggctgtgtgccgagcttggaagaacagtgtgacccgttcgacgtgaacaataggacatgacatgccctggccccgtgctggccactgcgtgagcgttaggaacattccctaaaatgcgctggcctggcgctgtcgtgaacagtggcgggagtgcggctggcgcgtgggggcgggacggggaggggcgcggccagccggggcttcttgcttcctgctgaccccgtgctgtgttgcatgggctggtgtggagtacgcgagagataagatcctcagtgggctgatccctgccctggagccctggttgaagccctgagggagacggcaaggcgatctatggtacgttcgcttacattatatcaatatttggacagtccctttaaagctcctaagagatattcaggagtgtcggacaaatacttccctggcgcccaggcaattcgaatattgtatgcgttcataagggatctgattgtggctgggactttgggacattttggtacactagtagaacttaggaaaggaatcatgttgaatggtaggggaagtaaggggagggggataaaatctttgggatgaactttagagggatgctagggttttccaattggtaggggataattaaattaatgcaaaaagaaaaaagaaatcacaggaaaagaatttggccatgaagaagacaaattaaaaaagaacgatattatgtgaa

SEQ ID NO: 527887 - DNA, 1356 bp, Homo sapiens
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagagtctcaggggccagccaagcccccaccccaaggaagccactgcctgcgaccccaggccggtgccatcgggtgactgcccggccaggggctgaatcccgcctagtggtacctccaga

SEQ ID NO: 527888 - DNA, 203 bp, Homo sapiens
gatcctgaggagatcccgaggagatcctgaggagatcctgaggagatcctgaggagatcctgaggagatcctgaggagatcctgaggagatcctgaggagatcctgaggagatcctgaggagatcctgaggagatcctgaggagatcctgaggagatcctgatctcagtgaggtcctcccctcaggatatctcaggatactcg

SEQ ID NO: 527889 - DNA, 442 bp, Homo sapiens
  misc_feature (1)..(1): n is a, c, g, or t
ngcagcagaaggtcgtcttcttgtaaatatttgtgaacaggacttccggagcacacacacagaagaatgcggccacacccttcctagccaactaacactgcatccttggacggaacggtgcccaagttcattttgctgtcctcttgactggatctgtcacaagccaacttggggtccctcagcactttgccctgatttcggatcctgagtaacagataccactgaattgctgtaacaatggggtgacacctttgggttttagtttttcataacactgagcctgttggttgacaaaacttggctgttggcgtcggtacagacaccagccaccgagctctctgacacatggacactggttcacatctacagctatttgaggtgccgggcaaaggagaactttaaaattgatagaaaactaaatttgaggaattaaaatcaagca

SEQ ID NO: 527890 - DNA, 1201 bp, Homo sapiens
  misc_feature (954)..(954): n is a, c, g, or t
  misc_feature (971)..(971): n is a, c, g, or t
  misc_feature (1188)..(1188): n is a, c, g, or t
ctactccttcagagactggaccagagaagccactgtgtgccactgtgggtggcccttgcaccccgcaactctcgccggctgtgcctagagagattcagcgcgtgccgatctcagggtgcccctgctcacaggctgcgaggccacacacgaatgactggccatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgancagcctgggtgggcaanaccaggtgtgagaagggacatttggaccacaatgaacagagcccagacttcaccattcaccaatgtcaaaggcagggactccaagggaagtcagtttcttacttcagatggagcaaagtcctatcaactcactatgccttggtttccccatctgtaaacgcagggtatggcctcaaccttattggcctcccagtcccattaaagctttgtgggaatntgaaaaaaaaaaa

SEQ ID NO: 527891 - DNA, 215 bp, Homo sapiens
  misc_feature (176)..(176): n is a, c, g, or t
  misc_feature (181)..(182): n is a, c, g, or t
gatcctgaggagatcccgaggagatcctgaggagatcctgaggagatcctgaggagatcctgaggagatcctgaggagatcctgaggagatcctgaggagatcctgaggagatcctgaggagatcctgaggagatcctgaggaggaggacctcactgagatcaggatctcctcagntctcnnatcctcgatctcctatcctcagattcctaaggg

SEQ ID NO: 527892 - DNA, 211 bp, Homo sapiens
tggactctagaggaccccgtgcattatggttcttagtgagcttaagttcagcgaacaacttgtcccacctccggtcggttaaatagtttttgcagaatagtcttcgaaaatagttttggcaataatagagattgtgatctttacaataagtgcacaagtcgatccaactgtgctgcgttagggaatatccttattacacgcctgttccatc

SEQ ID NO: 527893 - DNA, 1357 bp, Homo sapiens
  misc_feature (686)..(686): n is a, c, g, or t
  misc_feature (838)..(838): n is a, c, g, or t
  misc_feature (846)..(846): n is a, c, g, or t
ccacagctttttacctcacagctgtgcccctgtggggtggctggattgctagggccatttctccccaggagcccctgtgctggataagtagggtcttccctcaagctaataaatactgccccccaccccggccctaccacaattttacctaaaccacacataagtgcctgcaaagggttaaccccactcagggatggcatatggtagaaaacagggtctgaggctgggccctctcccttcttgcctttcctcatgcatagggcagcccaatctggtccctctgaacggccaggacctccgcagagggccctgctggcacgaggcactaaggtgagtcccggatgccagaggaaggggactccaccttggccgggcatccagcttgggccctggggggtgcgcattaaaggctccagactcagagaaaggctagcactgcccaagagtcagtcgaaggagtcagggccagccctgccctcccctcccctggctacaggcagggaagctgagtccagaagagtggggagggcagccagctggagcaggagctgctgggctccgtccgctggccaagaggtggctttgagaggtgggtctatccatgcccccagcagtgaccccaggagggcacaagggcagtggtgctcagaatggccttccgtaggcccaggtcaccatgttagaanggctgcaggctagtgctctcagcttcccggcccccccttccaggccgctgccgcctgaccctgtgtccaagagactccaggtaaatctgggccagggcccgccctgagccaaggcaggtgggaggcttggtaccctaactgcagttctcatncctgctcnctgccagtggtgctcttcattaggtgatcggggtgccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagacatgacggtggttggcgtggtgagatgccccctcagggcatg

SEQ ID NO: 527894 - DNA, 248 bp, Homo sapiens
  misc_feature (209)..(209): n is a, c, g, or t
  misc_feature (214)..(215): n is a, c, g, or t
gatcctgaggagatcccgaggagatcctgaggagatcctgaggagatcctgaggagatcctgaggagatcctgaggagatcctgaggagatcctgaggagatcctgaggagatcctgaggagatcctgaggagatcctgaggagaggacctcatctgagatacagggatcctgaggggaggacctcactgagatcaggatctcctcagntctcnnatcctcgatctcctatcctcagattcctaaggg

SEQ ID NO: 527895 - DNA, 375 bp, Homo sapiens
  misc_feature (62)..(62): n is a, c, g, or t
tcagttttctccccccagtgccctcaccccccagggaggcaagtccttgagctacacacacntggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactctgtctcaaa

SEQ ID NO: 527896 - DNA, 215 bp, Homo sapiens
cgctagttgggtctcagtaggttataaaagaatatatggtgatgataaaacaaagtaggtaaaacaaaaggcttagaatttggacataagggtttggttggataatgacttccaatggttgtttttacaggtgacacattcaccttatggtggtaggctatagtggataacaatttcttcagctgcctccaacatggccatgcctccataaatta

SEQ ID NO: 527897 - DNA, 511 bp, Homo sapiens
tactttccacagggcaaatcaggggggctgaagcaatcgggaaatttattcactgtcatgtaagatcagatgctaggcttctctaaggataggttgatttaacagtagccaatgcagctgtggcagagcatggttgactttcatgtgatttttttggcttgagcagtcatggttggcaggacacgtgcagttgttctgaggatcatggtctaacacttgagcatctagaggcaggaagggaatacctcttaagaatgaggagaacagctagaaaattccaaagtgctggggttacaggtgtgagccaccgcgccctgacagggtggtatgtcttcgaagacatttctattttttcaggtagtgacgttctcttatgtgaacataatcctcatagttgtgtaggcatttgtttggtatttaaattcgttagctgctcactattagtctttttaccacaggtattccagtaagttcattgttcctcttaaatcggttgatttttattcacttt

SEQ ID NO: 527898 - DNA, 824 bp, Homo sapiens
gcacgagggaacttcatgtaaaaggattgtgttcagttttgggaatagattctttcagcgtgttttgcagtttgcacctgtagtcccaactacttgggaggcagtttgcacctgtggtcgcacctacttgggaggctgaggtgggcagattgctggagcctaggagttcaaggctgcaatgcgctgtgatcacaccactgcactccagcctggttgacagagtgagaccctgtctcaagaacaaacaaacgaaaagtaatggtatataggagaaaagtagaaaatatagataaatgaaaagaagaaaaattatctatgttcatacaacccagagttaactaagtattctaaatcttctgacgtgtatccttccagactttttcatattgatacacacatgcacatatacacagtttcttaaaatttatttttgttttcattttttgggggtagagatggcatctctctgtgttgcccagactggtcttaaatctgacctcaaggaatctccccacctcacacacagctttaaatgtattttacatcgcaaatgggattatattatatatactgttttataaactttttcatttaatgtataattttcaccaaaaaattttttgccccatgatatcaattcttttgataatagaacttcacatttctgtcagatgattttcatagaatatagtcaagattctttgaagctgagcatggtagctcttgcttgtagtcccagctactcaggagggtgaggtgggaagatcgctagagcctaagagctcaaggccagtcttggtaacatataagacctcgtctcttta

SEQ ID NO: 527899 - DNA, 114 bp, Homo sapiens
gatcgctgtccacggaagtgaaggagcacgtggccacggagctattcgggaacaagagtactactacatcccgcagtacaagaactggagaggacacactattcgagagcacag

SEQ ID NO: 527900 - DNA, 131 bp, Homo sapiens
tatgtgaaggggggcacgagacagagggcagcaacaggcttctctcctgggctctgtggagcctgggaaagaaaactaagcaccagcacctgtttcctgacacaggagacagccacgaagctcgaggcaag

SEQ ID NO: 527901 - DNA, 421 bp, Homo sapiens
  misc_feature (7)..(7): n is a, c, g, or t
  misc_feature (41)..(41): n is a, c, g, or t
  misc_feature (352)..(352): n is a, c, g, or t
  misc_feature (391)..(391): n is a, c, g, or t
ggcgggncatggtggctcatgcttgtaatctcagcactttnggaggccaaggcgggcagatcatgaggttagcagttcgagaacagcctggccaatatggtgaaaccctgtctctctaaaaatacaaaaattagccgggcatggtggcgcacacacctgtagtcccagctactcaggaggctgaagcagaagaatcactcgaactgggaggcggaggttgcagtgagctgagattctgccgctgcactccagcctgggcaacagagcgacactccgtctcaaaaaaaaaaaattagccacccgtggcttgaggcagaacttgcttgaacctggggcgccagaggttgcagtnagccgagattcacaccatttgcactccaacctggggttnaggagaggaagattctgttcccaccgcaaa

SEQ ID NO: 527902 - DNA, 235 bp, Homo sapiens
cagaactccgagtaaaggctcgcaggacctcaccccgtgtaagcttgaaacatgtatcaattgaattgtcaacttgattgatgatccatggttgatgtattagctagcttgataatgtgtcacaatataaagacagataggatgacaaattatcagataatgaaagacattctcattacagtgtacttgcatagtctgttggttggttctatacatcatcgattgtatcgttgat

SEQ ID NO: 527903 - DNA, 303 bp, Homo sapiens
tgtgggtagcagcaatccagagcgcttgcgtgatgctgctacacatgtgatacgaagagccagatatcgaacgatcgaacatagcgacgtccctgtgaatgcttggccgccacaagccagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacctgcgttaccg

SEQ ID NO: 527904 - DNA, 679 bp, Homo sapiens
cagcaacggtctgcagccggtcagaactcgtcctctatccccgggaatctgcgagctccccgctttgcctccggatcaggcagctcgaagtttacacccctgtggccgtctgtccaaagccgaaagccttttgcttcagctgccggtgtttccctcctgggtttgtttgttgttggtgttttgcacgggggttggggatggggtgcggtttgtatggattagtggggagatggtgcggaggctggatttgagtttatatagactttttgcatgttgtattatcgtttattattgtaattttttttaagatctgggaaaaagcgatgcaaccagggaaaaaaaaattgacaacaaaacaatttttagttggttaatggtgtttacctggtgatggtgtttggccagcctggaatcagtgtcgccatcgacgtgggagcagggctatctccgggaccctatttccaatacctatagaggcgtcccgttttctcacaaaaaaaactattacgtttctcccccatttcgtgtgcaagtggacagcatgggagggggagcgacggaagggggacaggggttaggaaaactgcacgcaaaggcccgggagccccgatagtccccagaaaacaccaagaagaaacccgccactaaaacgcatagaaggagcacacgcaaggagcgc

SEQ ID NO: 527905 - DNA, 1522 bp, Homo sapiens
gagattcaaagggtttcttcactgtgtgacttctcagagccttctgtgacaattacataataactctccaaaaggaagagtccatatgtggtgattccaaagcatatttgatctttttttgttcgtccatggagctcccatggctggagtggtggagcaaactctgggaaaagtgagattaatgcagagctgtgagaagacagaagcagtggaatgacaccacaacatctgtgcattgagaagggcactctgctgcggcatggcagtcaaggctcaatggaataatctggagaagcttttctacaatgtctacactccagggcccacacctgccaatgaaatctgtaccttaaacctgaagaggaccaggtatcaatattctttgaaaagcagcccagatgatgcagctagtagtgtgataacagccagcgagtcaatgagcactcagaactgtcatatgcgagagagtatctcatcagacgacacattcagatctcagatcactactctcagatgcagagacatatctgtgacatgcgtatgagatgctgcactgctgactcatctgagactatacgtagctagctttttgtatgcctggctcatcagctcacctctggctcacgtccttcactcagctcaagatctggactcagacacctgcaccatgtctagctatttgatggttggtaagatggaagttcacatgtggccagctggtcctggtctaaactcctgaactcgagtgattctcagcctcagctccaagtgctgagatgacaaggtgtgaagccactgtgtctggtctgagtgcatattaatgtctctgagaaacctgtgccaagaaactattacctcggcttaatccagtaattttccaggaaagctgctttttatttcatagcacctacaccctgtggacctccagaatggtgattcacgatgagaggaagagtactgagccctgtcaaggcagcattgggtgaggagcctctcaattacatgttaggaagtgaagtcacccagacctcggattccaattttgatgcttcagttttaaaatggtgggggtgaggggctgatggagaagagtctttatggacacaaatggaccagggtgctttgaccttttgttctgtggtctcctcacttattaggtcacataaccttcagtgggctacataaacctctttctcatctttagcagaacaaatctgtggtctgggcttagggccagttggactgggcttggtcattgattcgcgctggtctttgaaatgtgagtggagggacagacaggtgttgagtccaagcagaagccttcgatgctcttgtgtggcttggctctgcctctgtgcttctccctcctccttgagaacaatatgccccacatgggagctgctcctttagccaggcctccaggaccagaggacaaatggggctgagcacaaccaagcccagctgagccaggtcagggttcaatgtagcctgaacatgaaataaatgtttataattttaaacc

SEQ ID NO: 527906 - DNA, 181 bp, Homo sapiens
tgcgtccccgggaaactccagtgtattgggcaaagatactacccagagtaaaccagtctcttcaccattgcccactaaaccatgggagggccaagcagaaggtgacaggggtgaatgcaaagggggagatgaagaagagaatgatgagccacccaaagtagtagtggccgaagctagatca

SEQ ID NO: 527907 - DNA, 102 bp, Homo sapiens
tcccttgtgaactttaatcatggtccggattgagaactatccttttcaggaaataccttgttaagtgtaatttcctgaggctgcatatccacagggccaact

SEQ ID NO: 527908 - DNA, 652 bp, Homo sapiens
tgtaagcacaccctttagttaaagggcccttcggataacagatatgcatgcacgaagcaaatatttcactgtagtcccgccttttgattatgacaataatagcggcaaactgatatgtgtttgctataatgtgctgctcaatgatggatccattaagtggtgaaaactctgattgcaaagcagcacacagagaaagcattatgacaacaaaacctatctttgtaactatcaggaagtgggagttttactacttgaagaaaaatgaaagcttcctggggaactgtattttagaagagttctctaggatgtgaatcctgaacatgtttcatggcccatggagtggtgagtgtagacaagtatgagtggagggatggcggctcctctgcccagaaatattcttctactgacaagtcacagtccaaggcctcagaacctcccgatcaaagtgcaaataaatactgtggggatatttatctacctctgggaccctaacatgcctttaatagataactacttgaaatcatggaaaccaaaatgcagattcattaaggaatttaacacaagactatcaagagtcagttttgttttgggaacagttgatggtgttaatggaagggtgccaaagagggtagaatgtcaatgtgactgggtg

SEQ ID NO: 527909 - DNA, 208 bp, Homo sapiens
tccatgatcagtacagtcttgccaagcgcatcacccgttccctcccaggttcaaggaatacccctgcctcggctccctagtagctgggaccacaggcacccgctatcatgcctggctaatttttgtatttttgtagagacagggtttcaccatgttggccaggctggtcttgaacgctggagctattgatctagtcgaatgacccgtg

SEQ ID NO: 527910 - DNA, 434 bp, Homo sapiens
tggatgcgttctagaggatcccttcatgtgtgagaacgtgtggttcttcctccctaattctccagggaaaggatgctactaaaatttccgactacttttctttctttaaacttccttgagattcttttatttttgtttgagagagagtctcactccatcgcccaggctggagtgcagtggcgcgatctcgctcgctgcaatctcctcttcccgcgttcaaaagattctcttgctttagccttccgagtagctaggactacaggcgcccaccactatgcccggctaatttgttatatttttagtggagacagggtttcaccatgttggccaggctggtctcaaattcctgacctcaaatgatccgcctgcctctgcctcccaaagtgctgggattacaggcatgagtcaccacgcctagcctagatgtcctgaaa

SEQ ID NO: 527911 - DNA, 513 bp, Homo sapiens
gtaagctcggtaccttacaggctgatgctgtaataatacccaaaaatgcagaagtcttcggaactgggtaacaggcagaagttggagggctcagaagaagacagcaagatgtgggaaagtgtggaatttgctagacgacttgttcaagtggctttgaccacaaatgctgactagtgatatgagacaataacagtccagagctgagtgtggtctcagtatgtagacaagagaacttgctggggaactcagagtaaaggtcactctatacttcgcaacagagactggcagcattttgcccctgccctggagatctctggaactttgaacttcaaaagagatgatttagggtatctggcagaagaagcttctttttttttttttttttggaaagggattctggctcggccgccgggataaagtgcagtgtaacaatctgggctcagggcaacctccacttcgggggtccaaaaaagtctccggcatcagccggtccaggggggatcctcaaaagtc

SEQ ID NO: 527912 - DNA, 687 bp, Homo sapiens
  misc_feature (635)..(635): n is a, c, g, or t
atagcattacgagacatacctagtgtaaatgacgagttaatgggtgtagcacaccaacatggcacatgtatacatatgtaacaaacctgcaggttgtgcacatgtaccctagaacttaaagtataattaacaaaaaattaaaaaaataaataaatgcaagcggaatattgtcaaaaaaaagaaaaaaaagaaaaaaactggataaattaggcttcatcagaaacttaaaatttctcagctaacaaactgagagaaaaatatgtgaaaaatatgtgtttgatacaagactgttgtcacaagatatgtaaagaactacaaactggtaataaaaagtagcccctttggcttgaaaaaaaaaaaaaaaatgggcaaggaattgaagagacacttctcaaaagtagaatcattaaatgggcaatcaatacatttaaaaggtgctcaaccctatttagtcattagaggaattcacacttaaactggttttaggaaataatcacttgaatggcttaaaagtaaaaatgccattggccaaatgttgttaaacttgggagcaacttgaacttttatacacatgtgggtggaagggtttaaaatggtccaacttgtttggaaaaaaaaggtgtttcttttacaanacacaagtgctctttttgacccacacatttaatttcatggcctttatacttg

SEQ ID NO: 527913 - DNA, 768 bp, Homo sapiens
tttactctaagcatctacaacaaatcatttctgcaatcagtttgtgacgttcaatgaaatgtggattttatacgacaactggtgatcgaccagctcagtggctagaccaagtaagctcctaaaacacttcccaaagccaaacttggaccacaaaagaaggtcatgttcgcatgtttcggtggtctgactgctggtctgatccactattgctttctgactcccggcgaaaccattacatctgagaagtatgctcagcaattcaaagagatgaaccgaaaatcttcaacccctgcagtcagcaatggtcaacagaaagggcccaattctccacgacaatgcatgatcgcacattacacaactaaagcttcaaaagttgaactaactgggctacgaagttttgcctcatccaccatattcacctgacctcccgccaaccgactaccacttcttcaatcatctcgacaactttttgcaaggaaaacacttccacaaccatgtagaatgcaataaagtgctttccaagagttcactgaatcctgaagcacggatttcttatgctacaggaataaacaaacttatttttacacttggtaaaaatgtgttgattgtaatggttcctattttgattaatgaagatgtgtgttgagcctagttataactgatttaaaattcacgatcccaaaccggcaattacttttgcatcagcctcaatatgaggaagtaatagttgaacagaataattctttcttaccaccttggcatttgcct

SEQ ID NO: 527914 - DNA, 499 bp, Homo sapiens
  misc_feature (394)..(394): n is a, c, g, or t
  misc_feature (417)..(417): n is a, c, g, or t
  misc_feature (482)..(482): n is a, c, g, or t
tgaggatcctacaggaaacaaagccctgtggagccgtggcttgctcaatggggcctcccagaaggtaagattgcagaatgggccccagggagaacactgcttagcacttttcctgttgccctcactgaagaaattgcctttggtgaattattcatagtgcacacgactgtgctgagtgctgtccgtccacagtcctttcttaccaatctgcaaaaaatctccttggagagtagcgagttccttagagagagtccattcccagtcctctgctctgaggtgtgtcctgggctttactttctcctgtaggcatgtgctgctttaatagagcatctctggactttcgggcaaatctattttagaagacaagcctagtgattgctgttttctataaatnttgctttgtgttttccctttttnatggcaagcttgataaatttaaccaaaatgattcttatcctaagaaatgatgaacaataactttngccattttttatgaagg

SEQ ID NO: 527915 - DNA, 1594 bp, Homo sapiens
  misc_feature (283)..(283): n is a, c, g, or t
  misc_feature (333)..(333): n is a, c, g, or t
  misc_feature (973)..(973): n is a, c, g, or t
taaaaaatgtttattttttcaaagaaaacggcaatagccaattgggaaaccttacttatcctttcaacctccaattttgggttttcttttaaattttagaagtgtgactttacgtgattttactatttttaaacaaacccccccttttccccttttaaagtgtttaccattcttacctcggtggcgtgaatctccttctccagagaggaaattgtggcctccagcgcgtttatattcttccgaggtgtccctcgcgctttgtggcctccttttatacacaaanaaaagcgccaaaaaccacaattctcacactcggtggcattcttatagagnggcgcctccaatctcgtgctcaaaaaaaaacaaaaaacaaaacagaaaaaaaaacaaaaaaaagagagagaggcggcgcgcgcgcgcgctctatagagagatatatctctctccgcgaagagagagagcgcacccacacgagatattatgcgccgcgcgtatcatccccacgagcgtctattcgtgtcgtgtgccacaccagagaaggcgggccaccacatatatagtgagagagcgcgcgcgctatatatatatagtagagcgagcagagagcacgcaggtggcgcgcgcgcgacgagtttttacaaaaagagagcgagtgcgagaagagcgcggtggagacaaacaccgcgctctgctaccaacgccgcgaggggagcagcaactctattgagtggcgagaagagcagagagaccatctaatataacatctcgcaggggggggggggggggagagcaccacatatcatattgtgggaggagacgacacaacatctctctcccatcactaaaaaagagaagattatattaatacaaaaacgcgtctctataacagcaggggcgcacaacaacatcctcattatcacaacaccttttctctcaccgagaaggccgtgatataatcatcaacagccggtgntggtgctgtatcaacgcaccaactaacgaagcggcacggaacaatatataatagatgccgcagcagcgcacgaagcgcttacgagaaagacaacaaaaacacttgggcgcacaccccaccaagccgaagcgacatatatcatgcatattttctacagtccgaaacaacaacctatcttttatctaaccccccgcgggggctcgcctttcgctttttttattatatatattataccgaccatcaactgcaaacttatctcacaaacaccagcaactcctaatcgtaccaacacgaaccctagaaaccagaccacccaaccaagacgatcacacactaaaggaagaagagcagcgagcgcgaacgcaaggaaggacgaatcaacagatgaacagtaagatcaaaaactcataatgcacaagagacggcagagaccagcacttgagagaagacgacgggaacggaatgatcaacactagacctaacgccagcacgacgcgaacacaagatcaacctactgagacagctcaaccatcagaaaaaacatgataagatacacagaatactgagtcgagaccgacagtgagcctcaggagaacgataatcaggaagagcagagccgaa

SEQ ID NO: 527916 - DNA, 157 bp, Homo sapiens
cttttacttgctccattttaccttgatctcctttccacattacgtacagttgaaaaggagatgtatgaaaatgtttattatgatttcagaaaaatatggaggacactttgtaagatgaggaaatgaagaaggcgttgaggaagtataaagcgttgag

SEQ ID NO: 527917 - DNA, 360 bp, Homo sapiens
tttttttttttcccccccccccggaaaaaagggaagccccggggaaggccccccttaatttttttctttaaaaaattttggggtgggttttcccccaaaggggggggtccccaaaagggccccccctgccccccccgggggggggcgggggggggcccatttttggcccctgccccctccccccggggggggctttttcccgttttttttcccttgggggggccccaaaagggccccccccttgaaaaaaaagggaaaatttttaaaatttttttgttaaacccccctttccccgggggggggtttttttttttttttcttttttgggggcccaaaaaaacccctttttttttcggggga

SEQ ID NO: 527918 - DNA, 246 bp, Homo sapiens
gggcgtgttcgcaccaaaaacgtgaagaaggcgggccgggtcatcatacgataaacgtactacacgcgcctgggcgatgacattccacactggaacaagtcgcgtgtgcaaggatgatcgcacattatccccagtgaaaaagctccgttaacaaagtgtatcagggttatgtcactacattcttatgaagctgaattcagaagaggcctcagtatcaggtatctccatgcatgctgccaggagtgc

SEQ ID NO: 527919 - DNA, 203 bp, Homo sapiens
ctcttgcacgagcagtcagacctattccacgtggttaagtgcttctactaccattaaagcgaggcactgaagctagagcttattagtcctctgtctctccagaggaccaagaaatacctattgacacaggccacttcagatgtgtacagcaaattctatagtgcttcttagcccagcaggtctttaccttccccttgagagtt

SEQ ID NO: 527920 - DNA, 1239 bp, Homo sapiens
  misc_feature (1208)..(1208): n is a, c, g, or t
  misc_feature (1215)..(1215): n is a, c, g, or t
  misc_feature (1219)..(1219): n is a, c, g, or t
  misc_feature (1230)..(1230): n is a, c, g, or t
attcggcactggagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctcttcttccccacagccgggctggcagacatgacggcagagctacagaagaagctggagagaagaggcgggcactggagcactgattcggacaccccagggaccagcgggctagtcccagggcatggccaacggccagattcttnttcccangatnaaaactctgancccaggaaa

SEQ ID NO: 527921 - DNA, 292 bp, Homo sapiens
gatcattcacctccttttgtggtatgtggtggtcatggcacacaaaagacacgcacataaatctgaaaaaggaaaatgaaaaaagaaacggtttagggattgaaatatgagtaaaggctggacaaatggcttagtggttaaaaaaaacttgctgcttttctgtaggatccaagtttggttcctagcattcacagtgaatgactgacaataacttgaaatttcagctctggggggggaatctcatgtcatcttctgccctgtgtgcatatgttcacatattagtagcattcat

SEQ ID NO: 527922 - DNA, 1378 bp, Homo sapiens
  misc_feature (1347)..(1347): n is a, c, g, or t
  misc_feature (1354)..(1354): n is a, c, g, or t
  misc_feature (1358)..(1358): n is a, c, g, or t
  misc_feature (1369)..(1369): n is a, c, g, or t
attcggcactggagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagcccagtagagacggggtttcaccatgttgccaggctggtctcgaactcctgagctcaagtgatccacccacttcagcctcccaaagtgctgggattaccggcgtgagccaccaaacctggcctcaatctgtcgtctcttgcagagcccaaagtctttaatggtggcttgggcaggaagctgccagtcagttcagcccagcctcttcttccccacagccgggctggcagacatgacggcagagctacagaagaagctggagagaagaggcgggcactggagcactgattcggacaccccagggaccagcgggctagtcccagggcatggccaacggccagattcttnttcccangatnaaaactctgancccaggaaa

SEQ ID NO: 527923 - DNA, 1170 bp, Homo sapiens
  misc_feature (1139)..(1139): n is a, c, g, or t
  misc_feature (1146)..(1146): n is a, c, g, or t
  misc_feature (1150)..(1150): n is a, c, g, or t
  misc_feature (1161)..(1161): n is a, c, g, or t
attcggcactggagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccccacagccgggctggcagacatgacggcagagctacagaagaagctggagagaagaggcgggcactggagcactgattcggacaccccagggaccagcgggctagtcccagggcatggccaacggccagattcttnttcccangatnaaaactctgancccaggaaa

SEQ ID NO: 527924 - DNA, 463 bp, Homo sapiens
aactagaggatccccttataatcccacgatcacagctcactgcagccttgagtctcctggactcaaatgatcctcccacctcagcctcctgagtagctgggcctattggcacaggccaacatgcctggctaatttttaaatttagtttttgtagacaggaggtcttactatgttaccctggctggtctggaactcctaggctcacgcgatcctcccaccttggactcccaaagtgccgggattacaagtgtgagccaccaatgcctgaacctttgcacatttataaattgagtagtaaaatatgacatcttttgagttgttcaccagacatccacatggagatgtcacaggaagcaagccttgggttctgaggagaggctgggaatggagttttaccctttggaagttgtcagcaggcagcgctacaaagttccgagtctgagtgaaatctcccagggagtgg

SEQ ID NO: 527925 - DNA, 479 bp, Homo sapiens
cttattggctggacgaacgactgcatcttgcacgatttacttataagactactcatggccgttgattcatatatttacacactgttttcacactgtgtaacgcagtttgttgaattaaacaagcaacgccagggctccggctcaacttttgaatactgattaccggccatcactatccacacaggaaaccctgcgagagatatgtcaggcattgctccctccgggactctgcgcacggctacagacgaaggactacactgatatgtactgacatccacagacaattcagtgtataaagacagcatgaaaccctgggagtagtgaaactatatctactgggccctaaataatgccactgacaccgccaaaaggtagatgtagcacaaccgctataaatcttgccagattgattataaacatgtgcatactaatgcgtgcttaggaatgtctgtctaatcagactggtaaagtaaaccttt

SEQ ID NO: 527926 - DNA, 1441 bp, Homo sapiens
  misc_feature (1410)..(1410): n is a, c, g, or t
  misc_feature (1417)..(1417): n is a, c, g, or t
  misc_feature (1421)..(1421): n is a, c, g, or t
  misc_feature (1432)..(1432): n is a, c, g, or t
tcacgaaactctccttagactgttcctcagcttcccgtgcccagctggtggcgatccactgtaaggagagtgcctggcgggagatcctggctccgtcatggcctctgccctgagtgccaccccgatggcccaagccgtatgggtgtcctgccttcacactactatgagagccttgctagggtaacgaatggggcgccatgttgaccgcgtattacagagtaagttctcgggctaggctctgctagtggtcatctacctagtgtagttgtctacgatattatgctactcatgcgtactatcctatgctactgtgggatgaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctcttcttccccacagccgggctggcagacatgacggcagagctacagaagaagctggagagaagaggcgggcactggagcactgattcggacaccccagggaccagcgggctagtcccagggcatggccaacggccagattcttnttcccangatnaaaactctgancccaggaaa

SEQ ID NO: 527927 - DNA, 630 bp, Homo sapiens
  misc_feature (599)..(599): n is a, c, g, or t
  misc_feature (606)..(606): n is a, c, g, or t
  misc_feature (610)..(610): n is a, c, g, or t
  misc_feature (621)..(621): n is a, c, g, or t
gcgcccggcccagacacagacttatacatgggcacacacacagacacacagggacacatgcctatctccaggcatgcacacagacccccccgccaacctgcaaggtgtccctgtatgacatgggtcttgacagtgaccacgtttccccatcaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctcttcttccccacagccgggctggcagacatgacggcagagctacagaagaagctggagagaagaggcgggcactggagcactgattcggacaccccagggaccagcgggctagtcccagggcatggccaacggccagattcttnttcccangatnaaaactctgancccaggaaa

SEQ ID NO: 527928 - DNA, 422 bp, Homo sapiens
  misc_feature (254)..(254): n is a, c, g, or t
tgatgttggagtgggccctggtgggaggtgttcgggtcgtgggagcagatccctcatgaatggcttgggccatcctcttggtgatgagggaacactcactctgagtgttcacaagatctggtggtttaaacgtgtgtggcacctctccccacccccactctttcttgttcctgcttttgccatgggactcgcatgatccctttgccttctgccaggactaaaagctccctggagcctcctcagaagctgagcantgttggcgccatgcttctggtacagcctgcagaaccatgagccaattcaacctcctttctttataaattacccagcctcaggtatttctttatggcaatacaagaacagcctaatacaccaggggtttgcaggtaacccgggcccctgtccttgaggacacagcagca

SEQ ID NO: 527929 - DNA, 119 bp, Homo sapiens
caacaggtcaaaaagagcctttattacatatgatgaatgacacttatgctttcttgccagaagcctttggagcaggtgctttgtgggctgaagctttttgacccttctgtcgtcttctc

SEQ ID NO: 527930 - DNA, 105 bp, Homo sapiens
ggtaattggtattgtgcagcagttgctatctgaggctgagtctgcattcctgcttgtggtgaacgtctgggagtttgacggctgcctacacggggaagttgcact

SEQ ID NO: 527931 - DNA, 180 bp, Homo sapiens
agaggaccccgcttgggctttcgagttgctataatgaacagcgatagtcttataccttgcttaggcatagtaaggaggatatgcggtgtgtgcgatatactagtattcctagaagtgagatggtagatgctagtataatattgatgttaatgaagggcaactcgaaagccccaagcgggt

SEQ ID NO: 527932 - DNA, 248 bp, Homo sapiens
ggataagatgagttgtaatcgagctacacgacggccaggtgcggatgggtcattcctgtaatcccagcacttacgggaggccgaggcgagcggatcacgagctcacggagatgaagactgtcctggctaacgtggtgaacacctgtctctactaaaatacaaaaaacaaaattagctgggcatggtggcgggcaccctgtagtcccaggtaactccggaggctgaggcaggagaatggtgtgaaccca

SEQ ID NO: 527933 - DNA, 484 bp, Homo sapiens
gttgccaactcgaaaagactgagctgtttccacgcaggatgcccccgcccgccttgctgggggcgctttcccggttgttggccccggccaggctcccaatcggcctttaatcgcaatcaaagttctacgtccagagagccgccgaatgccaaacctgactgtctgaaagttgttttcaccttagcaccactgtgtttttgtgggtttctatcatataacacaacacagggaaaattttttagggcccaaaagaagaaagggcctgaaataaattttaaaaccacataatggatcctctccttatagatatagaagttgcctctgagaaaccacaatgtgtggagttggaacggcgaaaaaaaatgttttttgcaaatatatataaccccagatttggtttttggcctctttacttacaaaaaacaccataaagagaggaaaaaaaaaattggggcccgcttggcccaaaccgttttaaacttgg

SEQ ID NO: 527934 - DNA, 347 bp, Homo sapiens
ttttagaacttttcgggggggggtggtaacccagtaataagaacggtatttaaacccagggttccccttttcaatgggacccggggaagatatgaagttaccctccaaaaaagcagaaaccttgactggcgggcctacatgtaaattcctggccggtaaggcaaagcaatggggcccggacagaaatcgccttttgttatggatcagaggggtcccaggggttatttggggggggttggtatcatccccaatttcctttgggattattaacccccccccctcccaaggttcttggccgtagccagggggctcccccctatttccccttttatactaatatttttata

SEQ ID NO: 527935 - DNA, 123 bp, Homo sapiens
accccgctatggtggcgaacacccgtgtacggtgatcccaaccccaacaccaccggtaacagaccccaacatcgacacccatcaccaccaccactatggtgagcccaaacccaacacccaccc

SEQ ID NO: 527936 - DNA, 452 bp, Homo sapiens
cacgaggggttcgataccgtgatggcgccctgcaacggctgctatcacaacctgaagaaagccgaatacgagctggccacctccgaggaagccctcaagaccgtgcaggatctggcgcggcaggccgacgatccggtgtacaagggggacgtgcgtaccctccacttgctggaatggctcatggaggagctgggcccggagggcatcaaggcgcgcctcaagaagagcctgaacggcatcagggtggccaactactacggctgcatgtacacgcgcccgcggcagatctttccggagaaggaccgggggccgggctccgagtccacccataagccccacttcatggacgatctgctggcggcggccggagcggtgaacgtggacttccctctgaagaccgcctgttgcggcggcgcccataccctgtccggaaacccgggccccgggggggg

SEQ ID NO: 527937 - DNA, 402 bp, Homo sapiens
tgattagaggatccggtatagagtggcatgtgatctgtcgaaacgaaggtaaaggccatgaacagatggccaagtgctttcgctcgtaagcaatgtgagagtggtgaaggcgtggaggaatggaggattgctctagtgcatagagcccagtgggggcccagtgggagaggctggaaaaaggagagacctagaatccagtgggagaggctgaaagaatggaaaccagttgggataccattgctctaattgagcttgggaaacaacttcgcataggaggtgggcgacaatgcagaaacaagggcataagagagattttgaaagaaggcatgtgagataagaaatcattgtggaaaacagtgtgacaattcttcaaagaactaaaaagtgaactaccactcaata

SEQ ID NO: 527938 - DNA, 462 bp, Homo sapiens
gaaagccatcgcagaccacatcagagacatctggtttggaaccccagagggagagttcgtgtcgatgggtgttatctctgatggcaactcctatggtgtccctgatgacctgctctactcattccctgtcgtgatcaagaataagacctggaagtttgttgaaggcctccccattaatgacttctcccgtgaaaagatggacctgacagcaaaggagctgaccgaggaaaaggagaccgcttttgagtttctctcctctgcgtgactagacactcgttttgacatcagcagtacaccgaaggctgaggaatcaaaatgtcgtctttgagcctagtaccaaacagtaataatgctacattcaaattgtgaacagcaaaatattttaaatagtgtgtgctttatgatttgtgaaagtctatcatgttgttagtgctgcaatctaaataaaagtatattcaagtg

SEQ ID NO: 527939 - DNA, 328 bp, Homo sapiens
caatactaaattataactttaaatactacatacacacatttacacacactctcacacgctacttcttacatgaattgtgcttggggagactccatttgttgaatgccacttaaggcatattttgctaagctgctgctccatgtatttttgtttggaacatctatcacagtaaggcacagctgtttattggatgagcagaaaagaaagcatatgcttgtggcaaccagaatgttttacggtctttcacgcttgtatcaaatggacctgcagaaacgtttaagtgttctcaggtatcttagttggagctgaaatgtgacatctaaccatt

SEQ ID NO: 527940 - DNA, 172 bp, Homo sapiens
caatcttgtgaaaataggcagcatctataccaatgggagataccatgtgatccgaaagttcaggctggggacacttttcaacagtatggttatccatgggatatacaggggcaagcaatttgtggcaatgacagtagttaaaagtgctgaacattacactgcaccagcacta

SEQ ID NO: 527941 - DNA, 309 bp, Homo sapiens
ttttccccaaaattaagtttgggcccccccttagttttgtgttccgggcgggcaagggtggggggcccccttctttggcggggtttgggcccctggccggggggttcccctttaagttggaaagggggggggggccccctggggcaattaaggggttgggcttttccttacccccctttcccggggccctgggggttctttaccgggcccttttttcccccccggggctttttgctgggggcccttttcccccctttcggtttgttttttcccccggccccgatttaaaagggggggtttgggctttta

SEQ ID NO: 527942 - DNA, 253 bp, Homo sapiens
aagcgagtcccctactggaggtatgtggggaccagaagatctgtaccctgactgaaggcaattcaatcaccaagtttcatatgacactgagtgggctaaccagaagatttttttttttttttttttttggagacagagtcttgctctgtcgcccaggctggagtgcagtggtgcgatctcggctcactgcacgctccacgtcctgggttcacgccattctcctgcctcagcctcccgagtagctggaactaca

SEQ ID NO: 527943 - DNA, 952 bp, Homo sapiens
gctcctgcctggcctagcctgactctcattgtgggaagttatgtgggttatactttctcctcctccaagcttgagcggaggccacgactcattgccacgtcgacccagactggcccgggcactgtagtgacaacagacgctaggagtccccccaggagctgtccttccgtccgaggggatgtcctactggtgtcctgcagagagagggcgctggtggactggacggctggtgcctctgctccctacacggtcagcagggcattgtgcgccagcaagcagggtgaagctcttgcctgctgtgccaggacccaagtcgcagctctctctccatgcgtccccagtccagactggctcaccatagtccagacccagatcactaggcaatgaggaccaggaggtgtatgtggtgccgcacccaggctcggcacctgtacaaagctcagggagctccaggctggaacttgtccaagcttctcctgagactcatcgtacaaaatccccagagctagtgggaaccagcttggatgatcccagagattgcccttgggacgggtcctaacgaattggttggcccagaaaacagggacacatacagagattaggcacaatacacaaggcgtgacccataatagaacttggcacttgagctaacatatatatagcaaacgatgatggaacatatgggatatgacacaagaaagcacacactagggcagacaggaatcgatggaaaccacaaaatgaaagagcagacccacatagaaaaaccaaaaaaacaaaagagacaaaaaactagagaaaacaagaaacacgggaacagtggaaaaaggacgaccagagaaaacaagagaaaaaacaaaaaaaaacacgcgagacacacaaaacgcgaagaaaaagcaaacaagagaaacgacaaaaaggagacaacacaaagcagaaaaggaaggagaac

SEQ ID NO: 527944 - DNA, 226 bp, Homo sapiens
acaaataattcaagcactgctctattacaaattttactggcgtctctattcttagcccgtcctacaagccttcagagtacttcgagtctcccttcaccatttccgacggcatctactgctcaacattttttgtaaccacaggcttccacggacttcacgtcgtttttggcctctgacctttccttcatctgttatacctttcgtggtaccgagctctccttcgtag

SEQ ID NO: 527945 - DNA, 278 bp, Homo sapiens
  misc_feature (6)..(6): n is a, c, g, or t
atgganccccgaaggcgtgggctgggtccaggccagatcagacagccccagcccggctacaagccgactcccagggactcaggcttcaggcccaccccagttctcttgaagatccagactccaggtgcatctccatggacccagttgctaggaccacctcagtggatgctgatgccagaccagcaccagccccactggacccagggtccaggcctacacctatagattcagttttcaggcctgcccccatggacccacacaccaggcctgtccacaca

SEQ ID NO: 527946 - DNA, 199 bp, Homo sapiens
cgaatcgacggtttctccgtgttttacaggctggtcttggatcctgatctcagtgatctgcccgcttggctgcacagtgctgggattacagtcgtgagccaccacagctggctgggaaagtccattctttttttttttttaaacaattttcccctttaaaaattggaagaattaaagttaattttggtgaaaagggcaa

SEQ ID NO: 527947 - DNA, 158 bp, Homo sapiens
tgagtggagagagaatgcgatagagagagagagagagacagaaaaggggggaggagagagagaggggggaagagagagcagcatagtagatgcgagaggtggagtggggaagtagagtaaagggagaggtgtgaggagagttgtggacgcgacgagcg

SEQ ID NO: 527948 - DNA, 254 bp, Homo sapiens
gagttcccgttgtggcgcagtggaaatgaatctgactaggaactgtgaggttgcgggttcgatccctggcctcactcagtgggttggggatctggcattgctgtgagctgtggtgtaggccgcagatgtggcttggatttggtgttgctgtggctgtggcgtaggccggcagctacagctccgattcgacccctagcctgggatgttcaatgccgcgggtgtggccctaaaaagccaaaaaaataaaaaataaa

SEQ ID NO: 527949 - DNA, 162 bp, Homo sapiens
gaagcattggtgctcagtgttatagatatggatgtttgctagggatggcgctaatgaacccaaccaatttgcgacttgagaccactcgaaccccacagtgccactgggggaagccagcccgggtgccgagagagcccacaaaatgaaactccgggggaataa

SEQ ID NO: 527950 - DNA, 165 bp, Homo sapiens
tatattctgtatagggagtgagggatcacaggaatgaagggatgcacaggaatggcaggatgaaggattgttccttttgtagtctgtttattatttgatatttggttcattttcataaacttcaaacactcagctctcaaacatgacctacctaggcctcttctc

SEQ ID NO: 527951 - DNA, 405 bp, Homo sapiens
agcactgttactgagggggaggcctgtcacatgtcactgtccagccctgagttggggtcctctcactaaaggtattagagagtgcttttacagaaaaagtgagtactttccacctggggagagcctaccaatggcagtactcctgaggaaggcacggggagccttgcaggatgtttttctggagggaggagccagagaagatcattttacctgtccaggggccttagccagcagcagaaattccagaggtgaaacctgagatgaggtggattttagagcaggttcaatttcttaagagtgctttaggcagcatagctgctacactgagatgagcaaggcccattccagcgataaccagaaactggttacaatagaccatcccttatcagcatttttttgcttcca

SEQ ID NO: 527952 - DNA, 118 bp, Homo sapiens
agcggagtggagcgctacctgggcgcggcggcccacggctgtggcggcgccaccgtgcgcgacgctctcttccggctaagggccgcgcggccgactgcgagagcccgcgcgagtttcg

SEQ ID NO: 527953 - DNA, 879 bp, Homo sapiens
  misc_feature (1)..(1): n is a, c, g, or t
  misc_feature (14)..(14): n is a, c, g, or t
  misc_feature (18)..(18): n is a, c, g, or t
  misc_feature (32)..(32): n is a, c, g, or t
  misc_feature (77)..(77): n is a, c, g, or t
  misc_feature (495)..(495): n is a, c, g, or t
  misc_feature (557)..(557): n is a, c, g, or t
  misc_feature (691)..(691): n is a, c, g, or t
  misc_feature (834)..(834): n is a, c, g, or t
natctcggattttncttncctgtgttaagaanagaagcttgctattacttcaagttttttggaagaaacacctgggnaaattcatcgcaaaaggatcatcacctaggcacatcgtcgtcaggttatccaaagttaagatgaaggaaagaatcttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatttattttgttatctattgttgttgctcaaactgttcaagctttggccattgggagctctttcacattggctcttgtgtacttttggcatgccctcatccactttgtttggagcacttcctctttctggcaccacaggatgctccaggctncatcttgtgttttcttctctgcattggccctagacttagtcatttctcctaggagccctggntcttttttttttttttttttttttttttgatgaatggccttaaaaccaagatcttggtgaaggggtgtgctcattgctactgtgatgacactgcttctacacattctaaatgaacagaactaggaaatattggntatgtgtactaccacatgtatatacatatccataaattatggttcctatatgcatatatattaaactaaacattagttcactgacattaaaaatgtatgaggttttttggaggtaaaaaaattaaaatcatgcctttatcttnccaatcttctataattgggtttaatttataacaaaaaccaaggta

SEQ ID NO: 527954 - DNA, 791 bp, Homo sapiens
aagataaaaataaatacaacacacccaaattaagcaggatgatagttcgtgtgacaaacagagaatatcattcgtcagagtgcttatgcccgtatagagggggctatgatagtctgcgcagctgtatgtgcaggaatggctaaaatatggtgtgaaggttgggcaatgactaaattatgcttgcagtcatgaatgggtacatggtcctgctgatggatcaccgaaagagtctgtctcgaactaggtgtgggcgatgttgaccaagtatctattgaatggccgaagtgtggcacggtgactgtgtgatgaatactcaatgtggaatagctaatatgagggtcagacagggtgctttcgaatgttatatggatgcaggagtggcagagaagtaatgatgtggcaatgagaagttgtagagtggcctggagagggaacctgaggatgggaggcggttgtctatccctcgagtagtaaaaatgattaccatggatgtaggaattctggaatagcaaggatatgtagaggcagatggtaccatcggaagcagatgcaatgggtgcaagaatgttgcagagttaaatgcgattatcttaatggcatggaagatggacgaatggtttagcaaggaaacagttgctctcaatgaattaaagaacagggtaactccagagatgaatggaggagatgtttagaaagctcatgatgatattacgagagaatccagtcgttgaaagaagccagaaggaagtaaaggagaggtgggaactgtccaaaagtccttgggtagaaag

SEQ ID NO: 527955 - DNA, 668 bp, Homo sapiens
ggttttaattgcatttccctgatgattagtgatggtgaacattttttcatatgttgtggccagtgtatatcttctttggaaatgcctattcatgccctttgcccactttttgatgggataatttggtttttttttccttgctgatttgagttccctgtagattctggatattagtccttacattcattcttaattctattttctgtcttcattcttgttttatggtccttatttgataaaatgctatactgcgctgagcatggtggctcacacctgtaatcccagcactttggggaggctgaagtgggccgatcacctgaggttgggagtttgataccagcctggcaacatggtgaaaccctgtctctaccaaaaaaaaaaaaaaaaaaaaaaaaaatttgggggcggcctgggcccgaaaaaaagttttctcaagaccatttccgtggggggcgcgggcgggccccgtgggttcatgtgacacctgggctcaaagacgttgttcccagaggagaaacctgggccctgagcacaggggctggggttcttcccacccattaaaaaaagacggcgggcgagacaccggagcgctctctgaacaactccgagagggtccggaggccacacgggggtctatcacaagggatcccaggaaccgaataattaca

SEQ ID NO: 527956 - DNA, 84 bp, Homo sapiens
  misc_feature (40)..(40): n is a, c, g, or t
gtgtaatgcgccgaatgcaggcccttgcgggtgtcccagncgctgatccgctccttcagctccaccgcccggaaccgctttcag

SEQ ID NO: 527957 - DNA, 301 bp, Homo sapiens
actgtaactatgtacttatgggataaaaagactgggatgtgattaagttaatcttgagatggagagattatcttgggttatctggataggcccagtataatcacaaggattctttaaaggaggctcagaatcagagacgatctgatgacagaattagaggtcatagtgatgcatggccacaagccaaggaatgtgagcaggctttggaagctgaaaaagacaaggaaatgtgttttcccctagaggctccgaaggaacacatccctgctcatccattttagacttatgacctccagaactg

SEQ ID NO: 527958 - DNA, 395 bp, Homo sapiens
gccgggggcctatggcagtgatgctgtgttggtttcctagggatgctttaacgaattaccccaaacctggtggattgaaacagcagaacttgattcccttacagttttggaggctggaaatttgggatggaggtgttggcagggctgtggtccctttgaaggctttggggaagaatccttccttggctctttttagcttgtggcggcagtgggcagtccgtggcattccccagcttattggtgcatccctccagtttttgttttttttgttttttccttttttaacaacagtcattggatttagggccccccctaatcctgggtggtttttttttgatccttattaattaaacctgcaaatactttagttccaaataaagtcccattttcaggta

SEQ ID NO: 527959 - DNA, 262 bp, Homo sapiens
tatcgccgcatagaaggcatctactaactcatgcacataggaaggcagagtttttttgtttttttgagacagggtctagctctgtctccaggctggaatgcaatggtgcaatcactgctcgctgaagcttcaaactcctgggctcaagcaatcttcctgcctcagccttctgagtagctgggaccacaggcgtgaaccaccacacccagctaatttcttcttaatttttagtaaagacaagatctcactgtgttgcccaagc

SEQ ID NO: 527960 - DNA, 383 bp, Homo sapiens
ggacgggtcgagtcactgcgtcgcgcgaatagaaatcgaagcctcttaaaatggcagatgacttgaacttcgagacaggagatgcaggagcctcagccaccttcccaatgcagtgctcagcattacgatagaatggacttgtggtgctcaaaggccggacatgttagatcgtcgagatgtctacttcgaagactggcaagacaaggacagaccaagggtccatctggttggtattgacatctaataatggggacgacatctgcagatatctgcccgtcaactcatacatatggatgtccccgacatcaaaaaaggaaatgacttccagctgatttggcatcccaggatgggtacctaatcactgctccaggacaagcggggaa

SEQ ID NO: 527961 - DNA, 355 bp, Homo sapiens
  misc_feature (84)..(85): n is a, c, g, or t
  misc_feature (99)..(99): n is a, c, g, or t
  misc_feature (275)..(275): n is a, c, g, or t
  misc_feature (301)..(301): n is a, c, g, or t
  misc_feature (305)..(305): n is a, c, g, or t
atcagccagctccagaatccctttcttaatgccctgaagctggtcaccagttccagcaaccgagagcataaggaaggtatcgannattccagccaccgncacttcagactggccaacgcccacggtctcaacgaggacgacgttgtagccagccgcctccatgacgatcatggactcgcgagtcgcacgggcaacgccaccaaggtggccccccgagggtgagggacgcacaaacgcctcgtcacgattagccagatcgcccatccgggtgcggncaccaagaatcgaaccaccggctcgngtcnaagagggatcgacggcaaaaccgcgaccttgtagccaaactcatcgatga

SEQ ID NO: 527962 - DNA, 102 bp, Homo sapiens
cgtccatagaacgtgtgcttactgttctgaaggaaaactgaacacgtccacttggtgcctcattccctctaagcccattgtatatatacatcctggtgctgt

SEQ ID NO: 527963 - DNA, 150 bp, Homo sapiens
acacacaacacagtctgttgctgagagatacctctggacgccggcagccttaagatggtttcaattggccactccagcacaaaccacccagtctgtggtggggggtaacctctttgggccgaggcaactcacaacggtcttctttgtctc

SEQ ID NO: 527964 - DNA, 278 bp, Homo sapiens
tagactgtgacttatacctaccaacgcactgtaccacggtttacgggacgacaagattgagcacctctgggacacctgccgggaggctttgtgctagaggtaggcctgagccttgacgtagaggtcgaatttcagccaggcgaaggcattctaagcagaagaaaccaggtacgcagacgacgacggtaccggacgggcaggcggttccgcggcagttcagtgaaatacgtggaacggttcggtgtggctggaaccagcggacggaggacggcacttcg

SEQ ID NO: 527965 - DNA, 239 bp, Homo sapiens
ttttttttttgggccccccccccttgggggggggggggggttaaaaaaaattcccgggcgggggggttttttttcccccaaaaaaaaagggggtttggggggggtttttaaaattttttttttggggtttccccccccccctctccccccccggcttggggggggtttttttttgggggggggttttccccaggggtttttttccccccgccaaaataaaatgccctttttttttttta

SEQ ID NO: 527966 - DNA, 178 bp, Homo sapiens
  misc_feature (6)..(6): n is a, c, g, or t
gggtantttcccgaagtgttaactgaaacaggtgacacagagtcaccagttttccgagaaccaaagggaggggtgtgtgatgccatctcacaggcagggtgaaatgtctttatccagctgtcctccttggatgtgccatatgacaagcctcgtttctatagggttgttttgtttgggg

SEQ ID NO: 527967 - DNA, 505 bp, Homo sapiens
attaagacagctatgatgtcactgcagttacagtgtcactaggtgatagaaattgtccagctccattacaaccttatggaaccactggtgcatacgtggttcattgtggtccattattgactgaaacaatgttatgaggtgcgtaactatatatccaaagcaaaagctaaatgaaataaatgaaactaattgtgttggtgtcctaaacacacagaggagaattacttcaagtatttttaaaacacagtcacttgtctatgcatttttagtggatatgccctaaagtatgaaactaaattaaaaataaataaaaaattaaaaataaaattaatttacaaatagtattaatatagaataataatatatgttaatattgttactctgaatctattatatacattttggaggataaataacatgcaattttgttaatattaggaatcaagaaactatatatataaaatcaaagctgctaaataaaattataaattgtgtttataattac

SEQ ID NO: 527968 - DNA, 1793 bp, Homo sapiens
  misc_feature (819)..(819): n is a, c, g, or t
  misc_feature (997)..(997): n is a, c, g, or t
  misc_feature (1388)..(1388): n is a, c, g, or t
ggcacccagttccccgggagatgcatggaaggggatggcggcggcagcgatggaggagggatgtcggacgtggtgcccaatccgctttcggctctcccttcccgtggtccgcgcagcggtggtcccgttctcctgtcccattggctgcggagcagcgcagctatggagtaggcggcagctctgtggagctgctcgagacttgagcctggctggatgctcagtggactgattggagactaggcagactcgtccgagtacgtcattcacccgagtaaacagtacttgcgataggaaagggtacgcgtgggagaacgaacatgtttctgcctagcatggagacggtgctacgcaagacgacaaaggcactgctgtgcaattgggaagggaatagcgcttgtctgagacatgcctacattcgccctctagttaattgcaatgccacgcgcatcgttaactgtgttcacacatgccaagtgggttgcctgagtgtctccccccgagctctctctgcggcgtgaatataggcggcattggcgatgtgcgagtgcacaaacaatcttaaaaggtaagcccgtaggcttactttgaaatatccccttgtaaccccctgtgcaaaaaagtcacaataatgcggtgcattaaaatgcccaaacggaatatcccctacgccgccccaagaaaaaccttttgtgccctgtgggaatgtaattttccaccaccccggttgttccataggtccatattgcgaatggcggggtaaagaccgggttgttgaactccaaacccccacgggggaggctccacgtggtgatacttctnaacacggcggagttacccttccctccgtgtttcggacttgttggggaatgttcgcccgttcctcttttaactggagttcgcgcttttgagggaccccttttttaaccccttatcaaacccccatttgtgtgcggcgcgtttcccggttggttcttgtttttcccacatttggaggcgnttgttgagatttccttaaaccgcgatttgtggtgtgttggtgttaccctaacaaaattggcttgtagtgtgtggaaaactcacccatgtgttggtggtccgccatttttgcgcctcccccagccgttgggaacctattgagggggcgacgtatattcaccgagagttgccgccgattcacgaacaattagcgacagaacttaagccacccccgtaagagggtttggtaccaaatttggtacctctgaatatgaagaacttccgggcgcccatatatgggcggaaaaggagacacgaggccctataaggctcatataaaacacggggctagaggcgagaaaggggccgaacaacaggataaacgacttgccacgccagaagggatttgagcnccccccctgatggtggtgcagcgcgcacacaagcattgttatatctacaagccacagcccaaaggttgtgcgcaatctaaagaagagatgccccctaaaacggttaaaaccatcagagaagcctcctcttttgggtgggtggaccaccaaatagggcttcaatgggaaaagggcccgaagttagtctaaactcaggctcgggagccttccgcccggaggataattttccgacggcggcccctttgtgtggaaaatctatggtttccacaagggctgctccttctagggataccagcacggcaaaacactagcacacaggcacgagaggacgcttttatggtgtactcccgggagaaggccagcagatggggaaacgcagaaccttttgggacacaggatctgtgg

SEQ ID NO: 527969 - DNA, 381 bp, Homo sapiens
cgccagctcgccagcgcgtttcgcgggaatatacgttgcacatatatggcgagactgagagtgagggcagacatttgtcacgctcaacacagcattttcgctgtacaagtgagcttggagggtctatgtgccataattaacattgcgcttgaagacattctggacaccgagactggccttagaaataggtggctttttttttttttttttaattgcaagcatatttcttttaatgacttcacgtcactagtgcctaaatgtagtaaaggctgcttaaggtttgtatgtagttggaatttttggagtccgaaggtatccatttgccgaaattgaggcccaaattgaatttggattcaagtggattcttactttgcgtatttg

SEQ ID NO: 527970 - DNA, 574 bp, Homo sapiens
  misc_feature (254)..(254): n is a, c, g, or t
  misc_feature (286)..(286): n is a, c, g, or t
  misc_feature (334)..(334): n is a, c, g, or t
  misc_feature (336)..(337): n is a, c, g, or t
  misc_feature (342)..(342): n is a, c, g, or t
  misc_feature (346)..(346): n is a, c, g, or t
  misc_feature (449)..(449): n is a, c, g, or t
  misc_feature (480)..(480): n is a, c, g, or t
  misc_feature (550)..(551): n is a, c, g, or t
cagatgaacgacgccagctgaccatggtaccgtacccaatccccggtcgtcttccatatctccatgtgacgtaatcccatctgcacacttctctacggcatggactacgcgcaatccttcagctgcggtggctcaggaaccgaggcgtgccgctgctgctgcagtcacttgaacggcaacgctcctccgcgacctgtgttgtccccgcccccgcgtgggtcgggatggagaaagcgacgagcccggggttgtgnggagcaactccaaacgcagaagagtgtccttnggtcttcgccggcgccaagctcccgggcttcacgcgtaccccaggctncnngaggnatgncatgacgccgcgggctgccctcggatttggggaacgagaggaagaaaggactcaggcttgcgttgcctccaccaaactttgctcgcgagttgcgaaggctcanagcagcaggcaagctgctgcctcgggccccncgggctcgcgccgcccccgccagcccggagagcagtcccgcgccgggccaggtagccgcatgcagccccnngcgcccgagctttgtggcggccc

SEQ ID NO: 527971 - DNA, 151 bp, Homo sapiens
tgcgcgtcttgcctgctctgcgcagctggctgcggcgttgtgcaccggctgggagatcatctgtcgccgattacggcagcaccgattgcacctgagtgcgctgattgccgaattgtcccagtacgacggcttccgctacgtgcagctgtcg

SEQ ID NO: 527972 - DNA, 186 bp, Homo sapiens
aagcgattttctgcctcagcctccctagtagctgggatgcaggcatgtgacaccacgcctagctattctgtatttttagtagaggcggggtttcttcatgctggtcaggctggtctcgaactcccgacctcaggtgatccgcaccatctggatggtttggggaacgtcaatatcgcagtcaacacc

SEQ ID NO: 527973 - DNA, 219 bp, Homo sapiens
aattcgcggccgcgtcgacaaacaccttgttgtcgagcacggactgcatcacggccttcttctcgtcgcgcgtgagcacgcgcttcttggcggtctgctcctcgtcgatgcgcgtctcgatagccgagcgcaattccccgatcttggccttgtctccttccttggtggagaacgggtcgaagcgttgcgacttcaccgccagcgtgttgaagtcgtcgg

SEQ ID NO: 527974 - DNA, 547 bp, Homo sapiens
tcaagcattcaagatctttgcgcgggagcatgtactcggcaattgaaactcatccgtctcgttagtaatcatagacttacacttattggctggtttcagatctcttactgggacatcttgcagaaccgtgaagaacaagctcagtgtctgatttgacaccttatcaaggtaaatcaagacatggttgctgctgacttctgtccggctcacatggttagatctttcaagcattttcactgttggcttcaggggaatgaagccagagaccatcttcacatcaacgatcgccatgttggaggcagagcggctccctgtgtaactgacacttagggagatttggaagctggtgtgggctttgggttcatcacaagtttgaggcagagtctgcactcctaaagcaaaggggaactcttccttttctgggagaatatcgtatttcaaggatgtctggaggtagacacatccttctcctctcactttcatgctgtattccccaggcagctctggcaatgagacctgctgcagtaacaggcggttgttgttgtcc

SEQ ID NO: 527975 - DNA, 240 bp, Homo sapiens
tgctgataaactcgccacaatagctttttcctactgtcagataggatagcataaaccaagatttccaaaggcagcactggttggttcccaggtgccctagagtaggatttttattttattttactttattattttttttttgagatgaggtcttattatgttgcccaggctggtcttgaactcctggtctcatgtcatctgcctgcctctgcctctcgaagtgcaggaaacaagaccggt

SEQ ID NO: 527976 - DNA, 287 bp, Homo sapiens
  misc_feature (28)..(28): n is a, c, g, or t
  misc_feature (49)..(49): n is a, c, g, or t
  misc_feature (257)..(257): n is a, c, g, or t
  misc_feature (274)..(274): n is a, c, g, or t
tgggcaacatttttggcccaagtttggnaacatttggcccaagtttggnattttggcagtagctgtatgggagaaaaagagtaagaggaaatattcccacagccatgaagggtgaaagggcaccttgtctcaggactagggctgcctgggtcagtcccagggtgaggccaagggttttctggccatcttcagggaggggccaccaggttcctcccctcaccccatattccatcaccttcctcctctgctctggggtnggtaaggggaagccctnccggtttcccaca

SEQ ID NO: 527977 - DNA, 1666 bp, Homo sapiens
  misc_feature (1321)..(1321): n is a, c, g, or t
gcaatattgagtgtacattgcagagacggtaacccgtcaagcgtgaaatcgatcgatgggtatacagagttcctagcaggctacgccagaacatgtggcagcttagctgagaagagtgaaggaggaacgccgtgctggagggacttagttctcaggtctgacaccctggtacatggaatcattggagcccagtgtatcagcaagtagaggcacattacgttctggagtcacggctaccgccagggcacaaccatcgagcgagtgcactcggaggcaaagaaagagcaacgagtaaacgagctagcatggtgcgagagagagtcatccgaatctaagaagagacgagtatgatgaagagttagatcgaagatcggtggacctccctgccaccgttcacaaagcctagagtagcagggacgtcggacacctatcgttctgaaatctcgagggacgagatgctaagctgaagagatggactgcatcctaagagtagaaaccataattaagaacatatgggggagacggagaggatgcagcatgacgattgtggcgatcaagggcaggaggccgcatggcaggaggtgttaggcaacgctaggggtacattcgctcggataagcaaggctcgaatagcatgggcacacgaattttcactccgccaaatcacacggctatggacacgagccagacataggacggaaattccgaggttaactacacacggggtgacacacacattggtcaacttttgggcatagagggggtacgaacataactggcagagggcccagagacgcagaaaggtcatggagactcccaagggcatttgcactgaccgaggacacctgtggtggagttccagacaaagaaattgtttcccccttgaaaaccaggaaaaaagtggcacacgcttcatgtttacacgaatgcgagcaccatgagtcttcttgggcccctcggtatagtggcataaggagaagaccctaaatggaagctataccactatgatatcacgaattgaaacgccagcgagaggttcccatgcgggcagaggcgacaacacctggtagcacggccacaaaaaacgtgccttgcatggcagaagggaacggggcgtaaaacaagggaaaccatacatgggatatgtggcgcgccattttacacccttagaagggattatgtgttgcaccgcaaaaagagtggcgatacaggtcaaaacgcacaaagtgggctttaaccacacttgggatcccacgcgtccatgtgcccccaactcaggcgcttacaacgcgggcgtcaacacgacattaatatttctacnaccgaacgtcgtattaataatcacggaaagaggtaaaacggagtgtgttataccagcgaaacgtgaaaaggttccccacattgagacgacgggaaaccgccggttcaccgaggacgcaagcaacggccggaggtactgtttgaaaacgcgacgaaagcgatcactgtagtcagctcgcgaagaagaaccagaatatagcgacacaactccgagatcagtcactacgatacatgaatacgcatacgatcgatcatgacgacaccacctcgcacttatatggtccatgatcttcgacgtgactgtccttacctgactatcgtcacagtcagtgcgcgacgaccagcc

SEQ ID NO: 527978 - DNA, 1126 bp, Homo sapiens
ggaagaacacttgatggatctggtgctacctgagatgcctccttcattatggctgtgataggtgcttcgctggctgtggggggctactaaacgtacccagcaatagcaggagctggcgttggtgtcatcgatggctaactcatgaaccagaacgtcgcgtggacacaggcatggctgtatccagagtggacagaagcccagacgcatttgactgctggcatcaggtcggtcacagtgtccctcaaggctcaagtcaatgattggtgcctgactactgacttgcgtgcaaagttgcctcccttctcgtattgaccttagtaacttgccctgagtaagtccagagaacggtcattggccatggatagtggctaagtgttgatctaggagtcatacaagtaccgaatcagtcacaatgtggcagtccaatgggtcgatgagtggacggactaggccttcaggtgtcatctccgccagagaagagcatcgacccggatggctccttgccaattctttcctcatgaagtgggttgggaaccttttggcaccaatcgtgggacgttcttgggatcctcgagaacaaggaaagcatttttgttatcattgtccttgggcaaggactcttggaagagcccaagttaccttgtgccacagttccttagagaggagccccaggtgtgcctgaggcttagaggcatttgggcgacaagcgcaaggggacaatgtcttggggacaacacaacaaccaatggtacagttggactggtcgtaacccattcagccgtggggggattccccgggacgcctacttggtggcccttccatggacgtcccatctgcacaagagatccaaggcctttccaagcgatgtaaccttggaccccagggtggacctagatcctccctgatggacgcagtggttgcccaaggttttggccggtggccttcgggactaggaaagcggacacaaaagcactttacccttgaggaactatccagggcgttcatgagcattatggcccttccaaggttccattgacgcccaatgttggattttcttggcctgacggcgtgaacatacttccttaaaacctggggacgtattgggaggacagtcagtgggaaaccc

SEQ ID NO: 527979 - DNA, 189 bp, Homo sapiens
  misc_feature (3)..(3): n is a, c, g, or t
atntgaaggaggatgacagcttctcttcagattctagtcaagcctggtctctctgggaagatggctctggagagctccacctataccttctctccagcacagaaagtagatgtgtgtcatcatccaaggaatgtagcttcaggtgatggcaacttctttgagcaaccactactttttcttttctttatc

SEQ ID NO: 527980 - DNA, 669 bp, Homo sapiens
atcgcgagccgccgctgatactgacatttgtagatgtggttgactatttctgtatgtctccatctatgatgagggtcttaaaaaaaaaaaaaaaaaaaaaaaaaaaaaaaaaaaaaaaaaaaaaaaaaaaaaaaaaaaaaaaaagaggggggcgcgccgcgcccaagaaataatactccagccggggggccgcaacaactgacgacgctgccccagatgttttgtggtaacagcagggcgtgcccaccaaagagagagcagcatgctatattaagcacgaacgaacagcggcgcggcgttacacacacacgcgcgtcgcgggcggagacacgcgcgtcccgggcgacgctatgcgggagaagaaggaagacccaattatatgcgtggtgggggggagagcagcacaatctgaggggccgccaccacacccccccccgacgagaatctatatcatacgcccccccaccagggggacacaacacctaccaacaccactcacaccaggtggactcacgacggggctaccaacaaacagccgcgcagcgccaattagctacgcgctgcgatgatacaacaaaattgccgccacaacgaggggtgtatactacgattgatatgaaaacactatttctactcacgcgagggacctctccatcacacataagcggg

SEQ ID NO: 527981 - DNA, 297 bp, Homo sapiens
cacgctctctctgtggcgggcagagaggtcactgggcttggaaccagtgtaagggactgcttggctagaagaacacagcatgactgcgcatgacctgggctgaggagacagctctgcatctcttcccccatgtgcccatcgtggagctctgccctgaggcgccatgctcagatgcaccagctggcctctgtggaagagccaggctcggaaactgaggcttgcggcactgggcccttcacagttcctcctccagagggctggcctgccatttcccacattcctgccccgagagagcgt

SEQ ID NO: 527982 - DNA, 667 bp, Homo sapiens
ccgcgtctctcgcctcgcgtcctccccactgtcctgttcgccctggcgtcctgcccgctcctgggctctcctcctgcactgtcgcccttctctctttcttttttccgtctgttctgtctgtctcttgctgcctgcccccccgcctccgcctctccctgcttcctatgcctcgcttcgtccctcgctcgccccatacgcctctttcgcgtgcgctgtgctcctcctccctcctccggcggcccgcctctccctccctgtccctgcctctccgccccctctcggtgcggcctcctctcccccttcgctctcccgctccccgtcgttgtcggtgccatcgcgccaccttcgctccggtcgcgcccgtccgcacctccgtgccctcctcctcttccttccgcctcccctgcgctccctcggctcctctgtcatgtggctgcagcctgcttcctccagcttgttctagtgatttcgcgcgtgcattacacaagctccacactgcatcatgaacgcgtcttatgtggctccctctccgcgggtgatcagatcctctcggaaccagtttttctctcgcatgttcgcccttatgtcgttatcatcgtcctccacttcctctcagccgggcctgggatgcccacgttggcgttccacctcatcccatcttgtttgg

SEQ ID NO: 527983 - DNA, 413 bp, Homo sapiens
cgctacaaatggtctcacacaggacagggtgcggctctctcagtggacacagtagtgagatacaagtctcactttctaggataagggttggatgaaccctcatacaattacaagactcaagcctattgaccaatggaaaccgaagtacccgtttaatttaattggatgccactacctgaagtctaccagatgattactataccgtttcacacacttaaggctaggacccgaactttttgcttgagaaatacctgttctcccaccccaggaattcactattttccagtttgttccctatttattaaatgactcaagttagccaagtctaaatatttacagtgataacgggcaaacagctcaacatcaccgattagaccaatggcgatcaaaagcacgatgagacaggatattag

SEQ ID NO: 527984 - DNA, 738 bp, Homo sapiens
  misc_feature (13)..(13): n is a, c, g, or t
  misc_feature (15)..(15): n is a, c, g, or t
  misc_feature (350)..(350): n is a, c, g, or t
  misc_feature (352)..(352): n is a, c, g, or t
  misc_feature (362)..(362): n is a, c, g, or t
  misc_feature (364)..(364): n is a, c, g, or t
  misc_feature (368)..(369): n is a, c, g, or t
  misc_feature (377)..(379): n is a, c, g, or t
  misc_feature (385)..(385): n is a, c, g, or t
  misc_feature (387)..(387): n is a, c, g, or t
  misc_feature (395)..(395): n is a, c, g, or t
  misc_feature (399)..(399): n is a, c, g, or t
  misc_feature (401)..(401): n is a, c, g, or t
  misc_feature (405)..(405): n is a, c, g, or t
  misc_feature (410)..(410): n is a, c, g, or t
  misc_feature (420)..(420): n is a, c, g, or t
  misc_feature (424)..(424): n is a, c, g, or t
  misc_feature (431)..(431): n is a, c, g, or t
  misc_feature (435)..(435): n is a, c, g, or t
  misc_feature (437)..(437): n is a, c, g, or t
gacaaagaaagangnagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagngncattccttgngngatnncttatgcnnnattggncntctcaaanctanangttncagtntgagtttaanggtnataaagntccngntactatattaggtttttacataaaaaggttttaaaaaaggggcccggggacccaattttggcatgggggaaattgtttgggaacccaaccgtttctttttcgggggggttttaacaaaaagaaaatgtttgcttttcaggggctggttggttttgcgtgattccttttaaagggggaccttatgtttctttatttgggtatttcccgaaaaaacctttgaaaacccctttgtgttttttgggggaaatcctaagggttaaaacccccagaggggggttctctgggggtgggggaggaaaaa

SEQ ID NO: 527985 - DNA, 460 bp, Homo sapiens
  misc_feature (354)..(354): n is a, c, g, or t
agtttgggctctgtgtacccccacaagtctcatctcaagttgtgatcctaagcgttggaggtggggcctggtaagaggtggctggatcatgggggcagaataatggccaccccaccaaagctttctacagcctaatccctggatcctgttacactacctggcaaaaggctttgtggagatggatgccgacgcgccacgtagcctcccatccctgtccccggcacggatccggggatggagcatgtggtaggcagacttcccccttgctgttcttgtgatagtgagtgagttctcacgagatctggttaaaagtgtgcggcacttcccccttgctctctctctctcctgctccgntatggtaagatgtgtttgcttcccctttgccttcactatgattgtgcgtttcctgaggcctcccagctatgcttcctgtacagcttgcagaactatgagtcaattt

SEQ ID NO: 527986 - DNA, 639 bp, Homo sapiens
  misc_feature (13)..(13): n is a, c, g, or t
  misc_feature (15)..(15): n is a, c, g, or t
  misc_feature (350)..(350): n is a, c, g, or t
  misc_feature (352)..(352): n is a, c, g, or t
  misc_feature (362)..(362): n is a, c, g, or t
  misc_feature (364)..(364): n is a, c, g, or t
  misc_feature (368)..(369): n is a, c, g, or t
  misc_feature (377)..(379): n is a, c, g, or t
  misc_feature (385)..(385): n is a, c, g, or t
  misc_feature (387)..(387): n is a, c, g, or t
  misc_feature (395)..(395): n is a, c, g, or t
  misc_feature (399)..(399): n is a, c, g, or t
  misc_feature (401)..(401): n is a, c, g, or t
  misc_feature (405)..(405): n is a, c, g, or t
  misc_feature (410)..(410): n is a, c, g, or t
  misc_feature (420)..(420): n is a, c, g, or t
  misc_feature (424)..(424): n is a, c, g, or t
  misc_feature (431)..(431): n is a, c, g, or t
  misc_feature (435)..(435): n is a, c, g, or t
  misc_feature (437)..(437): n is a, c, g, or t
gacaaagaaagangnagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagngncattccttgngngatnncttatgcnnnattggncntctcaaanctanangttncagtntgagtttaanggtnataaagntccngntactatattagtgagtgctacatcaaaaagcgtttgtagaaagaatggtgacgaggtagaccaattctgtgtcatggtgaaatcttgattgagtaaccaagcagttgtactattctggtgctgcttcataacataaatgaagggctgcatgcatctatcagctaggcatggagttgtgtatgtcgtatgatatccttaatta

SEQ ID NO: 527987 - DNA, 159 bp, Homo sapiens
gcctcctgttcccagccgctaccctgcatagcggcctccttcccaggctctggggcagcgcaggaggtggagtctggaagggtctgcctgagctgttcacttgggcaggacgtcagaggactcagacaccagcttcccatcacgtgtctcgaacttctt

SEQ ID NO: 527988 - DNA, 994 bp, Homo sapiens
gcggtttttgcgactctggggtcgcctgtctcacttctcggcgttgccggggcgcctcatggtaatcgcgagagggcgcggaggggtggcctgaaagggcggcgtgtccggagggcgactggcgcggagcctgaagaccaaggtgactgattccgattggcaggagagttcatcatggatgcagtgtgtcaagctagggatgcgggccatatccaccacttgtcatgtgctcgcgaactagttatatgcaaataatagcttcaattaatggtcgagaaagcagagccgtggacgccatatgtagcgcatttacaacctttgcattgccatgtgttctcatatacttggtccggggaaagatggtagaagatgcccggacctggcggactcgatgagatcatcttattgtgtccagcaggtgacttataagcccaacgtcggtgagccccgtggaaatggactcccgcgttctgggaactccgggacagcactcgtgcagggtgagcttctcatgctgagagttctgcgcattccaggtctccttccagctatccacacaagtacctgctccactaccgtggtttcccctcgcagaactggctgaatcgcacagctggcagcggacccctgttgccgtcaccgcgtgggccctgctgcgggacagctaccatgggggcgctgtgcctcgcgttcaggccagcacatcgccgtggggtgctctacctggccctgcagggtctacggagttgagtgcccgcgagtcgagtgagaagccgtggtgcaaggtggttaatgacgacctttccaagccatcattgatatatggtctgagctccttcagattttccatggacaagaattcctagtctggccaggctgcaagaaccaggtggcgtgcgggacttgccacgtgcggcggggcccagactgagacgtgttgaagcggaagaagtgcgttcaaacaagggagtgagagccagggtgacagcattgt

SEQ ID NO: 527989 - DNA, 239 bp, Homo sapiens
gccaaggctagtctcaaactcctaggctcaagtgatcctcccacattggcctcctaaaggtgctggagattacaaggggtagccaacacggcttgccttaactttcaacaattgttcttggtcaagaggttcctaaaacaaagcttattatacattgaggaaacttaggtttatcactctcaaggtgcatattgtgattcgcacacattttttttaaagtataaaggtatagggtcttc

SEQ ID NO: 527990 - DNA, 276 bp, Homo sapiens
ttcttgatttgttataaaaaggagagatcctctagatatcatgggtaagagggaaagctaacaatcccacaatgatttcctttctttcttggccatccgaatatatccttcttcaccaaagttggtggcccagctgtttttcacaagccagtattctttcccattaagatcaccatagccaaccattcagcctactcattcaacccaatagccctggccgtacgcctaaccgctaacattactgcatgacacctactcatgcacctaattggaagc

SEQ ID NO: 527991 - DNA, 374 bp, Homo sapiens
catcagcaagggtctccaaaagttcgcacagcaatggatgcacatgccttgcagggcaccccagcaggcttcctttccacgcagcagtccccaccctctgagtccgcccattcaagagctgacgacatatgagcaaactcacttctctccctcccttgtcatcagcacactggggttgataacagaagtgacagctccagcaaaatggtctggcaagttcctaaaaagttaaaaacatcgagtcacccatcaggcactccagcaattcccactcctgggtgttatacacaggcagcacatagcacaatcccagttatgtcccacacaaaacattcatgcaaggatgttccatcagttccagcatcagtcaatca

SEQ ID NO: 527992 - DNA, 344 bp, Homo sapiens
ttgtcgtctctagcaggatcccccatttgagcccctggatgccctagaatgccctgagagaagcacgcttgtggtgtagagcaggagactgaggacacggacttggctgatttagttatgcatgcaatattctaagatgacgccagatttaagaggttgtatgtgctcttttcaattggaaaagacctttgaaatttttttttcttttcttttaggaggccatatgctccagtgcctgatggccatcgtgagaaatccgtagaacaaagttcagatagcgaagtcttcttttagtgattaagcttaattttgatgagaattacatatgcttccaggggctcaag

SEQ ID NO: 527993 - DNA, 945 bp, Homo sapiens
  misc_feature (1)..(1): n is a, c, g, or t
nctgttttgtatggataagaagtgaaacacgagaagtaaggaaaggaggaggagaaggaaaggaccgaccattcgcgtatgagagtctccttcgtacacagtgttgtccatgtggttttttcactcttcttcacgtgaggtacgtttccgccttgttatccgctccaatgttgccgcaaatgtgtggttggccccgatattttcagacaagtttttgtcaaggtctctctcctccccattctgggggcccgcccccctgactcagttccctgcgtttcggagccagagacctgttcccttgcaagcctctgaagtaccgggaatccatgtccaactgcaccgttcatcctggcgcgttctgagtggccttgattttttgtcgggcggcaagggagccacccagaatcccccctaggaggcgtcttcgacatttgtgcccccccgccgcggtgcttccgtccccagtgccgctgtcccaaaactcttgtccgagttaaataggcttgacccccggctttattattcccccttggtaaaccacaggggcctgtcttcagttaccatttattttcttatacagcggacgtttctccacccttattgggccacgcaaggaaggggataaccactgggcgcatccattggtatcccgacgaagcccccactaccgcgaggcaaattggcggaccgaccacccgccgatatagtcagagtatccggccccccccgcccccgaccggggaaaagaggtggagaatggatcatgataggaaagcgcgtgtcaacccagctggacgcccaggggtctcgaaaagccacgaaggaccagcctagtccgcaccccaccgatccactcccccaagccacggcgatctccggcagagcccccccggctgggccaacttcaacacatttttacacccctcccaacccagaaaaaaaaca

SEQ ID NO: 527994 - DNA, 255 bp, Homo sapiens
  misc_feature (235)..(235): n is a, c, g, or t
gcagtctgtactgagggatagagatgagagctttagttgaggaggcagcactgtgtgtgagggtcgagaagctccagtgctgctacttcctgagctcatatatttgtagtccctttcagactcctgaggaagaagacgatttaaacaaacaacgatctaagaaaattcagaagacatatgatgaaaggaagaagaatggcacaatcagcagtctcctggtttagcagtttctggncgtccacagagtactgggca

SEQ ID NO: 527995 - DNA, 88 bp, Homo sapiens
aaaaatgcgcaagactaatcaattattattaaaaagcatgcaaactaaaatgaaggatctccccgaatctcaataaaccagtgaacag

SEQ ID NO: 527996 - DNA, 974 bp, Homo sapiens
ggggtgaactggtgtcggccaggcttctcgatgctccgtggcccgctgtgcaacctcgggctgctgttctgcagtgcctgagacctggcatgtacgagcaactcaatgggcgattggaacctgtaaaatgccccaatcttagcaatgtgcggggaagagctgggtcgactcaagctagttcttcgtggagctcaacttcttgccaaccacagtggaccaagctgaccaaacatgcatgctaattcttggccctgtgacatacatggagatctggggcccaatggagcatcctacgcaaggacatcccctccttcgagctgctacatggcccagctcaaattgctactacttttgattacaatggagcagctccccgagtcagcctatatgcaccagctcttgggcctcaagctcctcttccttgctgtaccagaacctgggtggcctgagttccacacggcatgttggagcggctgccttgccaaggacatacagaccaaatgtctacatcaacgcacccaagtgtaccctggagcaataccttggatggagggcaagctacaacaaagtgttccttggccaagggtacacattccccagccggagagcttacagccttctttcatttgacattcctgctccgacgtattcaggggattgagatccgctgggtgcattcgagaagggcctaagagaaaaatcctttcactgaggccaaccggattctcttcttcaagaacacccaaaaagattgacagactacgcgagaagcgagggtcggtcctgggcccgagcattataaagtttggcaggcagagctaagctgaagaaacaacaattcccttccgaaacttgccaaccggtctcgagtatgcccggaagttgagatgatcggtctagccccggcactggttggcaaggcccgagtcttcaacgtaatgcgggtcgccatacggtgctacaaaccaatcacc

SEQ ID NO: 527997 - DNA, 124 bp, Homo sapiens
tttaggcagcaacagagtgaccctgggggtgctcttgaccgacagccgcacccccggcgtcttaggaccttcgagcaggggattgcatcttggagggtctaggggaagcaactttccaaccccc

SEQ ID NO: 527998 - DNA, 287 bp, Homo sapiens
tgttgaggcccaagtccagtcgatttgatcgagtactcacggtcaaatcgactggacttcgacatggtggtggggatagcgcgccgccagttgaatagagacgggtgggtttgcccgactatgttaagacgaaggagtagtatccctcttcatccttctctagtggtggctcggggatctcttcaaacatgatcgctgacaagggccggctgagggtgcgaatgacggctctggggacgtcgtccggtccgctttcccagtactttcctaaattaatcataccacta

SEQ ID NO: 527999 - DNA, 88 bp, Homo sapiens
gcaatttcatgtggttctaaagtgaaaactacaataaaagaaataggcaagtttagtttccatacttgttcccttctgtcgtcttctc

SEQ ID NO: 528000 - DNA, 442 bp, Homo sapiens
gaccaggagggataactggagtcttagatgattcccgattagtgtttgtataccttcctctaggtctctccagaaggtgatagtcatcgctatccgaggtgtcatacaccaggtagttgacgaacatactcctgagtaaccgaacgggctctatccacgcactcgatgagcagcagggagcatgcggagacactctagatgggatttctgtagcgtttcctccatgtaggagaggtgtcggaatagactctgagcaaacagaaggaggtctgggcagtcatgcaggaatgaatactatctggtcctttgggatataggtatcttcaaactcctggtaggtgtcaatggccagatggtgcgcgcgatgagcttggagcatagcgtggtcaaaaagcctggatcacggaccggtttggacggcaccagcctcttgaagccaggc

SEQ ID NO: 528001 - DNA, 766 bp, Homo sapiens
  misc_feature (223)..(224): n is a, c, g, or t
gcaggcaccagcattctcaaccccttcaggctctaagtgcagtaaattcctgggaagtgtgactgaaaatctcttcagtcatccccactcagagggcagaggctttacccaggcatgggaggccaagcatacggagccccaatttccatcaacccacatgcccatagggtggggtgtccatgcagtgagaggctgctgccccccacacagaacccggctatgnncagaattccctctgatagactcaggcactgttcctgcctctaggtctatagtaggggctcagacattcagcccaaaagagagagaggcgtaagaacagagagctccaaagcccctcccaaaggaactgacttgatttgaaacagtatggggatgttcaagcctaaaagtgccctggaaaagaatggacatttgatggtaagcagttaagaggaggcagcagttccattagagcaagaaataaactgtaggtcagcaggtttacagagagggaggaaagcacaggaagaaccatctgggaaacgacttcaaggatcggaagctctcagtaaaagaaggccctaaatttaatggggtcagacaggggagcagtgtgtgcccaggcatgtgaaaggaatgcagcaaggcgcgggccagaagtgatcggacactggacaacaccaacagggtacagacaatccaggagggccaaagcaaaatcacagcacccacagggaggacccaccggcgaccccagggacacaccggggcggccagaaacggc

SEQ ID NO: 528002 - DNA, 182 bp, Homo sapiens
cgtacagatttaatataaagtcatctcaattagatatcccttttgaaagctgttgcttgcctacttcaagtgaaataaggatatggtcactaaaggtacaaagttcgggtaatggtatctgacaatgtcatgctccaataatactgaacttactttctgtcttcatagccgatagggttagt

SEQ ID NO: 528003 - DNA, 1533 bp, Homo sapiens
taggctgccgtctatcctgtttgccgcggctgtactgtatttcggttggtgtgtggtcggctcgatgcttgactcgttgttgtgttgctaggcttggcgcgcggtgggtggctgcccgtactttttgtgtgctatgagccgtcgtgggtgtcgccccccccggctgtgttgtgccgtccgccctcctaatttgcgtggcggcgaccagaggttgtgtgttgtgtgtgcctacgtttgttgggcgcgccgccgctgtgtccgtctggtgttctcctccccccccccgccccctgtgtggttgcaatgttatgcgccacccagttggggggggtgtctctccaagacgtgtgggacacgcctggttgtcgttcggggggggtttcttcttgtcgtgcgtttggtgcggtgccccaccaatatagtgggggcttgtttgctacccctctgtgtattgatgatattttccctggtcgcgtgtgggcaccacagtatcaacgcacacacccacatggtttgtttgtgtgccgcgcgcgtgacaatgaggtgtgtttgccccctgcgcgtgatcccccccacattttagcgggaatatcacctggcggtcttttcgcgttgtaaatagtagattcgagttgtgcgtctgaaacgtgttgtgctcgctcccccgtgcttttttaggcgaactatataacgcgacgctatatggcctaagtttagtcgtggagaagtgagaattgttccccgtgtttgctggaaaggtgaatccacttgagtgcctttgaaatggagtatgaaattttatgtaccgtgtaaaccacgggctctttagtgcctgtaaatgttgaggagagaccttatgaaaaaaattgctctaagagggtggagctatcttaaatgtgtgccccctctaaagtgagatgtttggccacgctaaacgtgtgtagtcttctctggcgtcttgtccgctacgctctagaataccccccacgctataattccacgagacactctgtatatttctatttaatcgaggtgttacgcccacgttctctttggggagagtggacccacgccacacactcttagagattggtttgcgcacctaaagagtgtgttatattttggaaaatgccccacgagagaggggttgaaaaagaggggagtttccacgtatcgtaccaccactaccacacgctaaatttaatttgagaactaatatgtttgtaaagacacttctagccacgcttttctccacaatgcctttgtttataaaactcactcaccacgaaagaattgggtgaaaaatgctcgaggtattgaccacctcttttcttccttgcactgcactgtcacgctacactaaaccacgttttgtaccacatgaaaattactaaatttgtttgacacttccactgttaaactaccggtcacatgttcacgcttccttgcacatgtaaatgtagaccctagtccacatcagatcatgtgtttctggagagtgttctttattccataaagttttaatttagtata

SEQ ID NO: 528004 - DNA, 740 bp, Homo sapiens
gtccctccattgtctccacggcggcgtaggagcgccggcgagcgcagcccgggaccgagcggggtcgtgcgcggctggtcggggccggcggcggctgaagcgagagcgcgacgcggacgcgaccgtgggttcccgagctgcgcctggccgacccagtctggccgtggcccggccgaggccctggacggggtcctgtggctcgccgttcccattgggtcgccggcgtcccttgaagcgcgtggggaacagctgcccgggggggcccccttgggcccatcgctcccggccttccctgcccccggctggttgcccgatctgggccttccttcccgggggagaccataccacacttggtcagcacacaggaaccatgatgagagaaaacagacacagacaaggaattagagagtagcccaaatcattttacccacattggaaggattacatcactcggtgcttatttcaggaaaagcccccaggacgagcgccagggacacacttgagttggacaaagcacacgtgggtagacccccccaggtccgtcactcgcgaacactattggtccagccactattacatcttcaggccacaccccctcatagtaacgagtgcgggtgaaaacacaactgtgccgcatttcgggccccctgcggtgcaaactccccgtacgtgcggacacatttctcgtggaaagttttcgagaagagattgcgaccgacgtactcgtcggcgctacgcgc

SEQ ID NO: 528005 - DNA, 160 bp, Homo sapiens
caaaaattagccaggtgtagttgtgtgcacctgtagtcctagcaactggggagacatcggtgggaggatttcttggcaggagttcaaggtttcaattaaccatgattgcaccaccgccctccagattgggtaacagccagactttgtctctaaaaaaatg

SEQ ID NO: 528006 - DNA, 431 bp, Homo sapiens
gggccagccaggcaccttctaggtaacgacacatctacaacgtttatcgtcacagccacgcatttgttataatcttcttcatagtatacccattataatcggaggctttgcaactgactagtcccctaataatcggtgcccccgatatggcgttcccccgcataaacaacataaagcttctgactctaaacctccctctctctaactcctgctcgcttctgctatagtggaggccgagcaggaacaggttgaacagtctaccctcccttagcagggaactactcccaaccctggaagcctcctgtagaacctaaaccaatcattcttcctatacagccgtaagcaagagtgttctccgtctaatctaaaggggccatcaatttcatcacaacaattatcaatataaaaccccctgccataacccagcccgg

SEQ ID NO: 528007 - DNA, 141 bp, Homo sapiens
gtagctttggacgatggaccttgcactcagtgaggagacaggccatgcctttcaagtgcatgcagcgcactgatttcattctcaagtttccgcacagtgcccaccaggtagtatgtccgacaagcctggcagaaggcagac

SEQ ID NO: 528008 - DNA, 592 bp, Homo sapiens
  misc_feature (111)..(111): n is a, c, g, or t
  misc_feature (172)..(172): n is a, c, g, or t
atgctgcacagagggtcaaacaattcccctgcctcagcctcctgagtagctgggattacagacgtgtgccaccatgcctggctaagtttttggtattttagcagagacggngttccaccatgttggccaggatgctctcaatctccttacctcatgatccgccagccttggnctcccaaagtgctgagattacaggcatgagccactgggcccagccaatcaacttttcaaagcaaaaaggaatgttttacaaaatagcttattaaaacatctggttcctggaatatttcttggtttaaaaataccttcctggttttaatactgtctttaccttctctccatgaatccatatgccatccatccatgaatttatgcatgcattcagcaaatacttatcaagtgcctccagtgtttcagacttttttttatgcactcgaggtagaaatgtaataggataagcgaagtctctgcccttactgagtttaaaatgtagtgggagaagtgagccagacaaacatgttaacacataatataattcagatagtgaacagtgccctcaggataaggtaagagtggttgacggagggagggg

SEQ ID NO: 528009 - DNA, 115 bp, Homo sapiens
ctggcattacagagccggacagaggctgggaaagggagaggctgggaactgggccccagcaggtgaccctccctggaagcagaagcagaaagcctcggtatctgcaaacaccaac

SEQ ID NO: 528010 - DNA, 421 bp, Homo sapiens
tgttagtatgcttcccttcacctctcactgggccttgctttcctttttgaattggagggtattgattagggagatgctgaaagaagaagacagaaattaataataaaatactgcactgagctcttcatgttgttaaatagagaattacttttttacctccactgtaattcagtttggaatgctttggatacttatgagtcctccttatgtattcctttgctggttgggacacatttaggtcaatcacagctaagtcaggtacttaaactgtccccagtagcaaatggtaattaatggaagcagattttctggtatgtcttaaaatgcatgattgccacttgttaatagttgactgttttctaagcataactagtttgcagatctttttgcaatctgaagagagtaagtagaccaggtagca

SEQ ID NO: 528011 - DNA, 730 bp, Homo sapiens
ttttttttttttggaaacggagtcttgctcctgtcccccaggtgggagtgcaggggcaaaatccccgctccactgcaagtctcctgcctcccggggttcaccccatttctcctctggcctccagcctcccccacagtagctggggactggcggggcgcgccttgccaccaccgcctgggctaattttttggtatttttatagtaaaagacgggggtcccagcacttggggatgtgttgatgtgcgtgagactgagactcactctagatggctcagagacgtttagaaaccacgccgtggccggcatgtggcaaaacccccttctctctcttaccataaaaattaaaaaaacaacacaaacaaaatttcccatgtgtggttcccacaattgagagaaaacaagattctcttataaaaaaagaacaaacatatcttctctccacaggtgtcaccggctcgaggagacgacaaagaaccgtgtgagagaacacctcgtgattctccacacgttttctctgtgacccccctgtgtgtgtcaatttttctatatctcaaagagtggcccaaaaagaggcactatacgaggaaaataaacacttatatatacgagaactcttagagagcggggtggtttttacgcccggtggtgtggggtgtgtttgtggcacccgtgtttagctcccccaaactatacttgtgggggggcgcaaaaacaaacggcaaaaactggc

SEQ ID NO: 528012 - DNA, 249 bp, Homo sapiens
ttaggcgcgcgtagattcgggctagtccacactgacttggccatcttgctctataaatgctggtgtgcatcgacccacagaacccttgcaacatttgagaaggacgctgctgagatgtgaaagggctccttcaagtatgcctgggtcttggattaactgaatgctgagcgtgaacgtggtatcatcattgatatctccttgtggaaatttgagaccagcgagtactatgtcactatctccgccccactg

SEQ ID NO: 528013 - DNA, 525 bp, Homo sapiens
catattctggcaaatatgctaaatttagttcattccaagatcactctgtcactgccggctggttacaccattattctgttgtctccatcccattttcctctttaagatgttgatttagttcagctctgttatgaacagagttcaaacgtccagcaaattcctgatgtttcctggaattggccgtcttgattctattactccacaaggataataacgacactagcccttgtgatacagccacttgtgaagtaacatccattacaacaaggggtaacaagaaaggagattctggggactcaggcgaatctttgataatctcagcttcagccaattctatctttaccacgcactaagattccttttaaatctctctgagtcttgccaagacttttccctgtacataatcttacactgatattctctgacttgtactctttgtctttccctctttcttcctcgttactttcgtacttcctcttctggggattagctcctgaatgcaatcagacattccaagatgacttc

SEQ ID NO: 528014 - DNA, 122 bp, Homo sapiens
tcgctattcatcggcaccgacagagacagagacacagccatcctgccaccaccgctgccgcagcctggctggggagtggggccagccccccaggccccctacccctctgaggtggccagtga

SEQ ID NO: 528015 - DNA, 177 bp, Homo sapiens
gcaagatcccaaataaacaatctaactttatatctcaagacattagagaagagaaagaacaaaccaagcccaaagttagttgaaggaagtcataatgaagttaaagcataactacacacattagagatagaccacctcagatgatcatgacaccgagttagtttttcagcgagaaga

SEQ ID NO: 528016 - DNA, 470 bp, Homo sapiens
ggatctaataggttcaggcagtactgtactactacatagatcttacaacaatggccaaaacttctatccaataatgaacacttctccctatgtattctagttgaccataaaaagaattaagaccgctgcccgttttcttgaaggtattttgcccaatgtacaagcagagcaggttgaaggacatgtatatcctgggctcttagagtgtttatttcatgctgaactagaagtctcaattttgccaagtctccaggtactgctcatctgtgactcagagtacaaaccgcatcccaccaagatttttgtctttctagtacacagctgtttcacacacacggaacaggcgcaggccatcaacggctgataggcactatggtgagaattacatttctcctttacttgtacgtgcctggcatatcctcatccaaggagacatacttcaagatctaaaatacatattgattcaggcg

SEQ ID NO: 528017 - DNA, 330 bp, Homo sapiens
cttattgtgttgcacaaggaaacaattaacagatagacatagacacttaggtactgggagataaaattagcaagccatatatccaagaaggagttaatatccaaaatacataagctctaacaactcaatagcaagaaaacaaaaaacccaattaaaagaatgggcaggccgggcgtggtggctcacccctgtaatcccagcactttgggaggccgaagtgggtggatcacctgaggtcaggagttcgagaccagcgtggccaacatggcgaaacccagtctctactaaaaatacaaaaatcaattggatgtggtggtgcaacacgaataa

SEQ ID NO: 528018 - DNA, 1003 bp, Homo sapiens
  misc_feature (302)..(302): n is a, c, g, or t
gtttgccgtcagaacacacggtgtcgtgacaagtaccccgtaaaagcctacatacatgggaagagtgaaaagactcatatcaacattgtcgtcattggacacgtagataacgggcaagtccaccactacgggaccatctgatctataaatgcgggtgtgcagtcagactgacaagacacgcaattagaaacaatttgagaaaggaggcatgctgagaatggcgaaagggctccttcaatgtatgcacttgggtccttggatcaacactgcaagagctgcaggcgtgacacgtggtatcaccnatctgatcatctccttggtggaaatcttgagaccaggcatagtactatggtgagctatcgaattgatgcacccagagacagcagagatctttatcaaaagacatgagttacagaggaacatcggtcatggctgactgtgctagtcctgactggtaagctgactggtgtatggtcgacattctgaccgcctggtaatcatccgaagcaatgagtgcatgaatccctgagaagcatgcccttctggtcttacatcagctggtgtgtgacacagctaatggtcggtgttaatcaatgattggattccacttgaaggcgcacccgtacgatgccatgcaaggaggatctcgagggacacataggtgtagggcgaaaggtacagtcgactataccatgtgcacgactcacattcgggctgacacatccaccgatgacacgtaacgcacttgggtcggcccaatttgcctggtcaggaactggtgacaagcaatggctggcacgccaaagtagctgaacgatgcccctcgggtttcaaacgggcatgggccaaagtaaaacgccgtaaaggcattggacaatcgcctagagggaaacccatgcttgacttgaggggctcatggactgcattccttaacaaccaacgtccattacccaattgacaaagacccgttgcagccttggactctccaagggatgtctacata

SEQ ID NO: 528019 - DNA, 382 bp, Homo sapiens
ctctcgctctcgagaatccccaaactcctgaccgtgcaggaagacttccgggcaatccgtagacgtccgtgagatcaaggttattgacgcgtaaggactccagaatggctattccagaggctattccacagcagccctcgggtctgctgcttggctatttttatggtcacttcttgattatacgccgaacaaggggtggattattcgtgagttttccaggaagagggtgagcaaggtctcagaactgaggctacctactttattccgaccatataggtaacttcccaacattgccatggcatctgtaaactgtcatggtgctggtgggagtgttacttagcatgccaatttctcaaagttcgcatataatgagcagaacgga

SEQ ID NO: 528020 - DNA, 100 bp, Homo sapiens
taggcaacggatgcaggcatgttatgggatctcaacgaaggcaaacacctttacactgctagatggtggggacatcatcaaacgcgctgtgcttcagtcc

SEQ ID NO: 528021 - DNA, 1286 bp, Homo sapiens
gcctggcagcagggcccacgccacggggccatgggcagctcgagccaggcaggctgctgcccacgcttactgccagtggtgaccccatgccctgtggtgcccagccacaaccaccctggcttcatgccgagggtgctgctctggttgccagtctggcatgcctcgtgggtgtgcagcctggtgctgggactgctgctggtgtgtgcaggtgacggcaagttgtgcctggtgccctcagggccccatgtggcatggcaagtgcttgcatggtgtgatgccaaatgtccatccaattgtgctgtgcccaagccgggggacaggctgaagcacggaccatgggtgcctcttgctgggcccatggggcccacggaacatggcctggggttgaaggtgctgggggccctgttgcttgccatctcccatggccttctgttgggcccatgtgacgggtccttgttcccttggtggctgcctgagcgttgcttgccctgacgtacaatgcttgcaaggtgcaaccagaaggacaatcccagacggcaatggaaccattccttgcgattacatgccccctttcaatgggccggttgttggggaccttgggctcaatccttgcttggatagggtcatcctaacaactggcatgtcttcaaaacaccataaactcagagactggccctttcacttggcttcgaacgcggacgacccggacaggacagggcccctgccttggctaaacctgcagttgttggcatactggcacttggaccatacctgcatggggctagaagagtggggaccctccaatccggtggaaccatccattgtccattcggttggaggagcattccttccattcaaaatttaccggagaccacccgtaaacggtcagaattggcccaaacagcaagggacgcgtcggtccaaggccaccacacgggcgccggaattaaggccggatcacagcgtaactatcacaagcgggactgggtttccatcatctgaacattggttggtccgcgacataccccatttcgaccttgcgtacacagcctgtcagggaggccagacgcctgaaaaacacctggaccggccctccgcagaacactttcgcccgccatcaacggcgtttgatgcaacgattaagcgccgcaacctaggatctcgaacaaaaagacacgcgcccagcctcgaatgtctatgcctgtcacattaggcgcatagcccgacgggacccgactatgcgtcacactggcactatgacagcacgggactcaccattgtagccc

SEQ ID NO: 528022 - DNA, 399 bp, Homo sapiens
gcggaaaccaggactccctccactgagtggtagagcccaatttgaagcctaatggagcatgtccacctctaggggctctcgtgccaaggccaccttgcactcagccttccaggtggcagcacggctctcacggggagtggttcccgcctggtcactccccaccctgccaccgctctgcctctgagtaaacggtcggcacatgtgttgggttgaccgtggcattggggcaagggtctgacagtcagaggtgacggtcgtgcaggaggagacaatcccagctgcagctatcgggcagggcagggcgcagcacctgtgtgtgctggaagggacagagtgtttttgtttgtttcttttttccccctgagacagagcaaaaccctatctcaaaaaaaagtggtc

SEQ ID NO: 528023 - DNA, 670 bp, Homo sapiens
gcggaaaccaggactccctccactgagtggtagagcccaatttgaagcctaatggagcatgtccacctctaggggctctcgtgccaaggccaccttgcactcagccttccaggtggcagcacggctctcacggggagtggttcccgcctggtcactccccaccctgccaccgctctgcctctgagtaaacggtcggcacatgtgttgggttgaccgtggcattggggcaagggtctgacagtcagaggtgacggtcgtgcaggaggagacaatcccagctgcagctatcgggcagggcagggcgcagcacctgtgtgtgctggaagggacagagtgtttttgtttgtttcttttttccccctgagacagggtctcactctgtcacccaggctggagtgcagtggcacaatcacagttcactgcagcctccaccttcccagactcaagtgttcctcctgcctcagcctcctgagtggctggaactacaggctcatgccaccacgcccggctaatttttgtatttttaatggagatgggggtttcaccattttggccaggctgccccaaactcctgacctcaggtgatcccctgccttgcctcccaaagtgctgggattacaggcgtgagccaccgtgcccggccataagaggcagttttaattgaagagat

SEQ ID NO: 528024 - DNA, 186 bp, Homo sapiens
cttttccaaagagcttaatttggtgtcataaagtgaagcgtaacgcgcgagtggtgagatcgtcctgtcctgcgcttaacagtacaggtggaccaaaggggctcccggccaaatacttctggttggagggtggggagggagtgctctctcaaaaccactcctggaatggcttaactcgcccagcac

SEQ ID NO: 528025 - DNA, 247 bp, Homo sapiens
gacgatcctggctcagtgatctttgggctcagtgatctcccactcggctacaagtgttgggattacaggtgtgaacacttattcttattggttttggaattggccaacagaatttttctggccactggaccggataaatccattcactgagaacacggcattgcagtacagaaagagttaaattgaccggaggctggccacacaaaatgggaagaccaagtttttactccaaattttccccttaaag

SEQ ID NO: 528026 - DNA, 196 bp, Homo sapiens
gtgactacggctactacggtatacaagagtcaggttcgtccttaagggttgtgtatggctatcattgtgtttatgcggttagcttggattagtcatggtggggtggtgataagtcggttgttgatagagatatttggaggtggggatcaatagagggggaaatagaatgatcagtactgcacaacttgtcgagatt

SEQ ID NO: 528027 - DNA, 494 bp, Homo sapiens
cctgaaccttgccactttttgtaaaaagcgttgcttagactcattccctcaggtcttctgaaaatgagtattctatgtttatcggtgttgaaccccaggggcaggagccacggggcctacagatgcacccaagggcagcagccagtaggacgtgaggtcttgcctgcctgggaacatttgcagcctgcagcctcgagccttagcctacattctgggcctgacaggaaatgttctgtctttctttaccccacaccaggactcctggagtggtgggcaaatacctgtgagcttgttttttgggggaaaggcctatctttgaggccattcagatcttaaccatcactgtccgtccttcttgtttcttccggtgaaatctgtgctaccaagtgcctatgaattgactctactaaaatgaaatcttttaatttgtaaacattggaatcggaataaataaacttatataacttaaaagcataaaatccttaagtaattat

SEQ ID NO: 528028 - DNA, 408 bp, Homo sapiens
gagagagagtagagagagagagagagagagagagagagagagagagagagagagagagagagagagagtgagctagagagaggtctcgccgagctctctccttgtcgtcgccccgcttatatgcttcggttaccctcagtctttcctctctttataccgctgtcctttgttctctcttcttatctcactctggcttatgcctccgatctttcttcttgtgcatatgcccgagcctttgcttcatggtgtacaccttttagccgttgctgtcgccgtttctctgttgcctctcggatttactgtgattattgatctcatttgcttgcgtctccttgtttcacttgatgttgttactgttgcctagtcacttgacttatatgatttttacctttcctttgtgcttttctc

SEQ ID NO: 528029 - DNA, 81 bp, Homo sapiens
tacttctgtgcatcaagcatggccgggtatgcactcaacttcggcaaaggcacctcgttggtcacaccccatatccagaac

SEQ ID NO: 528030 - DNA, 162 bp, Homo sapiens
ggtcggtacctctcgggccgttcttcgtgccaagggtgggccaacgtgacaaagcgcggtgtctgcatccgccgcttagcccgaccggtcttcttcttcttcttctcctgttggccaccttaggagtctgacctctcacttttccagcagggcccgagagta

SEQ ID NO: 528031 - DNA, 743 bp, Homo sapiens
  misc_feature (5)..(5): n is a, c, g, or t
  misc_feature (63)..(63): n is a, c, g, or t
  misc_feature (87)..(87): n is a, c, g, or t
  misc_feature (124)..(124): n is a, c, g, or t
  misc_feature (144)..(144): n is a, c, g, or t
  misc_feature (153)..(153): n is a, c, g, or t
  misc_feature (157)..(157): n is a, c, g, or t
  misc_feature (207)..(207): n is a, c, g, or t
  misc_feature (225)..(225): n is a, c, g, or t
  misc_feature (241)..(241): n is a, c, g, or t
  misc_feature (285)..(285): n is a, c, g, or t
  misc_feature (290)..(290): n is a, c, g, or t
  misc_feature (292)..(292): n is a, c, g, or t
  misc_feature (302)..(302): n is a, c, g, or t
  misc_feature (396)..(396): n is a, c, g, or t
  misc_feature (407)..(407): n is a, c, g, or t
  misc_feature (501)..(501): n is a, c, g, or t
  misc_feature (528)..(528): n is a, c, g, or t
  misc_feature (548)..(548): n is a, c, g, or t
  misc_feature (558)..(558): n is a, c, g, or t
  misc_feature (724)..(724): n is a, c, g, or t
aaaancaccagaaaaggaactgacactactgagacctggaaggagccgacccccaacccctancccaggacacagctggcacctcangcccctttccttctgaaaggagggctgtgtctctctnacattcacacatacacaganacatgcatntgtncacactcatggcacatgggacctcaggggtagcctgtttgccgatccccncaagaggtaccaggaggnagaccgctagaagganataagaggctaccctggtctccatccaacccaagggaggtaagnaaagntncaacgccctncttaggataagtggactgttctttctagttcaatggagcgttgacttagggggcgtttttgaaggttttttttcctcctttttgtagtttttanaaaaatagaanttctcttggtatttataaatttacggctatggctctatgtgtctatgttacaggtagaaaagccatatggggcactccttttgtgtttgctcangccttgattgcctgtcatccaaggtcncttggtctgagaagtctatncggtcacctnagcagccgcttaagcaccttcagtgggcccatcccattgagcggcgtactcctgctgggagccgggcacggtaatagaagaggtaggaaggcaacaggaatcccaggagtgagaatagcaggaggcccagattcacccagaagggctctcctttcaaggggaccancatgcgcatgaaaatttgg

SEQ ID NO: 528032 - DNA, 133 bp, Homo sapiens
cgtcggaatgaaatgagggtgggcaggcctgagctccaaaaccttctgatggcccaagccctcctggtctggctgggattatctccacacaaagggagaaacgggacaaggtggtcatggaggtccctgaaag

SEQ ID NO: 528033 - DNA, 506 bp, Homo sapiens
aattttttttcttattcttttttcttttttatagactatttttacctttattattttggactcttggggaacaaaatttttactttggagtcacattgaccagccctattttttatttttgggacatttaaaaatttctttgacatgtattttggataattggaaaaccataatgctaactgttgccaaagggaggtcaccatataactggggccctattttctttaacaaaggggtttaatttaaaattttttactgggcgttttaaaaacatgtttttaaaaatcaattctggcaagggatcctggggaaaaaaatttgtgtttactctttagggattaagggatttagggatctttcgtgatgtcccataacatgcatgaacactttaaagttctctaatttaggcgctgggtgtcttgttattggattttaaaacgttatacaccgcttgccaggcttgttaaaacttcaatacactcttgccagggctatttttacttgag

SEQ ID NO: 528034 - DNA, 106 bp, Homo sapiens
  misc_feature (7)..(7): n is a, c, g, or t
atctatnacttcttcccggaccaaagtgatagttaagggagccacagccatttctgctcttccatagagcagctctccaagcatgccattccagggcaagttgtat

SEQ ID NO: 528035 - DNA, 185 bp, Homo sapiens
tcttttctgctgctgctccccggcagccagttctgatggcccagatggcaaccactgcagctggcgtggctgtgtgctctgctgtggggcacacattgtgtcacgccattactggcgtcttcagtggaggaagtaatgctgagcctgcgatgcctgacatcacttaccatgagcctcagggaacc

SEQ ID NO: 528036 - DNA, 228 bp, Homo sapiens
tggtatggggcaatgagtgcatcagctgcaagcatactccacactctccttcattcactggaggacacagagctaaaggcctacagaaggccttacagtcatataacagtaaatagcagagtaacatctttatacacataaactgttagaaatgataagtgtaaagttgtgcgtctcctgcggctcctgaactcgccgattcattatgaatagcatcggaccagccat

SEQ ID NO: 528037 - DNA, 300 bp, Homo sapiens
atgtttaggcagtctcttgggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagacc

SEQ ID NO: 528038 - DNA, 199 bp, Homo sapiens
cgtcaggccactaagtcgtcgttccggtgcggatgcgttctgcaccgagtgcgcggggtcgatcagcccttcgcgcacggcctttgtagaacatcgtgccgtggttgagcgagtctggcgcgtcgtcccggccaagtgtcgcagtgggcgtcgaagtggaccagcgccagggttgcccgaaagcgcccgggttgggcct

SEQ ID NO: 528039 - DNA, 1596 bp, Homo sapiens
  misc_feature (721)..(721): n is a, c, g, or t
  misc_feature (1067)..(1067): n is a, c, g, or t
  misc_feature (1254)..(1254): n is a, c, g, or t
ctgcggtggatgattttcttcgtcgcggtgcccctcacccgaccctgcgttcctctgcggtggtaatcatctcgccgggggatagcatgacggggccctctctggtttgtggggcaacaacatgtgagggagggccgcgtgaggtagaagcggcctctcttcctccgtgttgtgtagactcgtttcgctgccccgccgctcccgtatggaggaggtttgtttcctcccccttttcgtatgcgcccctctgttgagtggctcccccaccagggccgcaaagggggccgcgggggctctcttctcgttgctctcctcggggacatatgtggggtgtgggatagaattatcacccccacggggggggcacacacaacccacagcttgtttgtggggcccccctcacggaagatatgttgttgccgctgtttggtggttttgtttttgttgttgtcgcgcaccaacaaccctgtggggaggactgctgtgtggtgcgcccccttcctctaagagtagggcgccccatctgtagtggtccctccccccctcttcttctcctctgcggtcctccctcaccgtggttattggtgcctctcctcgcgcgcttattattttggtgggcgccccaactatctccgcggggagtcccccctcttggtgtcctccctgcgcccccctttattggtagctcgccccctctgtgccccgcgccgcgcggacgaanagagaggcgcgcgctctcttggagtacagcgccgctccgccgctcgtctggtggtctgtgggagagagctctattattaatgggcgcgtccccacgagtagtgggtagaccgcccccgcgacttatgtgcgcgtcggaagagggcgcctcctcccgtcggcgggggtctttcttcacacgagagcttctgtcgtctgcgtgttatttgttcacgcgccctcacacggtggcgccacaccacactcccgtgagagagtttggagcgcccccccccctcggataagatagagagcgcccacacacagaggtgtctctcacacaggcgcgctctcctcgtctctcacanatgtggagagagagctcacacagagcccacactctctgtgtacacacagactcctctcatgtatagagagagttttatgagagtgtacacacactttcctctttatgagcgctgtctctccccgcgacaccctcgtgataaccacacttctcccccctctcccatctctggggggtgtgtgtgtgtnaagagcggtgtttgtgtgtgttgagagtgcgcacggcagagcctctcttccacgcgagactcttctctgtgttgtgcacagagagaacacccctcgcgagagtgttgtgtgtctctgtgtccctctggctgtggtgcccacagagagtgttgtgaagcctgtttgttgagaaggtgtgaggagccacctcacgagatatggccacaagagcccccttctggttttttgagtgagaaatgttcttcttcttttcacgagaagaagaagagagaagagaggggcacacttttgagaaaataaggccaaaaattgtaaatgggtgttccaaattttttagaagga

SEQ ID NO: 528040 - DNA, 715 bp, Homo sapiens
agctcgctgcagcctcaaacttttaggctcaggtgatcctcccaccttagcctcctgaggagctgggtgcacacgccaccatgcctggctaattatttatttatgaggcggggtcttgctttgtcacccaggctggagtgcagtggcgcaatcttggctccctgcaacctctgccttctgggctcaagtgatcttcccacctcggcctccggagtagctgggaccacaggtgcatgctgacacacccagctaattttggtattttttgtagagtcggggtttcgtcatgttaccgaggttggtctcgaactcctgagctcaagcaattcacccacctttggctcccaaagtgctggacatgcaggtgtaagccaacatgctgggtgtgtttttaaaccatttttttgtagagacaggttttgctaatctgtccaggctggttctcaaaattcctgggctccaggtgatggtcccgcctgggcctcccaaagtggctgggtaccggattaaaggtcaccaggttcagccaaaattcctaaaactggataggatattccaaatttccaaattgggatcccctttccggtccgggttacatttttccccccagaattgaattactggggggaccccggaggaatttctactgggtgccagtgaccggtagggctatgacccaaagcttgggaaatttggcgcaggcaaactttctatc

SEQ ID NO: 528041 - DNA, 260 bp, Homo sapiens
  misc_feature (3)..(3): n is a, c, g, or t
  misc_feature (115)..(115): n is a, c, g, or t
  misc_feature (134)..(134): n is a, c, g, or t
  misc_feature (211)..(211): n is a, c, g, or t
  misc_feature (234)..(234): n is a, c, g, or t
  misc_feature (245)..(245): n is a, c, g, or t
tcnactcggtacccgggaggggactggtggtggcggcaggatagttcagacgtctctatttcctgagcgtctgagatgttagtattagttagttttgttgtgagtgttagaaaanggcctacaactaggaagcnataaggaaaatgattatgagggcgtgatcatgaaaggtgataagctcctctatgaaaggggaagtagcgtctgtaanacctacttcccctatcatagganaacacaccaanaccagaagagcacac

SEQ ID NO: 528042 - DNA, 940 bp, Homo sapiens
  misc_feature (2)..(2): n is a, c, g, or t
  misc_feature (67)..(67): n is a, c, g, or t
  misc_feature (254)..(254): n is a, c, g, or t
  misc_feature (280)..(281): n is a, c, g, or t
  misc_feature (286)..(286): n is a, c, g, or t
  misc_feature (333)..(333): n is a, c, g, or t
  misc_feature (347)..(347): n is a, c, g, or t
  misc_feature (531)..(531): n is a, c, g, or t
  misc_feature (545)..(545): n is a, c, g, or t
  misc_feature (563)..(563): n is a, c, g, or t
  misc_feature (570)..(570): n is a, c, g, or t
  misc_feature (576)..(576): n is a, c, g, or t
  misc_feature (581)..(581): n is a, c, g, or t
  misc_feature (591)..(591): n is a, c, g, or t
  misc_feature (601)..(602): n is a, c, g, or t
  misc_feature (608)..(608): n is a, c, g, or t
  misc_feature (641)..(641): n is a, c, g, or t
  misc_feature (650)..(650): n is a, c, g, or t
  misc_feature (702)..(702): n is a, c, g, or t
  misc_feature (721)..(721): n is a, c, g, or t
  misc_feature (734)..(735): n is a, c, g, or t
  misc_feature (759)..(759): n is a, c, g, or t
  misc_feature (778)..(778): n is a, c, g, or t
  misc_feature (782)..(782): n is a, c, g, or t
  misc_feature (812)..(812): n is a, c, g, or t
  misc_feature (826)..(826): n is a, c, g, or t
  misc_feature (829)..(830): n is a, c, g, or t
  misc_feature (845)..(845): n is a, c, g, or t
  misc_feature (857)..(857): n is a, c, g, or t
  misc_feature (924)..(924): n is a, c, g, or t
cnttacattccatccaaagaaggtaatccggacgtggtgagggatgcgtccaggtgggagctccgancgctggtcctgagtgggctctgatgggtgggagggcccaggtcctgcctgcccacccaggccccacatgccagggcgcgtgtctgcatggccacccacagctgaaaacaggcgtgggcgatctgaagccctgtctgtgttctactgtggcagaaagtgccccagtccttccagcggttttgggagcngggcctccaggagcgcagggctgagnnggggngggggggggggtgacagggggggcctttgtgaagggggagggagggngcggcgcgaaaggnagggagggagcgggggaggggtcttgactcatcttaacaaggctttggggcaattctgtgctatggaggccctgccagcccctcctagtagtccaatagggaggccaccggggacaggcacggggtggccgcagggggtgctgctggcccgggcttggcggctggggtggggggtccctggggntcccgccgccccgnaccgtccctttctggtgnccaaccngctgcnaggcncctgctggcngttctggggnntggggnaggggcgctggctgcctcaagtgtcccctcccnaaggctggngccccccgcatgtggctccgcactccctggtctttggtgctttcttgcaaanctcctggtggtggcaaaancccatgggggaannaagggggtcttgccgtgcaatccnagcccgtctgtccccagcnggangtgtggtgctggctcaatgctgcctccctngcctgtctgtcccnccnntctgcctctggctcnaggctggctccnagcccccgtctccctgtgtgtcggcttgttctggggtgggtgttgctctgtctccaaatcccttccngcctgggccgcgccta

SEQ ID NO: 528043 - DNA, 1014 bp, Homo sapiens
gctacgtatgctactatcatttaccatctcgacttctaggaatactacctatatcgttcacatctcatatcctccctacgatgcctagaatgactactaatatcggtgtgcattctagctactctaacataaacctcaacaccgatctctctaagccagtattgtgccctatagccatagtagtcgtcgccgggctgcgaagcatggtggcccgtagtcctaactagcgccaatctccgagaagatattggactatgacggactgtaacataaacgtaaacctacgtccaatagatacagactgaatgagtcccaagcaatatatatcacgtgactcgacttggaacatgacttatccaaggaatcacatgaattcgaattcaagcacgaagtcaaaccaacgagacttgaatgtgattcagcatcatccaccgcttgacatatttatgaaaccagaattgcaagaaagcaaccctattgtagttgttcgcccgaacctgtatccctccgatcccccctgaacagacacgcaccctgcactaatagtaactaacggagaccgaccacatcacagatccatggcgaagggaacgccactatatatccgagagccagttatcacagacacaagagctactggcatatagtaatctacccatagagaagggtcgctgatcataacgatttgcagacgcagaaaataatcagtattaagatctatcgtaagaaaaaatgtatccggtactgggagtatactagccgaggaggagaccaagcgaaggaacggaagcatagggatacgccaataaactaaagagtcataccgtagtaggggaaaatataccaaacacctagggagaaaagtgagaaaggccagggcgaaatggacggccaaggaagcagcacaggagagaaaaccagggccagtacaagggccaggggcagagggataggggaaactcgaaccagcaggccagaccacaaaaaaaagagaccggcgcccaccaccacgag

SEQ ID NO: 528044 - DNA, 383 bp, Homo sapiens
  misc_feature (18)..(18): n is a, c, g, or t
  misc_feature (158)..(158): n is a, c, g, or t
  misc_feature (179)..(179): n is a, c, g, or t
  misc_feature (191)..(191): n is a, c, g, or t
  misc_feature (196)..(197): n is a, c, g, or t
  misc_feature (199)..(200): n is a, c, g, or t
  misc_feature (207)..(207): n is a, c, g, or t
  misc_feature (210)..(210): n is a, c, g, or t
  misc_feature (218)..(218): n is a, c, g, or t
  misc_feature (220)..(220): n is a, c, g, or t
  misc_feature (225)..(226): n is a, c, g, or t
  misc_feature (228)..(228): n is a, c, g, or t
  misc_feature (231)..(231): n is a, c, g, or t
  misc_feature (234)..(235): n is a, c, g, or t
  misc_feature (241)..(241): n is a, c, g, or t
  misc_feature (252)..(252): n is a, c, g, or t
  misc_feature (261)..(261): n is a, c, g, or t
  misc_feature (273)..(273): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (294)..(294): n is a, c, g, or t
  misc_feature (300)..(300): n is a, c, g, or t
  misc_feature (311)..(311): n is a, c, g, or t
  misc_feature (319)..(319): n is a, c, g, or t
  misc_feature (327)..(327): n is a, c, g, or t
  misc_feature (332)..(333): n is a, c, g, or t
  misc_feature (336)..(336): n is a, c, g, or t
  misc_feature (340)..(340): n is a, c, g, or t
tcggtagtgcactggctngaggattgagctatggaaagaatggtaggagacggaatcagaggagagcaggcgacaggtcaggctgggccccataagccttgagggtttcagctgggtagtgacactgttaaaaaatattctggccggagtgcaatggntcacgcctgtaatcccagcantttgggaggccnaggcnngnngatcacnagntcaggagntngagannanccnggnnaacacngtgaaaccccntctctactnaaaatacaaaanagccgggcntgntgncgtgcnctgtantccagctactngggaggcngaggcagnagaanngcntgancccgggaggcagaggttgcagccagctgaaatcatgccactgc

SEQ ID NO: 528045 - DNA, 415 bp, Homo sapiens
cacactgggaatgagcatatctgtcttagataccgaacacgaaggctgtggactacctatggagatattcaccctttgactttggtggcctgatcaagaattgggtgtggacgttggccctgtttgcttttaataacccaaactctctcggaaaccccaacaaaaaaaatttaaccccattggtgttcctcttgttctaatcttgccaaccggggcaggggaccgacaaaattccagttttttatttccaaaaggttgggaaacagtataattggacaaagaaaaatgtttcttctttttttttgctgcccaccaaaaacaaacaaaatgctttttgttttttttttttaccaatcccaatttcaaaatgtcccaggggggctaaaaaaaataaactccacccctctttttgata

SEQ ID NO: 528046 - DNA, 448 bp, Homo sapiens
gtaggcatcaagcaatggatcaggccagtcgatcccgacctgtcgtagatgtggtacaaacatttggcggtagtaatatccttcaatggtgaaaggagtattgaagggaaatttctgggctgcatttgccatcattgcatcatcaacctgatgttcaacgtattcctgtaaaatcttaaaccaggaattcttacctgcagtaataccatcactgaaggctcctttaggtcgccagagaatctctttgggtatcagatcggaatcctcaaacgtctctctcaggagatgtttctctatcccattctttggaattctcatttctggtggcagagacaaggtaataggcagacactccgcatgatctagaaatgggactctcagttcaagaccatggccagcagtagttcgatctgcgcggagaacatcaaaccactagaagtccctcaga

SEQ ID NO: 528047 - DNA, 148 bp, Homo sapiens
cgcttttcccccccccccctttgccttgttccaagctctttcttttcaaaatacttttctggttttcatagggggggtttttatttttctaattagccccccgtggggatgttttaaagaagcccccgtgtttttgtgttgttggcca

SEQ ID NO: 528048 - DNA, 197 bp, Homo sapiens
caccccagtgtacctccaccaccacctggtcgtccaaattcccaacatttttcttctgtgtgtattctgaaacagaagttcctctcgtagaagcactgaattctcccacccttatgccttttctttaatggcccttcttgacatggtttataggtaaaaaacatgattccaggaactttttacacaagacatcccag

SEQ ID NO: 528049 - DNA, 481 bp, Homo sapiens
  misc_feature (158)..(158): n is a, c, g, or t
tctcatgtgatttctacaaagagtcatatagggtctttgaatttagaccaaaatattaaaaataatcgatctataaggcagaatggggtcaggatgaggcaaggtggaggttggagctgtgtgcatgaaggtccactccactagttgctggaggtggnagactcctggactggtgatgggctctgccagacaaaggacgctcattcattatctcaactatcactagtggttactatgtacgcctattttcagcacctactatgctctgatacttagtatttaactggccttataaggtagagagctgctcaataaggagaaatccccagaccgaacaggtcccatctgacccctgaacgcctgggtttatgtggcaataagtctgttggaatcagagtaagggacaacagcagacagagtaaaggagtatataggttcttagtcagtcctgtcagtcctccaggaatcaggaattacctaa

SEQ ID NO: 528050 - DNA, 846 bp, Homo sapiens
tatcggtggtggcacatgcctgtaatcccgagtaggggatacaaggcatccgcaccactcccagctaatttttgtatttttagtaagacggggttcaccatattgtcaggtggctcgaactccctgacctcaggtgatgcactcaccttgggctcccaaagtgctgggattacaggcgtgagccacgcacgccgtggcctagggatgtcttgacttcttcacttgaggtcttctgctggggtcatcttgccgccaagatatctctagcagtctggtaaggcaaaaaagccatataagttaaaaagcacatcatcattattggtcataggaagatgaatcattttccacaattctgtgtgtgatctattttgcaggccagacgaggtatcagagattacggtcgcggcgttcctagggtaacttgagattgggtcatattctgaccaagggcaaacggcaggttgctgaagcgccggagaatcatttgaacctgtgaggcgaaggatgcggtgaggttgcgatttgctccaaggatgggaaacttccggttctccagacataatggcactacacatagcctaatactagctatgttggcgcgtgcaggtcccacgaaaaatacttagcacacaattgtttgaggctaggcgcaccccaaactagcatgggcaaaagacaacagaggtgtacctaagtaccgtcggtctgactaggtgtgttctctccacaataacaagccgggccaccgcgcatttcaacaacccagggcctgcgcatagtgggctcacaagcgacgagggagtaataacaccgcgcggtaacagcggacgcacccactaatcggca

SEQ ID NO: 528051 - DNA, 204 bp, Homo sapiens
  misc_feature (174)..(174): n is a, c, g, or t
gtttgaccttttgcagaaaagaacaagagggaagacagaccttcaggctgggtgcagtggctcatgcctgtgatcccagcactttgggaggccaaggtaggaggatcgcttgagcccagggattcaagaccagcttgggtaacatggtaaaaccccatctctacaaaaaacagnaaaaattagctgggcatggtgtgtgtgcct

SEQ ID NO: 528052 - DNA, 453 bp, Homo sapiens
gctactcgggaagctgaggcaggagaatcacttgaacccgggcagcagaggttgcagtgagctgagatcgtgctactgtactccagcctgggtgacagagcaagacgccatctcaaaaaaaaaaaaaaaaaaattcaaacagcatggaatagataaaaatgcaagactgggcgcagtggctcacgcctgtgatcccagcactttgggagggtgaggtgggtggatcacttgaggtgaggagttcaagaccagcctggccaacatggtgaaaccctgtctctactaaaaaaatacaaaaattagcagggcgtggtggtgagtgcctataattccagccacttgggaggttaaggcaggagaatcacttgaacccgtgaggtggaggtttgcagtgagccgagatcgcgccactgcactccagcctgggtgacaagagtgaaactcggcctcagg

SEQ ID NO: 528053 - DNA, 1233 bp, Homo sapiens
  misc_feature (282)..(283): n is a, c, g, or t
  misc_feature (291)..(291): n is a, c, g, or t
  misc_feature (678)..(678): n is a, c, g, or t
  misc_feature (696)..(696): n is a, c, g, or t
  misc_feature (699)..(700): n is a, c, g, or t
  misc_feature (705)..(705): n is a, c, g, or t
  misc_feature (709)..(709): n is a, c, g, or t
  misc_feature (715)..(716): n is a, c, g, or t
  misc_feature (718)..(719): n is a, c, g, or t
  misc_feature (736)..(737): n is a, c, g, or t
  misc_feature (746)..(746): n is a, c, g, or t
  misc_feature (748)..(748): n is a, c, g, or t
  misc_feature (758)..(758): n is a, c, g, or t
  misc_feature (762)..(762): n is a, c, g, or t
  misc_feature (771)..(771): n is a, c, g, or t
  misc_feature (783)..(783): n is a, c, g, or t
cggcgcccaaagtgctgggatgacaggtgtgagccccgtgcctggcctggtcatttctcttgctgtgcccaacctgccattaatcccatccatcctgagcccgacgtggtcatttctctcaccacccagcctaccgcccgacgtggtcctttccctcaccacccagcctaccgcccgacgtggtcctttccctcaccacccagcctaccgcccgacgtggtcctttccgctcaccacccagcctaccgcccgacgtggtcctttccctcaccacccagcctnncgtcgggnccagtgttcatggaggcctctctgagtctgcattcgtactcttagcaagaccttggatacgaatatgagggccccatattcttcatagagtatattgtctcgtgtttcattactcttcgtgtcttctcggtttggacgagcacaaagcactacgcatccgatgtgagactatgtcccagcagtcgtcgacgaactacagcctattcaccattgtggaaattctgtctagtaggtcgaggacggaggtctcgactctgtactgcccagagcgtggacgtgcaagataggtcgcagtcgtatgggcgtcactgacgaaggctctgaactcgccggagttgcacgccgattcgtccgtgccctcagtctcccaagtagctgggactacanggcgtcgtgccaccgggnccnntgctnacantattanngnntcgtcttagctagaganngcggatttnancctggattangccnaggatggtnctctgagtcgtnccttgacctcaattgatttccggtccctatgcgtttggtgttcttcccccataaaggtgctttgaggactattacattgaggtgttgaaggcccaatgaactatcccggtgggccttggggggcacttttcctttgatgattccattcctttgcttagatgtgccttacttaggaatggcaaaaaaggctgtgtatataatggaacacaacccgggggtgtactagtagaatcccctattgggtcagttggactcaagcgtgtttgaacacgcagacaactataggcgtgtagtgtagacacacaactactggatttacacattggtcatggcccctacaaaagcaccactccagttgggggtgtaggaacagggcactatgtactagttgccacaagattatacaagacacagtcgtcacaaaaaattatagcctgtagtgaacccgat

SEQ ID NO: 528054 - DNA, 282 bp, Homo sapiens
ctagctgctaggggcgctcaggacccactgatcagcgtcaacctcagaggcaggtgcacaaggaggccgatttcctgtcacgatgtgggacttcatctctttacagtttctctagtgaacctctctaagttcagaactctgtgcttactaatgtcatctgtacatatttcctaaacgtgattattttaatatgaaaacctattctcctgtgtacaaaatgcggattgatccttacagaggagatgaaaactcctcaaccatggtcaccatgatcagagttct

SEQ ID NO: 528055 - DNA, 399 bp, Homo sapiens
gatgcagtccctgtcaattgtggtgatcactccccctttcacagtggcatcatcttgagccacagtcactggattgactttgctgtctaaaactactgacagggagcagcccccgggtcgctggttggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggagtgcagcaggaaggaacaaagacaggcaaacggcaacgtagcctgggctcactgtgctggggcacggcgggatcctccacagag

SEQ ID NO: 528056 - DNA, 1210 bp, Homo sapiens
  misc_feature (259)..(260): n is a, c, g, or t
  misc_feature (268)..(268): n is a, c, g, or t
  misc_feature (655)..(655): n is a, c, g, or t
  misc_feature (673)..(673): n is a, c, g, or t
  misc_feature (676)..(677): n is a, c, g, or t
  misc_feature (682)..(682): n is a, c, g, or t
  misc_feature (686)..(686): n is a, c, g, or t
  misc_feature (692)..(693): n is a, c, g, or t
  misc_feature (695)..(696): n is a, c, g, or t
  misc_feature (713)..(714): n is a, c, g, or t
  misc_feature (723)..(723): n is a, c, g, or t
  misc_feature (725)..(725): n is a, c, g, or t
  misc_feature (735)..(735): n is a, c, g, or t
  misc_feature (739)..(739): n is a, c, g, or t
  misc_feature (748)..(748): n is a, c, g, or t
  misc_feature (760)..(760): n is a, c, g, or t
ccgactctagagcgatccccctcaccacccagcctaccgtccgacgtgtccctttccctcaccacccaccctaccgcccgacgtggtcatttctctcaccacccagcctaccgcccgacgtggtcctttccctcaccacccagcctaccgcccgacgtggtcctttccctcaccacccagcctaccgcccgacgtggtcctttccgctcaccacccagcctaccgcccgacgtggtcctttccctcaccacccagcctnncgtcgggnccagtgttcatggaggcctctctgagtctgcattcgtactcttagcaagaccttggatacgaatatgagggccccatattcttcatagagtatattgtctcgtgtttcattactcttcgtgtcttctcggtttggacgagcacaaagcactacgcatccgatgtgagactatgtcccagcagtcgtcgacgaactacagcctattcaccattgtggaaattctgtctagtaggtcgaggacggaggtctcgactctgtactgcccagagcgtggacgtgcaagataggtcgcagtcgtatgggcgtcactgacgaaggctctgaactcgccggagttgcacgccgattcgtccgtgccctcagtctcccaagtagctgggactacanggcgtcgtgccaccgggnccnntgctnacantattanngnntcgtcttagctagaganngcggatttnancctggattangccnaggatggtnctctgagtcgtnccttgacctcaattgatttccggtccctatgcgtttggtgttcttcccccataaaggtgctttgaggactattacattgaggtgttgaaggcccaatgaactatcccggtgggccttggggggcacttttcctttgatgattccattcctttgcttagatgtgccttacttaggaatggcaaaaaaggctgtgtatataatggaacacaacccgggggtgtactagtagaatcccctattgggtcagttggactcaagcgtgtttgaacacgcagacaactataggcgtgtagtgtagacacacaactactggatttacacattggtcatggcccctacaaaagcaccactccagttgggggtgtaggaacagggcactatgtactagttgccacaagattatacaagacacagtcgtcacaaaaaattatagcctgtagtgaacccgat

SEQ ID NO: 528057 - DNA, 462 bp, Homo sapiens
gatgcattaaaatgtagatagcacctgatgacgtgagaaatgcacctgatgatgtgagaaagttttcacgtaacttccagataggtgaccgtgaggacatgtgtaaagaagttcctatatgttaatgggggtgtttgtcgcctcctcttatagacaaaacaagccttgaaacaatttttcactggttatatttagtaagtgcatgtgcgtgcctgtgtagattttttacttaacgtagaatgaattactgtccctttttctttactctggagcacatttacgtaaagcacttgccagttcagacttatttagtggttcagccacaatggaaaggatgcctcttgagtttatcttaccagccttcctttccttgtacccctggtgaaagcccagtctgttctcaacctccagaggcctgcttgaaaagacttcagctttagtcacaggggttttatactagct

SEQ ID NO: 528058 - DNA, 659 bp, Homo sapiens
tggcgctccggtgggctgctcgctgcatctctgtggctgttttgtgctctgccacgctgggcagtgctgcctgcgcctttctgcaacctcctcggacctgcgtggtctcgatgctgggtgagcgatgcgggcgtggctggtatgtgctggcctgggctgcgaccggctggctacgactattcttttggccgggtctgtgcgctgatgtgtgtctgtgcttggtgcacgatgtgcactgcttgctctgtgtctgcctgcatgtgctttgatccctgcctgtcacacttccctgtggatgcagttgattgttttgggcaaacttcttgctgcctgtgtggcccttgcggatcctgctgatggctgtggctccgagcctgcttgcctaggcaattttgcaggcactgacctggctgcatccaaaggatgtgaccaagggcagaactatacaaacgcgctgtgaaacacgggccacgactgcccagctggtacccaaaccgaaagcccggcggggaccccctgggtttgccctggctggcattgggcatgggtaacttggagatggtcccgtggggaagaccccacggcacgggagggatcttaagccggcaaagcagagccaaggagggcgcctgagaaggaatcggaaagaaccggcaggt

SEQ ID NO: 528059 - DNA, 255 bp, Homo sapiens
  misc_feature (50)..(50): n is a, c, g, or t
ggtggtgcatgcctcgctaatcccatctatactagcgcaggaggccgagnaggagaattgcttgaacccaggaggcggaggttgcagtgcagccagggattagtgccattgcaccagcctggcaagaagaacaaaactcatctcaaaaataaaatgccaatccaagtcgaatcacctcttgttttaactagatgaatcattactgtgtatgtaggtataaactgttcaccagtaagtaagtgttcacttacaaca

SEQ ID NO: 528060 - DNA, 840 bp, Homo sapiens
  misc_feature (28)..(28): n is a, c, g, or t
  misc_feature (66)..(66): n is a, c, g, or t
  misc_feature (137)..(137): n is a, c, g, or t
  misc_feature (220)..(220): n is a, c, g, or t
  misc_feature (361)..(361): n is a, c, g, or t
  misc_feature (380)..(380): n is a, c, g, or t
  misc_feature (444)..(444): n is a, c, g, or t
  misc_feature (451)..(451): n is a, c, g, or t
  misc_feature (462)..(462): n is a, c, g, or t
  misc_feature (467)..(467): n is a, c, g, or t
  misc_feature (487)..(487): n is a, c, g, or t
  misc_feature (526)..(526): n is a, c, g, or t
  misc_feature (532)..(532): n is a, c, g, or t
  misc_feature (559)..(559): n is a, c, g, or t
  misc_feature (564)..(564): n is a, c, g, or t
  misc_feature (573)..(573): n is a, c, g, or t
  misc_feature (576)..(576): n is a, c, g, or t
  misc_feature (581)..(581): n is a, c, g, or t
  misc_feature (586)..(586): n is a, c, g, or t
  misc_feature (596)..(596): n is a, c, g, or t
  misc_feature (608)..(608): n is a, c, g, or t
  misc_feature (631)..(631): n is a, c, g, or t
  misc_feature (737)..(737): n is a, c, g, or t
  misc_feature (776)..(776): n is a, c, g, or t
  misc_feature (828)..(828): n is a, c, g, or t
tatgattgatgagaaatcctaaatttgntttattccataaagtttaagaaataggtcaggtttggnatctgtttatctccaccaatccctttgttaatcaacacgttgtggatgtgcaaatgccagcaactgttttntttaggaaaacaggcatggcaaagcaatagtcttttccctgggtcacaaactgagcatgtgacagagctgaaaacagcgaaanagatttactgtctggagtcccattgggattctacttcctcaacagggcctcagggcatctgttttattttaaagtactctgggtcataatgacttaattgtgacttttatttaactagcatgttcatgtaactagaatgcncctgtccatgggttttaanatgtcatactgtgctatttttcttaattctgtaggggtaacaagtaactcagtaatgacttaanacttgcnatatattttcnatacnggggtaagggttttgacccnccttccgacgggcgcgttttggcggttggtgttgcgcancattgncaggccgtatgccgggggatgtttgcntccgnggccttggnggngatgnctgtncaggggcctncctcccgcctgntgcttcccccttccccctgattntttgacagttgacagctcatcagttttcttctcacactggcttttttgattgcccattggtaggaatttcttccattaacactgctgatagaagtgtcttactgtnggctcaccctttgctctgcccttctgaggtccttctgcngcttatcttttgtcacttctcctttgtcaactgatctctagtttgtccctcnggtataccaagg

SEQ ID NO: 528061 - DNA, 421 bp, Homo sapiens
  misc_feature (5)..(5): n is a, c, g, or t
  misc_feature (188)..(188): n is a, c, g, or t
  misc_feature (253)..(253): n is a, c, g, or t
  misc_feature (259)..(259): n is a, c, g, or t
cgtantgagttctcactaacctcaccccagtctcagccctggaccacagggtctcttcgcacaagttctaccagagccaccagaaaagaggccttgtctcctccaggagctgaggtcagcaaacaatgtgcctgggaagtcaaactttggcctccaaagctgtttttataaagcacggtgttcctggnaacgcagtccacacccattttgctcccatatgggtctgtggctgtagtttctagctccagtggcnagagcntgagtcactggcgataggagatcgcatgtgctcacataaccctattatatgacccgtataggagggagtgtgccggaccccgtttctagaaagtaggatctcttcattcatcctgggaaaccttcttctgggggattcttctagaagtcgacctgcgaggca

SEQ ID NO: 528062 - DNA, 167 bp, Homo sapiens
tagctgatctcaactctcctgggctcaatatttcccctctccgatgactcaagtgctgtaattataggtgtgagccacggtgcccagcctacggcgtgtttttaggaaccaggatacaattgagcttagtgtatggccattatgtctatttagtctcctttgtgtat

SEQ ID NO: 528063 - DNA, 1105 bp, Homo sapiens
tccaacctgggcaacagagcaagaccctgtctcaaacaataaagagaaaacaaacaaagaagaaagacactattaagtctgggagaatggccatccacatttatgggaaacacgtggctggtcatatctgggtggatttacggtgcgtcgtttacacgaataaatcttcatagagatggaggtaatcccggttatataggagcatggaaactggagggcccttggggagggtggacttggcaagagattctggttggaaggtagttcatcaaggttggctaccaagagtagactggtcttccattggtggtgggatggctggaaactggaaccccaagaaagggttatggtggaaggccggacatcgggcctgggctggcctgggggaccgcaagggccctgggacattggctggaagaacggagatggccggggcctggatggcgttatggcggggagcgggtactccgggcctccaaggccatctggacaggggcggcccggattgcggcttgggttggccttggcactttggaccggtgggaggacgggccggtcctcattggagaacccttcgtcaaccctggggtggctgaaggtagcagtggggtcccaagttggcaacaatcattctaccaccccaggaccatagcggagggttgccattgccaaaggctgggcaataccgggctgtatagcctgggaagaggcgaacacgggacacaagggagtacccggtgggtcgccattggagcagaccccgtggtacttccaaggaacgggtgcccttcaacatgacttctgggagagaggggggcgaccttaaaccaaacctaattcacaacccaagtatacccgaaggtcgggccaaggacactcgagggcagtctccgaaaggagacccacgcacagggggggtcaacaaaacgtatacacaagaatgatgggcacaggagatcacccacgggggggccgtcacaccaagtggcaggaagaccggcagcaagacacagttgtgcagccctaagtgagggcgggagcccaaagaaggcagaacaaggagccaagaggagaatgtgcgacaagcagagagaaagcgacagag

SEQ ID NO: 528064 - DNA, 103 bp, Homo sapiens
gcggcatctgttgacatgcatcacgtgtgtcatgatgtgcttctggaggctcatggcctgcacattgtggcatcatccacccaatccacaggccagagcctcc

SEQ ID NO: 528065 - DNA, 445 bp, Homo sapiens
aagaagaagaagtttctggcttaaaggaggaaggtgctggccattgaccacttgaatgaagatcagctgagggagaaggccaaggagctgtggcagagcatctataacttggaggcaaagaagttcgacctgcaggagaagttcaagcagcagaaatatgagatcaatgttctccgaaacaggatcaacgataaccagaaagtttccaagacccgcgggaaggctaaagtcaccgggcgctggaaatagagcctggcctccttcaccaaagatttgctcctcgcttgcacctgcctccggcctgcactcccccagttcccgggccctcctgggcaccccaggcagctcctgtttggaaatggggagctggcctaggtgggagcccccactcctgcctgcccccacaccccctcccccccagtaataaaaagcccccccaccctga

SEQ ID NO: 528066 - DNA, 133 bp, Homo sapiens
ttcgattgagagatactgaacgaaatgattaaaaagatgatgcaattgcaggcatggtggctcaccgtgtaatcccagcgctttgggaggttgaggaaggaggatggcttgagcccaggtgtttgagtgtcgc

SEQ ID NO: 528067 - DNA, 122 bp, Homo sapiens
tctcacagctactttcagagactgaggcatgacaatcttaaaccctgggcaggtggagagttgctgagagccgggatcgcaccactgcacttcagcctgggtgacagagtgagaccctgtct

SEQ ID NO: 528068 - DNA, 645 bp, Homo sapiens
taagcactgtggaaaactctgtaggctgattaatgaagatgtgagtgagcaggttatgcaggtattaggacctgaagacctccagaggtattgttttaaaagtttacaaagtatcatccagaatggctgggtgtggtggcacacgcctgtagtcccagctacttgggaggctgatgtgggaggatcatttgagcccaggagtttaagtccagtctgagcaaggcagtgagaccctgtctctaaacaataaaaattaaaataagtattatcgagagttcctggaggggtgaaccttttaaagactttcaaaaacttaaaaaaaataaaaaaaacacaaaagacaaaaaattgtgtggggcggcgcgccccgggcccccgaggaaaaggttttttgagaacccattcgcgtggggcggcgggggggcccacagatggggacaatgggcgaaatgtggggcctaaaggcgtggccccaaagaaaagcaccgcgggtcacggcacaacggggcggggatctccaccaaataaaaaaacaccgccgggggggaacacgagagggtttgggaacaactccacagagggggagtcccgggggccaacggggtcctttcaccagagggtgccaaaggagccaaaataaatacg

SEQ ID NO: 528069 - DNA, 859 bp, Homo sapiens
aaatcctccagtctggcaaagactggaatgggagcatgaattggaaacaggtcaagactcctggccataaatagtcttctcactttaaccaagatgtttgtctcatgcattctgacccaagaaggttactagtttccaggaggagaattggtgggacttttcagccctaaatgtgcttaaaggacaaaggaaggaaactcagtcacagaaacgagtggatggaaaaaaccattatgctattttctttttaatgtcatttcaaagcagtaatttggatagatgtcatgttgtttcctatgaatgccatggggttatatctggatgactaccttcctatgaccaaaaactaagagtgacatagtgataaattcacccaggtcagaagtagagtctgggacttttgtgtgtcagtctgctatttaacaccaaggcctttgtcctctaaaggtagaaaagtccaagaggagaaagcatgtgtcaatattattttaaatgacattaatttgatatccctaaatgaaaagaagatctttataaagacctttgtctctctcctgttacttccccatctatctacttttatctttcctctaaaagagctaagatgtgcagtagttgaatagctacctcacacaggatcttaagcagctgtcactgagctgagctctgagccagcagcttgacggcacacatatactctaacatgggttgttcgattttcgcccacgtggtggattgttgctgacacttttgccaatgcttggaaccctgttcaattgctccaaggggggcttcttgggaaactggagacgtgctggttgagccagtctcgtgacatctatggtggcattggcggcgg

SEQ ID NO: 528070 - DNA, 238 bp, Homo sapiens
cccttatattcaaaatgacattgaagaaactcatgtgtgacttaagacatatagataacaaaagtacatatcctggaatggaagaactcaataaatgaaataaaaagcacaactgagagcttcaacaatagactagatcaagcagaataaatgaatttgtaaacccgaaggtatcttaacccaggcagactaaacaaaaaaaaaggagaaagaaaccaagaaataagaaatattgaag

SEQ ID NO: 528071 - DNA, 195 bp, Homo sapiens
tgcagtaggtagtttcatcactcttaaagtattgatacagcaagcacacgatgcctgatgtactagcggtcagagcaggctgtactgctggtgctagagtctcatgtcagacagaaccaggcttttaatgaaggagcagggagagttaactcgttctctgtgttgaccccccttctctgagtctgctcagtccgc

SEQ ID NO: 528072 - DNA, 179 bp, Homo sapiens
ttttagtcttcagctatgtatccctggaaaagagcctgggggccaggtgtggtggcttatacctgtaatcccagcactttgggaggctgagacaggaggatcacttgagtctaggaggtcaaggcttcagtgagccatgatcacaccactgcagcctgggcagtggaagaccctgtctc

SEQ ID NO: 528073 - DNA, 327 bp, Homo sapiens
  misc_feature (42)..(42): n is a, c, g, or t
  misc_feature (107)..(107): n is a, c, g, or t
  misc_feature (116)..(116): n is a, c, g, or t
  misc_feature (186)..(186): n is a, c, g, or t
  misc_feature (211)..(211): n is a, c, g, or t
  misc_feature (240)..(240): n is a, c, g, or t
  misc_feature (256)..(256): n is a, c, g, or t
  misc_feature (318)..(318): n is a, c, g, or t
tgctgagcacccgtctccctgggcccacttttcttcctctanactttgtctctgtgtcttatttccttttctcagtctcttgtctccaccttgcgagaaataccaanaggtgtggnaggcaggcccccttcaatacgaaaaaaatctacatgggcctggactttttttctttaggaaaaaaaatcnccattatctggccaggcgcgaatgntggtgctgcggtcccagcactttgggaanccgaggcgggcggaangcttgagctcagaagttcaagaccagtctggacaaatatggcaaaaccccggtatctacaangtaaaaaaa

SEQ ID NO: 528074 - DNA, 350 bp, Homo sapiens
tactgtgcttcactttatcggtccctccagcagggtgagcaccttcttggaaggtctgcatacatcttagtgactgttcaccggtgggtgctctttgccatcgcggcatcccgctgcgtagggcgccggtcaggccactgaccttcgctatacaggtctctggctgtggagagatcccttgcgcaccactccccgcaagatggtcttcatctcagggatgccagagccgacagcctgaggggccaggatctgtgtgaatccggctgagaaagtgatgaggacaacagggtaggtgacccaggccaggtactggagcaagatgctggtgttcaagccccggtacatgcaag

SEQ ID NO: 528075 - DNA, 306 bp, Homo sapiens
aagagcgagatgggggtgaagctggaggtgtttcggatgtccctctacctcactttccccgtggttatgttctggatctccaatcaggctgagtggtttgaggactatgttgtccagcgtaagagggagctgtggccaagagagaaggagggtcagcgccaggagctagaagaatttaagcagaagatccggaagcagaaagaagagagacttcttcaagctgcccagcagagctcctgagaccttcagttcctcaagtcccagctcccttccccaccacagaaaataacacacactcaactctta

SEQ ID NO: 528076 - DNA, 179 bp, Homo sapiens
ttttcaagaacacttacgttttgaaaaaaaattttgaaagcaaattttaatgtttggtaaaatgctttccagggtaaaaaaagcaaaaatgatttttattttagggcattttaaactttcccccccccggttttaaagggttaaaaaatgttaaaaaaaaatgccatttataaaggaga

SEQ ID NO: 528077 - DNA, 435 bp, Homo sapiens
  misc_feature (2)..(2): n is a, c, g, or t
  misc_feature (5)..(5): n is a, c, g, or t
  misc_feature (25)..(25): n is a, c, g, or t
  misc_feature (27)..(27): n is a, c, g, or t
  misc_feature (187)..(187): n is a, c, g, or t
  misc_feature (283)..(283): n is a, c, g, or t
  misc_feature (294)..(294): n is a, c, g, or t
  misc_feature (300)..(300): n is a, c, g, or t
  misc_feature (306)..(306): n is a, c, g, or t
  misc_feature (331)..(331): n is a, c, g, or t
  misc_feature (400)..(400): n is a, c, g, or t
cngtnttatagacagtcaaacgacngngagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactcncggcaagtacggctacggctacaatggcatggatctcagcgtcggccgctcgggctccggccactttggctccggagagcgcgcccgagctacgcngcaagcgccangcggcngcaccncgaagccccaaggtacagccagccngggcacgtccacgcactctcctcagcccgatccgctgccctgctccgccgtggccccctcgcccggagngacagcaaccacggcggggaaaaaatccctaaggc

SEQ ID NO: 528078 - DNA, 969 bp, Homo sapiens
cgacccacgcgtccgacagatgttgatgaatgtgatgggaaccacaggtgccaacacggtctgccagaacatcctgggtggctacagatgtggctgcccccaaggctacgtccagcatcttaccagtggcatcagtgtgtcgtatgagaatagagatgctccaatcccaatgcctgtggctcggctctgtcgttcctgctacaatcaccctgcgggacgttcacaagtgcgtcctgcccctcggggttctccttcgactcagttctccatgtgcctgcacgacgtggtaactgagtgctcgtcctccaaagaacccctgcaattatcggctgctctaacacggacggggggctaccctctgtggttgcccccctgggtattaccatgagtgggacaaggccactgtgtctcagcgaatgggatttcaacaaggggcagtacctgtcactgtgatacacgcaggtcgatgagtgaaaatgctctgtccccagaagcatgctacgatgtgcaaaatcatacggctattctaacgaaagacagcaggcagaagacaagtattcatgaacctgatcccactgctgttgaacagcatcagcctagagagtgtcgacgatggacagccccgtcaacatgaagttcaaccctctccccaacttcgggttctaaagggaggcagcattcctggaacctaaggggcccgcgcatccaaggcccccttcagagaagcccacccattccggttgatggtcaatctcctccagggtaacggatgacacagccgtcttccggagttccaccacaggaatgggctcagctaatttgcacacgggcccaaaagaagtcatgcccgacatacacctgtgatcgagagtcctctttacgcaaaatagcttcgacacggcaaaagccagggggacacacaaggcagggggaggcaaaagagcgatccgtcaaaccgactggtcgaca

SEQ ID NO: 528079 - DNA, 427 bp, Homo sapiens
aaatagtgacgtaaagggggcgtgctgcgggctggggacatttgaaccggtcgcggcttgtaggagggggacgttggggaggtacattacacgggtttacaagttatggagataaccggcgacgctggttaaagggagcactactttgaggccgcatgttattagtacaacgaatggtatggtgcttaggtttaaacttcaagtcaaagttacgggaccggtttaagcacttagcgcatgggcggcaagggatactatgccgggtattacgggctatatacctaccggcattacgagtacggatattgcacaagcacggacgtagacggctgcggataccaggagaggcatggggcatacgacggcggcgaaaacaggggcaacggcgaaagttgtacgggtacgtggagagaatgcgcctgcgata

SEQ ID NO: 528080 - DNA, 218 bp, Homo sapiens
tgaacattcgtgtcctgcatacctgacacagcttgtgagtccctgcatgtacaccagtcattacaaagtgatcctgtaaagggtgagactttcaactaggcgcaagctagaagacgaggccagagcagctttcatagtaattagcagtgtgggaactgagggtccagtcaacacagcagaggacttcaggtgatgaggggccgtccccaggtggagtg

SEQ ID NO: 528081 - DNA, 561 bp, Homo sapiens
gttgcagactttgctgactgtgctccctgcactccactcaagatagagagttcaaatagtcttgaaggggagtcagcttcaggatggaagtgacccagggagaggccccgaatgtgggagggtactgtaaatacggactacggcgagtgtgcagagctctctgccatgatacttcctcgggactgacgtggctgagaacgtgttctgtcagaggattggttggaactctgccctgttgtctgaaactcaaggccaaggagaatgataggagacttgaggacagagctgacccttgcaccaggctgggaggctgcagcccttttagatgccacttactgtaagtggccagaataccagagaggtgggttccatggtcaaatgcacagtaggtgtttacccttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctata

SEQ ID NO: 528082 - DNA, 411 bp, Homo sapiens
  misc_feature (263)..(263): n is a, c, g, or t
  misc_feature (373)..(373): n is a, c, g, or t
gcggccgcctactactactaaaattcgcggccgcgtcgaccccccacccccaatccgtggaaaaactgtcttccacgaaaccagtccctggtgccaaaaaggttggggatggttttgggatgacactgttccacctcaaatcatcaggcgttagagtctcataaggagaccgtaacctagatcccttgcacgtgcagttcaccataggagttgtgctcctgtgagaatctaattctgctgctgatctgacaggaggagttcangaggtaatgagagcaatggagagtggctgcaaatacagatgaagctttgctcactcacccgccactcacctcctgctgtgtggcccagttcctaacatgccacagaccantaagtcttgggggcctgctgggggttgggggcccctgc

SEQ ID NO: 528083 - DNA, 889 bp, Homo sapiens
gtactctcaaaaaatcatcctggtaattattgacttatcctagatccatgtacaatccagactcttatctgtgagctctcaagaaaaattgtaaaaccatctcatttcagatataaacataaacgagaatccagttcatgcatgtagcatcggataagtgacgttcgtcgttgaataagatgccttttggtctaaccgaaatagggcatacagatgagtcttggatgggaaagtggtaagacttgagtttttaatactgtgcctattctccagacagaacgactttgatgtggctttttacattatgcttgtaagagatgttgcaagggcggatacagtagtcttagatagacaattggttgggagtaagtgttagtcggaaaaaggtgaagatattgatgctgagttatgtgaagcaaattatcttggagagctttgctggtagacaaaaagtgaggaaatgtttcactaaatatattatggtcaatgaaaaaaccggactttagagtacatgtgataaccaagtagatttgtgaacttatctcttgagtacctgattggatcttatgtgacatgattcaacctttaaattgtgggcctagattattagcatgttgggtttaacttaataggcatcttatgctggggagagacctagtggagcctacttcaggattctgcacggggatacagggctggggccttgggaatggccaacttctggtgaggaaaaggaacccaaaccgtgtgggccctggtctaagagggaaatggagagggccccggggacacatggtggggaagacaagtcccccgggaagaagaaccgtggggaaagacgggaccggtacagataggggcgcacacaaggcgggcaacaaaaacggaa

SEQ ID NO: 528084 - DNA, 1206 bp, Homo sapiens
  misc_feature (239)..(239): n is a, c, g, or t
  misc_feature (244)..(244): n is a, c, g, or t
  misc_feature (275)..(275): n is a, c, g, or t
actggtgggttctgagaatcacgagcagcgctcatataggccagcaaccagtatatagcgcaggacagctacaaaccatggactcactcaggaagccgcggtggtagcgccccttcctctgaccagccagcctctggtcaccacgcttcatatgaccagcagtcaggctatgctcaacatcacggctcatatgatgagcagtcaaattatgatcagcagcatgattcctatagtcaaancagcngtcctatcattcacaaagggaaaactacagncaccacacacaagatgaccgtcgtgatgtgagtaggtatggagaagataggtagaggatatggcgggtctacagggaggaggtaccgagggcgtggtggcgcatatgacaaggaggtggaagagtgtcctatgactaggatcaagtgggggtgaccgcggatggctgcaaagacatgatcggtggtcacagggaattatggagccagcaacagatgctgattcagaatcatgataattcagataacaagacaatctgggtgccaggacttggggagggtgtgtctacagatcaagttggggagttctttaagaccaacataggaattatcaagacaactaagaagaccggagataccatatgatagatcttgatacagacaaggacatcatggaagagccaaatgggggaggcaaacggtgtgtcattgtgatgacacctccttcagcctaagtgcaggccattgactggtttgatggaaaagaatggccatggcaacatcattaaagtgtcctttgtcactagaatgatcctgtagattcatgacgaggacggtggaagtggagtgtggggcggcgaggcgtgaaggatgtagaggtcgtggaggcttcagggagaggtggaggacccaatgagtggggattgggttggcctagagcccggtcatgggggacaatatgaactttgctcgaaggagtcctggtatcagtgctgtgagctagacagagtagtctcgtcctcaggaggagattcgggggagaggtcaggggggaaagggtacaggcgggggggatggggaccggggggttgtggacaaggggggttgttgggggaaaagggggtgggaaggagaaaagtggtttggggaaattgggtctttgggaaaggtttggaaagcgtttacaaggttaaaaataaacagatttaattaa

SEQ ID NO: 528085 - DNA, 430 bp, Homo sapiens
ggagagagagaactaggtctcgagtttatgtgtttgtattttttgaaatgttgtaataatttggtattttgatatatcccttgttgttgtgtgttcatgtgtatcccccgagggaacggcgggggccacaagggcgtggggcaaccagttgttgtgctgttgttgtgtgggtcatcagttttactacgccacgcgtgaggcgtcggtgagagtggccaagtgcagggttaagctaacccctaacggagacatggcaccacgatagtaccacgagagtgtccacgaggcgtggccggcgcgtgtgcggagcggccggacccacccatagcgcgcgcgtgtgtctcctctggggtggcgaatggcgctctggcgtggtgcgggttctcgcgaagagagggcgaggcgaggggaactcgcccggggcgagctc

SEQ ID NO: 528086 - DNA, 519 bp, Homo sapiens
ttcaacattctaggagtgtcacttgctacatccccttcatctctacaaatccaaagtatctagtgagtcacgtcagctacatatacaatacatgcgataattcattctccatagtccttaccatgacttaagggcccgtctcagggaccatctctggcctcgtgtacacctcgttctgctgttctcctttgctgtgccagccacgctgggctctgttcacatcaagcagctaagctctgcccatttcagacatttaacttcttggcctcaatctctgaaatgcctgtttgaatttgttaccggaaagctcattaacactcatcaggtacccagctcggtgtcagacaaggctatctaaaatagacctacccttaatggattaaaaatctgagaatatgaaataacaaatatcggatgacattttaggagaccctttatatacctcatttgtgtgtgtgtagtgtgtgtgtgtgtgtatggacatggcgatgggagggtgtcattgcaaagtgaggagga

SEQ ID NO: 528087 - DNA, 163 bp, Homo sapiens
gaggatcccgtatatgctgtctcagtatccaacggggactggttgcaggaatgctgcagacgccaaaatctgcaggtgctcaagtccctgatataaaatggcatagtatttgcatataacctatgcatatcctcccttatacttttttattttaatttttttt

SEQ ID NO: 528088 - DNA, 286 bp, Homo sapiens
catagacacattctccccttgaaggcatccacagaaatgtctcccccttctatattaggagtgcttacaatttccccatctgtttcttagctatatgttcgaatacaccaaaacgttactctcccaatattattgacccacataatagtgaatcatcattgattttctttacgctccaccacatgtggtgaatacttttcatattgtgtgcaaatactaattcgttcatactcaaaaaacttcccatgttgtataaaaacaaaggtaaacaaacacacaagacgca

SEQ ID NO: 528089 - DNA, 135 bp, Homo sapiens
tcggtccgacatggggacacgtgttgtagtcgttaactattcaggaactgaggtaggaggattgcgttgagcctgggaggtcgaggctgcagtgagccatgatctagcctgggtgactgagctagactccatctc

SEQ ID NO: 528090 - DNA, 138 bp, Homo sapiens
agcagctagctggcatagtataatatctagggaatatctaaagtggactcagacaaacttgggacttactttccttccagtcaattcaacagagtagcaactgcatcaatactgcattcataccattcaattgggcag

SEQ ID NO: 528091 - DNA, 177 bp, Homo sapiens
  misc_feature (13)..(13): n is a, c, g, or t
cccggaactgctntggatggagctgggggaggaggaggtggaggaagaaagcataaacaggggcaggggggccgaggagaccagcaccatggaggaggacagggtcccagtgatctgtatttgatgaggaggagccgaggccccagcttcatccgaagcaggcatccaaagcagttg

SEQ ID NO: 528092 - DNA, 386 bp, Homo sapiens
  misc_feature (191)..(191): n is a, c, g, or t
  misc_feature (213)..(213): n is a, c, g, or t
  misc_feature (237)..(237): n is a, c, g, or t
  misc_feature (251)..(251): n is a, c, g, or t
  misc_feature (265)..(266): n is a, c, g, or t
  misc_feature (288)..(289): n is a, c, g, or t
  misc_feature (311)..(311): n is a, c, g, or t
  misc_feature (324)..(325): n is a, c, g, or t
catatgtgtgtgctcgagcaggatcagcggattgacagcgctgcacccagcacggtcggattcaggacgccagtgacaaaaccagtgcatggacaagcagcttccatgcgtgtgcatttgatttttaaaaacaatagcatatttcagtgttaacttacccccctcaaacctggcttgaaacattttccccnattttccaagggaaacaaactnctaccaaaacggtgccgcctgcanggaccccgggcccnagcccctatctggnnaggtggtgctgtgtggactccnntctggggccgacccgggggccnagcacagtggccnnccttcccaggccggcccttcagaaatgcagctttggccactgaccgggtatctgctgctca

SEQ ID NO: 528093 - DNA, 858 bp, Homo sapiens
  misc_feature (7)..(7): n is a, c, g, or t
  misc_feature (409)..(409): n is a, c, g, or t
actgtcngaacgtgactctccgaactacaaccagacaggcgtggaagcgccgtgataaggtcctttctgcgcattcttcctgtaccgaattctcaaggcggtggtgcacctgatttctccgtgaggaatcccctccgtttttctacgcggcaatttaataacgggccagaccaggaactaagtaggctccccacctaattcggtaagcgggaactttcctcttttattagcgaaaatcgccagggtccaaccataaattcgggggtacacagacaccccgatgtgcccttctcccccatattttagcggcggtactttccgccccaaacagtttaagggtccccttatctagaaccccgtcattgcccattattataaccctcttttgggcagaaaatttttcaatcancgccctttctccctccctcaccattatacagggaaaatgctgtccggagaaacctccctccccgagttatttatcctaatcaagatgttctcactaccacgtcggattataatctaaacaactggccccccattatgggtctttcagcccaaacattctcttgcagaccaaaatggtttccaaacacccagattcgtacgcaactgtccccccctaactacgcctctcctaacaactgtgactcccttatgcctcctccccatctacttccttcttaaggcaatgagaatgatatcacccgcccccgtatttacaagatcttctcgggctagtaaatttttttattcaacttgctaactccacgattatccccataaaggtgggcaccccgggaaataatccccccagaaacggaggggaaaaaaaatcaacaagcggcccacataaca

SEQ ID NO: 528094 - DNA, 218 bp, Homo sapiens
  misc_feature (97)..(97): n is a, c, g, or t
  misc_feature (141)..(142): n is a, c, g, or t
  misc_feature (171)..(171): n is a, c, g, or t
  misc_feature (200)..(200): n is a, c, g, or t
gagcggtcatgttacttgcttttactcaaagagctttagaaaggaaaaaaaaatattcaagggaagttcatgggactatttactagtagatacattntatctggctaattgggaaaagtggccacttggtggatggaactnnatctcgatacctctcgtgcctttctccangcctttcaagagacttccacagagtgagnagagagaccgctcttacc

SEQ ID NO: 528095 - DNA, 908 bp, Homo sapiens
  misc_feature (907)..(908): n is a, c, g, or t
tccccgctccttcctccccggaccatggcgttcacgttttcgcgtactttactagctaggtgcctgacgctgtgtgtgccactgtcgcgccatcatcattcattgcgcggatggggaacgttatattgcttatgatgtgctgatgacggacttggcagggaatcctaggtaaaccaggcggtaagtacaccttgaatcgccttggtacttccagatgaactcatccatgctttcttctgtgtcatgtttctttgtgcagcagagtggcttacactgggtctcaatatgcccctcttggcatatcatattggaggtatatgagtagaccagtgatgaggtggccaggatctatgaccctacaacatcatgaatgcagatattctagaccatatagtcagaaggaaggatggtgcaaattagtttttatcttctagcattttggactacctatatggatgatctatgtttggtgagctcttagaaacaaaacagaagaattggtccagttaagtgcatgcaaaaaggcagcaaatgaagggattctatccagaagatctgtcaagagtagctgtggaatctgatcagttactttaaaaatgactccttatttctaaaagctatccacatttgcggggaagacgagtcatatgtcatgtccagaatacgattaaatgggatagtaataataatttaaaggtacccgtagtagaagagtgtaattacatcttaggacaaatacctgtagtgtataatatgaagctatcaaggagaatgttaagaacagaagggactgtaagaaaaataaaacatggagactggagaacaaaagattgagtgaaagatgcaaagtagaaaaataaaagaagagagcatgagactatgttaggcatgtgcgttatttttgttnn

SEQ ID NO: 528096 - DNA, 416 bp, Homo sapiens
ttaaagtgggcaatcagaatacactgactgttcggatgccaacatgtccgtgttctctttccgggaattttaggaggataatactcttcccttgaaggttaagctgaggtacatgaccagattctagcaaagaaatgtgggccaattgggtacaccttccttctaggcctgcgcataaaatcttctccaccctcttctctccctcacccaggaagccagaaacaaaggtctctgaggagatgggagaaccagacatagatccgagtcaccacttggattcaagtcacccatccctcatcagagtatgatgtgagcaaaaagtaaacgattattgtgttaatccactgagatataggggtttatatgttgccagagcatagtgtattctatactgccactcccgtaccagggtaccg

SEQ ID NO: 528097 - DNA, 161 bp, Homo sapiens
  misc_feature (139)..(139): n is a, c, g, or t
tcaccatattggccaggatgatctcaatctcccaacctcatgatccgcctgcttgcgctcccaaagcgctgggattacaggcctgagaaacttctagaacctcaggaagctgcagctggagggctggggcacctgcccncctgctccccacacatcatatc

SEQ ID NO: 528098 - DNA, 1063 bp, Homo sapiens
gcccgcttaaagctcagcttgccactgtcatgataacagggatgggtggtgtgcacatgcagaggctcacacattgtcaccattcacgcctctagaatgctccccgtggggcacgaaggcctggggacatgagtgtccttgaggtttatgttacaagggcatagacttataaaacatacctattcaaagatttcatcccgtcctcaatgtcgacatgagactgcgtgatgcttatgtgaagagcgcgtatgtttccacaagacaagctaccgatgtagtacgccagcggagtgccgtggacccaggagctggcctgtggagccagcgttgtccccgagctgctcgcctgtggaccagtggctccttttctgaggctcctgactccattcttgcagataactggtggatcaggagcttacattctaaatgctacatagaggtgttgaagaacatgacataaggtactgtaatagtggatgggatgaaaagataaaaaggtaaagtaatcatatatattataaggcagaacggaagaggatgcatacgagaaaaacacaaatagacagagcactcggagaagccgaagagaaaggaaagaagagaaaagacagacacacacaggcaacaccaagaagcgggcgctacaagccagagaccaaccaaggcgcaaagtcgatgcaacgcaggcaggacggaacacactacagaaacacaaaaaccacacgacccaggaggggggcacgacacaacaacaacccacaccagagggagacgacagaggagagaaaggaagaagcagcggccgagacagaagaaggagggagcagcacagaagcacgcaaccagaggcgaaagcaaacacgggaggaaggcagagagaaagcgagcgggagccacagcacgcacgccagagccccaggcggggagaaccacacgagaccacgacaaggaccacgagacacaaccagcaaggcccgcacagacgcagaagggaagaaacaggacagaacaaaagcgagagagcacggcaaacacgcaggacggccaaagagaggagagaaag

SEQ ID NO: 528099 - DNA, 202 bp, Homo sapiens
gtctcggctcactctaattccgcctcctgggttcaggcaattcttctgcctcagcctccccagtagttgggatgacaggcgcacgccaccacacccagttaattttttttgggtattgttagtagagactgggtctcactgtgttggccaggatggccttgatctcctgaccttgcgatccaccttggccttggcctattat

SEQ ID NO: 528100 - DNA, 860 bp, Homo sapiens
gaacgccggggcagagtcttaaaaccgagggcccgcaggggtccccgggcgccggatgcagaaatacgagaaatgaaaagatggggaaggcactacggaactgtgttcaaggccaaaaaccgggagactcatgagatcgtggctctgaacgcgggtgaggctggatgacgatgatgagggtggtgcgagttccgccctcgggagatctgccttactcaggagctgagcacaagaacatcgtcagggcttcatgacgtccttgcaacaggggaaaggaagctgatttgtgggtttggaattcgtgtgaacccagggacctgaacgaagttatttgaccagttgctaatggtgacctcgatccctgagatttgtaacagtcatccctcttccagctactacaaggggctggggattctgtcaataagccgcaatttgttgttaccacaggggaccttgaagccccagaagctggttaataacaccagggatggggaaggctgaaactgggttgattggacctggctcgacgcttggtgattcccgtccgtgttcactcagttgcaggtggtcacacttggtggtacccggcccacgcggattgtcctctttggggagccacgggtggtacttccaacgtgcaatcgaaattgtggtcacggcggatggcatctttggagaagttggacaatgctgagcagggctatttataccggcattgatggcgatgacagtggagaggactccacatgtggggaagcccacgagggatggcctcttggcacaggtgcagattaagctacgattgtccggccaaatccgggaaggtgccaaacatggaaggggatgtgtgaattgagtag

SEQ ID NO: 528101 - DNA, 364 bp, Homo sapiens
tagagatcccctctctgtcctccatcagtcgctgaggattctccatccttggtttacagaattccttttatcacactatataattcattatgaatagctggtaagatgtccaaggaaggtacagaatgagcatataggaggccagcttaacaaggcaggaatgagaggacaagagaataagacaaagaggagatgagagaagaatatacacgtttagcacaacagatgtgcagaagctcacctacccatatgtcattatagcctcgctgtgtaatcgtgtcagaaaacaaggcatactgacacatagtgctctacttcccatccacttaagttctaggaggtcagtttaaaagctccctgggaa

SEQ ID NO: 528102 - DNA, 109 bp, Homo sapiens
cggctcatgtctacgatactcaaagttatactactttaaccttcatttcatgacacatcaatttcatgtattatataatcatttaattaaaatcttagattatcctcat

SEQ ID NO: 528103 - DNA, 450 bp, Homo sapiens
atagggtgtgagagtcagtatatgtttgggattttttagagtcgtgggtgttcgagcttgaacgctttctttattagtgcgctgcttctacggcctactatgggtgttagattttttactctctctacaatgtttattcctagtgttcaaagatctgttcctcttgtggactaacagtttaatttacaacgtgatttagaggtgttctgtgttgcttttcatcaagaactaagattctatcttggacaaccagctatcaccaggctcggtaggtttgtcgcctctacctataaatcttcccactattttgctacatagacgggtgtgctcttttagctgttcttaggtagctcgtctggtttcgagggtcttagctttggctctccttgcaaagttatttctagttaattcattatgcagaaggtataggggttagtccttgctatatta

SEQ ID NO: 528104 - DNA, 864 bp, Homo sapiens
tcgccctccctgtcaactgaactcattagccggcacaacgagagactaagaggcaaccactgcgcgaattaatcacttaatggagatttggcatcagcaaccattcctgaagaaagcagacttatggccaaaaaacaatctgaatcagaagatactcttccatccttctcttcctgaagaaactgaagtgtccaacttcctctaagtattgctacgcaaaagctgctgcaattaaactattgttatacggagtagtcttttcccttcagactctgcactttatggaatgttgcaaaacagacgaacaagaaaacaacacccacttactttcgcaagggtattttatctttatatagcgttgtttgcacaagtatttaccctataaacctcaccaccaagaacgggcatactctctttttagacacctagacggcgaaacatactagccatccttacggacaaattgtagatccttctgcttgacaactgttgatgggactagcaccctgagcacagggggctatcagccccaataaccccgtattcttctaaagataacccgtcgacgaaacttgctatctccgtaacttcgtcgtaccgaacacaatgacaattacattcccagatcaataatggcttcatgatagagtatagacagcaacccgaagtgtactacatatcaatccagaggcatgctcgcactcatatggcgagccatgccctccataaccatgagtaccgcaccatcatttgacgacgtgcggcatgccctccgacattcatacaccgcccccccacgtgcagtctcatccgagcaatcgccgctcggcagatcggatagacccacaagcgtccgcataacgg

SEQ ID NO: 528105 - DNA, 375 bp, Homo sapiens
cacaaggtaggaggtgaagctggcctccatcgaggcgcattccacagatgacatctggtctctgggccatgatgggtcattactgccattgcgtttatagacgcctactttgctttcagcccccttctggtggcatcccagggtttaaagtgaccaggcagctagtgtggggagacgggacacagctgtctgaggtcagggggtctgtatgtgcctctccggcagggaacagcctcggccgtcagaagccaggtttcagcatttaggatgcagccaacagccaaattgctttcttggttttatatataagggctttttttggtaccataagggcgggtggacagggctgcctttgcttcctggagggtctggttc

SEQ ID NO: 528106 - DNA, 858 bp, Homo sapiens
gcgcgtcaggggtgcgaggtacaccgggataaccggtaggacccattgatggagacgccacccgggcgcgtttgccccagcccaggacgttggacaggaccggcacttccgtagcttttaaagcgcctcgcgattagggcccaagtgtggccacgagagaaggctgtcgatggcgcggtaagacacgaacgcgccgtcggagggcagtactctacataaggtccgccgctatgacgacgggggtacaacctccgaatggtggcgccgagatttacccacagagggatctcagaatgcgcggcaaataagggcgcaaaaattcaaccgtgggagcatatagggccttcccaagagggtacgaaccgttggtagagagaggtagtataacaatagattatggagaaccccggagaaatgtgaattgtgtgctccttgggggaaagaggcaacttttgtgggccgaaaaaaatgaagttatttccttaacgagcgccgaaaatgtgtgtcgagttggaaggtgaaagcaggggggacacaccaattgtggtcgtggacaggaaaaacacgtttggaaatttgaagacgggtctgtgggcaggagacagaaggcgcaaaagaggccgggacttgggagatggggggccccatagaaaaagtttcatataccctgatatccacaagggaggaatattcagttgccgagaagggaaaataccatctcgcgaaaggaaggactgttgggatagaaaaagttaggaagttgaggggggacagaaagataagggggtgaagggacaattggacaactatgtggcacaaaactgtagagaaaatggtttgggatgggcaatcgtatca

SEQ ID NO: 528107 - DNA, 132 bp, Homo sapiens
aatttgaaacaagaaatattaataccatggggagaaccccaacaaagaaatctgaaatgtatgtaaatgcttttttttccgtttttgttcattttggatgctggtgctaaccttccaagtgtccatgatttt

SEQ ID NO: 528108 - DNA, 145 bp, Homo sapiens
cacaggcatcatccaatctcaaccccagtctcaccatccatgttgtctctccatcttgctcgtccatcagcacacattccagtgctccacatccagcacacccagcatcatgcccagcactggcacacacagtgggcagcacaca

SEQ ID NO: 528109 - DNA, 155 bp, Homo sapiens
cccggatgtctcggtacaatgactttccgatccaaagaatcatcatctttaccttgacttttcaggcaattactgcaatctttcttctcagaagattgggctacagcccttgccttggcctcacttttagggtctgcattttggtcctctggctc

SEQ ID NO: 528110 - DNA, 500 bp, Homo sapiens
  misc_feature (56)..(56): n is a, c, g, or t
  misc_feature (72)..(73): n is a, c, g, or t
aggtcgattctagaggatccccatggcgctgatgacacggtgttgtccgctcgcanatcatcaacgacctgnnactgggccgtaacatggacgagctgctgcgtctggtcgacgctctgcaattccacgaagagcacggcgaagtttgccctgccaactggaaaaaaggcgacaaaggcatgaacgcttcgccagaaggcgttgctgcctacctgagcgagaacgctggcaagctgtaattgccactcgcataaaaaaaccggccttcgtggccggtttttttatgcctggacttcaaggcttccagtgcctgtcctggctctttgctgctcctacaggagtgtgcattcccctgtaggagcggcttgtgtcgcgaaagggccgcaaagcggccctggatttcagatcaatcgttgaaatcacgccagccgccatttccttccagcggttgacgatgccgcagaacagctcggccgtcttctcggtgtcatcagcgccat

SEQ ID NO: 528111 - DNA, 157 bp, Homo sapiens
actcgcgtgcacatcatggacactggcttcgcggctgcgtgacatttcctacaaatgcatctgtgtgagatccgcgtgcatatctctcctgtactcttcagagaagaaaatcttcattgggctcatcccccataacctgggcaagtttgtcaacggc

SEQ ID NO: 528112 - DNA, 113 bp, Homo sapiens
aaaattttttttttgggttttaaacccttggggccttttaaaagcccatgggtttggtcttttttgtgtaaaggggaaaaatttttttttttaaaccccaggttggggtgcca

SEQ ID NO: 528113 - DNA, 232 bp, Homo sapiens
gattagaggatggtgtagtgatctcctctgggatgttgaatttgagtgttagggttggtcttggccagatgtagacagttggtccactccctgtgtgcccatagggttctggtcccccagtgagctccccatcaaggctgagcttggcaggagacagacgcctaaggagagggatttccaacgcaggattaacggttgaggattaagcccggggcatgaaacaagggtcggg

SEQ ID NO: 528114 - DNA, 670 bp, Homo sapiens
tatggataatttcacttaactttaaagacatatttggcacaaaaccttggtttaaagatctgcaatattatttatatctaaactactattactaagataacgagaaacgtgtagtgtgcgagggcaggagtattttggtattagaagaggcctattacaaacaaacaacgtctgttttctgacactacaacgaggacccaaaacagtggcacacttttggagtgccaagctcacgacaagtgctgtccttcacctctgtaacagcaaaaaatttcaccaacagcagcgggttacacgtccactttatcctacacatgtccgagattttcggcccctattcttccaactactaaatatcgttcacgtcgcatcgctcgcaccggaccacctctcctcctcgcgtcctcgtccgacgcactcttaacgcgacgcacaactgtcccgccatttccccgaagctcgcccgtgaacggcagcacgtggtgacgccccccgtgcgatcctctgcacgcagcctgcgccttctggcccacgcgcacgccggccggcgctttctcccagaggcggcccacgtgctcccctgccacactctggcgtcccttctggccctactgacccggttatccaccacgtcctctattccctaccgcacgccgacacctttccccct

SEQ ID NO: 528115 - DNA, 247 bp, Homo sapiens
ggcagacattcataaatgcagaaaaagcatagcatgcataataaaaaatatatgtgtacctacaattaatcaatgttcatcacagttttttttttattttaaaaggcagggtctggctcttgtcacccaggcggaagtgcagggctgtgatcagggttcattgcagccttgaactccggggctcgggcaatcctccggcctgagccttcggagtagctgagactatcgattttgtattagggtaagg

SEQ ID NO: 528116 - DNA, 191 bp, Homo sapiens
gatccttcatacccagtcgcagattgacacgtgcatggggaatgcccgtcgtggtgttgaatgccggcaacaatcggtagcctagctcgcgtgccatctcaagcatttcacccttgtaccagtgcatcacatccgcctgtttctgcaggtactccctcggatagcacagttgcctaatcactagtgaattc

SEQ ID NO: 528117 - DNA, 741 bp, Homo sapiens
ggggcccgcgttagtgcctcctgacgcggcccccggatgaacgagatctgggaacccgggagccgaggataacgaagcagctcggtgcgcaaggggcctgactgctgcttgaggcctcttgctaatattcgattttacacacgagcatgactatctgcagttatagacccgggctgctggtgcatacagtggaccccctgagatcccagactttagtggcgtgccgtcatcaccaatccaccttcaataccagctctactgtcaatgttggtttggcacgactgaggaacgacaaagaccctgcaagctcgagcagggccttgcggatccccctgacctggcctgctagctctctagaggtcctcaccatcctgctcctgaagcttcctgcttgctcgcagctgcttcacgcaggccatgctgagccagcccaggatggagagcctggacacccccgcggcctacagcctgggcctcgcgctcctgggtagtgggcgtcgtgctcgtgctctccagctgtctcttgcactggggttcgctggaatctttacctaggttgattacttcgggatcctcaaggaggcgagagtgaccgtgtaccccttcaacatcctggacaacccatgtactggggaagcacagccaactacctgggctggccatcaagcacgccagcccacggtcctgctcctgacggagctgtggcctcactacataatggtctctattcgagagcctacc

SEQ ID NO: 528118 - DNA, 300 bp, Homo sapiens
gtcgcttccccacagtgagaaagcagcacaagatctgggctcggggactctatttccctctatccgaaacataactagttatgtatgtctctgagttcctagttataatgtcttggctgagaaccacagaaaggactagatattcatacatgcgagagagactgagactgcatgttaattgggcatattgctagacaaaggtccgcaaagaactgccagaaccaggcctgtagccaagttaacgggccatctagtacctctcacgaattgcaagattgtcggtatcagaggaatcttggg

SEQ ID NO: 528119 - DNA, 559 bp, Homo sapiens
  misc_feature (171)..(171): n is a, c, g, or t
  misc_feature (559)..(559): n is a, c, g, or t
ggctgttccgcccctctctgtcttctctgcagtgggagcagcttctcctgtgccacagttccttcaccccctgtgaaaattgttcgccttgcttccaagtttggtcttccacttcccttccttgtggttcaaggaagcaccttcaacagcttgctgtgagccggttccgcntattctgcagtgtggtcgctgaaacggaccgggaggattacttgacaggattagaagagccttcaggcagcttgtggcaggctcttcatgttgttccccttataccttacacttgtgtcttcttaggccggcaggctttccacaaaccagggcgccatttttcaagggggacattcggaaccacaagcaagcccaaatgttctattggcgacgtctgggggctggccaacaagttggcgggtgcgcttgggatctcctggggcgcttgggagatttgcgagaaccttggcgtgtctcggcgagaacgcctttcattccatttgcgcgtatatttgcccaaggagaaacccccttttcctccgtgaagcgccaaaacaagcttcttccn

SEQ ID NO: 528120 - DNA, 808 bp, Homo sapiens
ctggtgcttattcttttttatgtgcagcgggagagagcgggagtgtgctgccgtgcgagagtgggagtgcgaagggggcaggccagggagaggctgcaggagcctttgcagccacgcgctgcgccttccctgtcttgtgtgcttcgctgagtgtagacgctgggctgcgctgtgcagctgtgctgtggtgattacttttgcttgctatgtttcgcgttcgcgtgcagcgggcgggtgtagtcctcgtgcggccagcgggcgtgaggacactagcactactgtctgtgagtgatgcaggtatcgtgcaggtgaaggactgcgaggctgcgctgtgaagactgagcaccctgtgcggtgccgtgtacgcgctgggcatacgcgcagcggctgagcagcgctggggacgccattgtgttggagcagggctgacaccacgggtgcgccacgcctgagctgagcaggtcagggcgaatcctggaccccctgggcgaacccggttggggtagctgggactaccccgccttgcttctgggcacttgccaaccccgacaaggggtgggcgccatgttgctctcgactttcccgcgactccgtttcggccggaacccacacttcgtacccgcccctggcttacgcagaagctgacgcacacgctgacttcgaatgtggcgaacatacttggtttacaatcgcgggcactggccccttactccttggtgcacctcattaccatattcgaccctcgacttcctcgtcctgcgactttcgctcttttccctacctacttctggcgtgcacagttggatcc

SEQ ID NO: 528121 - DNA, 1126 bp, Homo sapiens
cgtgccggaacccaactaagctgcttcgcctcggacgtcttgatatgcccgtaactctaacgcatgtggcggtctccgtgtgctgggcgtggtccagtgactagaaggcgaggtgccgcgggacccatggcggcggcgtgcgccgtacgacgtcgaggagctccagaggaccgcgtatgaagacgacgaagaggaggagcagtcggtgctgggtggaatcatcaggaattacttgattcacgcacttcctctcaacatgtgtgaccatagataacattgcagatggttctctggtgcacttgacactgatgcaggcccattctgcaaggtgtgcacatgcctgtgttctttgctggggaggtattgataggatcatctctagaggacgctgtgttagtactttgagacgaacacactgttcgacaccagtgcttgatacagtacaggcaactatattaaaaacacgatgctaaataatactaagaatgccattaccacattgacagaaagctcagcagtgattccatgaagctctcctgaaacgggagataataaaggtaaaggcagaagaaaaacaccagtatgggtgcgcgcgctgcgcacattgggcctgtctacacattgcacgagggactaagtgcactatgtgctgcctaattcgatctcccacaccatgcaattctcgttcacaaccttttacctaaccacctggtagaaagttgcaacgtaccgataggcacagctgcgttcatggcctcttcgaggtcgcccgctaggcatttaaagaattcctgttcgggaatacttggggtacatgcaaggcgccacatgaagccaatttccagattagttgtaaagccggagcaagcttgttcaaccaactgcgtggaagtttagctggagaccgcgggggaaggagaagccaccaaattgtgccagcgttgggcaataaaagttaggaacaggaacttatcttggtgtgcccttcctgtacttttgacgttattaacccctttctttgaaggaaccaaggcaacaggggggttcctggatcctatttactcgggaaaaaccttcctaaacctggccttggcccttttaccaaaaaacttcaactctcccttta

SEQ ID NO: 528122 - DNA, 425 bp, Homo sapiens
ccaaggcggaggcagagagattccctagcccagagacagacggttcgtgtgggtggaggatcaaggagctcagggatccgagatgaaaggaggtttcgcgagtcagggtctccaggggtagaggggtcagagatgaaagcggggtcaggggccccaaggaggagggtccgttgcctggggaatgaggatccgaggtggaagggcgctccagggtcggtgtctggcgcaccgagacgcctgttgtcaggccgggagcctcgcgtcggagtaggaaaacttttcgtcaagttccgtaaaggagcgtgacacagcgtgcgccgccgcgagggccaccgagtcccgagagtctcccccgccccggaggccccgtaacggcaccccgggcgccacgcacgcgattccatggcgtgcaggagccgcggccg

SEQ ID NO: 528123 - DNA, 247 bp, Homo sapiens
actggcggcagtgtgtggtctattcttccagtggggtcctccatggtggcacagggtcttctgtttttcttgtgggcagtgcattccctttgtgctgtcccaggcagccttccttcacaccctgggctttggcacctgcttggtcgtccgggccaccattggctttgccctgcacctgcagctccagtggcactcaagccactttgtccctatcactggctgcataggtcacatccttgtgggtcaa

SEQ ID NO: 528124 - DNA, 910 bp, Homo sapiens
  misc_feature (14)..(14): n is a, c, g, or t
  misc_feature (16)..(16): n is a, c, g, or t
  misc_feature (36)..(36): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (62)..(62): n is a, c, g, or t
  misc_feature (73)..(73): n is a, c, g, or t
  misc_feature (81)..(81): n is a, c, g, or t
  misc_feature (91)..(91): n is a, c, g, or t
  misc_feature (101)..(101): n is a, c, g, or t
  misc_feature (107)..(107): n is a, c, g, or t
  misc_feature (162)..(162): n is a, c, g, or t
  misc_feature (206)..(206): n is a, c, g, or t
  misc_feature (217)..(217): n is a, c, g, or t
  misc_feature (219)..(219): n is a, c, g, or t
  misc_feature (246)..(246): n is a, c, g, or t
  misc_feature (260)..(260): n is a, c, g, or t
  misc_feature (268)..(268): n is a, c, g, or t
  misc_feature (271)..(271): n is a, c, g, or t
  misc_feature (313)..(313): n is a, c, g, or t
  misc_feature (315)..(315): n is a, c, g, or t
  misc_feature (338)..(338): n is a, c, g, or t
  misc_feature (340)..(340): n is a, c, g, or t
  misc_feature (344)..(344): n is a, c, g, or t
  misc_feature (352)..(352): n is a, c, g, or t
  misc_feature (367)..(367): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (404)..(404): n is a, c, g, or t
  misc_feature (421)..(421): n is a, c, g, or t
  misc_feature (423)..(423): n is a, c, g, or t
  misc_feature (437)..(437): n is a, c, g, or t
  misc_feature (439)..(439): n is a, c, g, or t
  misc_feature (444)..(444): n is a, c, g, or t
  misc_feature (453)..(453): n is a, c, g, or t
  misc_feature (467)..(467): n is a, c, g, or t
  misc_feature (478)..(478): n is a, c, g, or t
  misc_feature (499)..(499): n is a, c, g, or t
  misc_feature (504)..(504): n is a, c, g, or t
  misc_feature (508)..(508): n is a, c, g, or t
  misc_feature (563)..(563): n is a, c, g, or t
  misc_feature (602)..(602): n is a, c, g, or t
  misc_feature (615)..(615): n is a, c, g, or t
  misc_feature (654)..(654): n is a, c, g, or t
  misc_feature (671)..(671): n is a, c, g, or t
  misc_feature (673)..(673): n is a, c, g, or t
  misc_feature (685)..(685): n is a, c, g, or t
  misc_feature (688)..(688): n is a, c, g, or t
  misc_feature (726)..(726): n is a, c, g, or t
  misc_feature (741)..(741): n is a, c, g, or t
  misc_feature (743)..(743): n is a, c, g, or t
  misc_feature (799)..(799): n is a, c, g, or t
  misc_feature (815)..(815): n is a, c, g, or t
  misc_feature (846)..(846): n is a, c, g, or t
  misc_feature (888)..(888): n is a, c, g, or t
tgcaagtaaaaaananttattgctattccaggcttnaaatgagcncanaantcagggctggngtgtgtttcanaagttgtnatgatgtaanagggtggtanaaaaanccaggcagtttgatgtcgaggccaccctctcttccttggacccctgctccaaaancagctgctggtgaggctctttcccatctgcctcattcacccaanaggactccaanantgaggcaggcagccttgtgatccccanagctcaaaggtganaggctgcncanacctctcctagcactggaagagccttgtccttgggaccgganantatggctttggccctgtggagananaaanggtgccanaggagttgtcttaanaggacaaggcatgcacggtctganancanaggttgtnacgtggccacccatgancnagttcgtttgggananatcanactgcacanctttttaaaaaaanaattagctgcnaatcttttaaaatggtaaaanttcanatanaaatctggatttttggcttctctaggagtaaacattgaaactttttttttgaganagagtctcactctgtcaccaggctggagttttgccagtntctggcagttgtnttcacagactggctatgcactctccaactgactccagtncttgccacccttaattntntttccaactggngancaggcctcagcagccttgtatcaatgggcacatgtgcngtgactttctgtgtnanaaatatttacattgtaatagcatctttaatcaaaaaggaaaaatcggctgggtgtngtggctcatgcctgtnatccagcgctttgcaaggccaaggtggacanatcatgaggtcaagagatcgagaccatcctggccaacatggngaaaccccatctctactaaaaa

SEQ ID NO: 528125 - DNA, 198 bp, Homo sapiens
ctgagaaaggtggatctgtctacccaggagtttgagaccagcctgggcaacactgtgagaccccatctctacaaaacatgcaaaagttggccggccatggtggcatgaacctgtggtcccagctactccggagtctgaggcaggactgctcgagcctggggaggcaaaggctgcagtaagccaagatcacgccactcc

SEQ ID NO: 528126 - DNA, 641 bp, Homo sapiens
aaaaaaaaaaaaaaaaaaaaaaaaaaaaaaaaaagggggggggggtttaaaattttccctgggggggcccaatttagggttaccccgtttttttgttaaaggggggcccttatgggggggggtttttaaagaaaggggggggggggtttaacaaaaaggcgtggtgaggggtggggaaaacagtgaggctagacgtgtgggagacttcttggggagaagagaacccttactcgtgtggggggggggacacacatagtggggaaacacctctccctaagcagaagattattaaaggcctctctagcgggggaacctattttactactttctacaggggggtctatataggtggtgttacaccacacggtggaaaaatatgtctggcgggcgcgagagaaagagagtttgtgggcacgcagcgggggagactgaattgacaatttgtgagaaacaaaatttttttatatacgccgagggagccaagtgtaataataaaaaagcgaaccacacagaccaactccacacctacgacaacatcacccgctacgatgcaccatcaacactcctgacccaccatcctcaacccccaccagcccacccccccaccgcaccaccgccaccacacaaccagacagccacca

SEQ ID NO: 528127 - DNA, 300 bp, Homo sapiens
gccacatttctcttaccaaccatctgcatctcccactgtcttttctttctgatgctaattccttccacgggatgcttcttttttgttttcagacagggtctcgctctgttgcccaggctggagtgcagtggtgtgaacatggttcactatagcctcaacctccctggctcagtcaatcctcccacctcacctcctacaggcgtgggccaccatgccaggctgattttttaattttttgtggagatggggtctcactatgttgcccaggctgatcgtgaactcctgcgttcaagcagttct

SEQ ID NO: 528128 - DNA, 168 bp, Homo sapiens
agctctgtacccctctaaagcgcccatttaaccttttttaaaacaacagcttaaaagctttttggataaaaagcttttattactacatctctgcatcttctctccggggtctaagaaaagggctcaaattcgcggagttgagaaacgagaaaatccaaataaagcgaa

SEQ ID NO: 528129 - DNA, 417 bp, Homo sapiens
cctggaattggagctgcaggcaactaaattttttacttcacagacctcatcagaaactcattttacttaaccctttatcattaaaatgtaatcctctatttaacctatatcattcaaaaatatatggaacccggccgggcgtggtggctcgcgcctgtggtcccggcactttgggaggccgagagggacggatcacttggggtcaggagttcaagacccggcttggccggcgtaatgaagcccggtctctactagaaatgcaaaagattgggcgggcatggtggtgtgctcctgtaatcccagctactcgggaggctgaagtgggagaaccgatggagcccaggcggtggaggttgcagtgggccgggatcgtgccgctgcactccggcctgggcaacggagcgagactccatgtca

SEQ ID NO: 528130 - DNA, 271 bp, Homo sapiens
gcttgctgtgcggttggtgcgcgtaagcgggctggcagcgcctgcagcatggcgacagcgttgtctggcgctatgtgttcgacccgaaggacgcacccgcactgcatcgacaggcgatgatcgatgcgaccacgcgggcgttggcctccagtacatcggcgaatgcgtcggtgatgcaacccgtggcaggctcacgctggccgtggtggctggcgttcgtgttgtgcgcatcgctgctgtggtggctggaacggcggcgctgaccgcatcg

SEQ ID NO: 528131 - DNA, 174 bp, Homo sapiens
cctaaaaaaaaaaccaaaaaaattagccgggcgtcatggcacacgcctttgatcccaggtactctttaggctgaggcagagaattgcctggaccggggaagcgaggttgcagtgagccaggatggcgccactgtactccagcctgggggacagagcaaaactctgtctcaaaaa

SEQ ID NO: 528132 - DNA, 190 bp, Homo sapiens
cgagagcagtttattagagatgaatgcattttaaggccttgcatttgatatgtcatccagttcatcatcaagttgcctgttactggctaacaaataatgcttatgtattcttctcatttggtcctgcaagcgtgctgatcctttgtacctccactgtgggaatcagatctagagcaaggtgaggctggtg

SEQ ID NO: 528133 - DNA, 164 bp, Homo sapiens
tcagatcgaatcgagctgtgtaccttctccgggacgtctacggtgacttcattctgcggacttactctgctgaaagctcagctggggtgtgcaagctagggacccattcctgtgtaatacaatgtctgcaccaatgctaataaagtcctattctcttttatgag

SEQ ID NO: 528134 - DNA, 1183 bp, Homo sapiens
atcagtgattatctttttctaaataaaatatcaccagaattcatcagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaagaagggacgcgcgggacgcacgataggcggacggggagagaaaggcagggacaacgagagaaggagcggaccagggacgaaaaatacaagagcgaggcgcgccgcaggcacgaacagcaacaagacagcaaggaacgaagaacgacagaagagcgagggcggacgcacggagcagacaacgaaaaaaacaaacacaagagaagagaagagcaaaacgagaagaagagagaacagagaggaacaacaggaaacaaacaagaagaagaacaagagcagagacaaaagaaagaaaaggaaagagaggagcagaagaaacggcgagcggacgcgagacaaagaggcagcacagggggggggggacgggagagagcgagaaaagaaacgagagaggccgccccacgggagaggaggagcgacagagagaaagacgcgacagaaagagagagaggcagaggaggagagggcggacaccaaacgaacacgcagagcgagaggaaaccgaacgcaagagcgcagaagcaagcgaggaacagaaagagagaaagaaaagaaagaaaaagagaggagaagaagagaaaggagaaaagaagagaagggaaaagagaaagagagaagagagagaggaaagacaaacgaggaagcagagaagagagagaaaagagagagagaaaaagaagaaggaggagggacggaaggagaagacgggagaaggaggaggaagggagagacgacgagagggagagaagagaggaagagaagggaaggagagaggggaagacgagaggacgaggcgggacgaggagaaggaagagaagacggagccaggaggcgacagagacgaggggacgcagaagaaggagcgagagacgaagaggggagaggacaggagcagataggaggaagacgacagagaagaaaggaagagagaggagacgaggaaaaggaggaacggacgaagagagagaacgaagagaagaagagaaga

SEQ ID NO: 528135 - DNA, 903 bp, Homo sapiens
accaggacagtgccatctgcagtgacccagttccaggacgaagtttacaaacacctcctggaacgaagctcccgcctgcatgtcaccttgatgggggctgatgagctgggcgtcagtagtgatacccagtgactagacgcactctgcgtcttcccgtgtatggggctgaggcctgctggacagatggctggccaagtgggagccagaccctagggagtttgcacctcggactgggacgaattcggaccggctctgtgttcactacgactcagaatagcctggctagcgttctctgtcgtccgagagctggaggtagtgggaaccaagcagctggagctggagagttggtgctggtaaaacagtccattcccctggggcccggttcttacccaggtccagagaaaccaacgcgggcatgtccgacttcaccaaaaggacttcctggttgcccctggactggcttcctggaggcgttcgcctctagtttctcagggatggagcgagagcccgagctcagagaacagtaacgaggagctgctctccatatcttgcaactcagccaggtgcttcacccggacgtttaccacggagtgcggctgagtgccaggtacatgctaggtccgcgtccctcaagtcgttatccatcgttctgcaccgtactatccgtgagacctgggaagggactcccgggtcatcagcttaggaacaccggttgtacacgagaacttttccctagggaaaccggttcaatggtgtccacttttcaaggaatgtgagacaactatttggagccattacaaccctcgcactggctttgcgtgcatgggagttagcagcgttggctgccacttggggcaccttggcacggaacctggaggtctgcgagaccaacgtgtatgccca

SEQ ID NO: 528136 - DNA, 862 bp, Homo sapiens
agcgggccgtctttcttttactgacacatgaccaatcatatggtattcttcaagggcacactctctaagcattcatcttctctcagctcttgcactagctagaactaggttaacggaacgaacctccttctcattacttgcccctcgctgctaaacatcactctcctgctcacgaacaatgctgctctccactacttcaactgacaacaacaactactcccctctcctccaaacccaccttggttagccaaggaaacaattccatctctccacttctccgctccaactggaattcaagctgcacacttaactgctgcaattcgtggccctccccacgcacttccgcctccacacacaggggacacaccacgcttcaacgccacttcctccccaccgctaccaaatttcccatacaacacccagttggcttaaatgtaacaaacccccaggctctaagaacacaccactccaaatttgcctttaacacccgtttaaacccaacccagcttgccgcatgcgccctaactaactccgcacacacacccccttcacaccggcccaagacaaccgcaccaacagacaccagcacgcaccacttggttggcaaccagctctaccacacccctttacccctccccaccaaccaaccaaccccttcagccgtcctcgacctcttccacccggccgggtttctcaccacaaagttaggccaacgcaacccacgttatttcgccccataggctagaaaaagccccccttgggcccattcccttcctaccaaacatgacgcacgcattggaggcacaaacaggacttctccaaccccccaacggggacccccccaatcttcccaccgggtagt

SEQ ID NO: 528137 - DNA, 1136 bp, Homo sapiens
gggactctctttatctggactcagccctgcctgcacccagtgtgaaataaacagccttgttgctcacacaaatgcctgatatggtaggtctcttcacacaaacgctgcatgaaatattggtagccatgactcggatcggggtacctccacttggagagatcaatcccacagatcctcctgctcttttgctccgtgagaaagatctacctagtgacctcaggtcctcacgactgaccagcccaaggaacatctcaccaatttcaaatctggaccccactgaacaatcggactgattcaactcatctaggcagccactacccagagcccctggaaactctggaccaagcactctctgacttgacataccttaccagatctaactcgagctatagcagctagaagactgaccactgcccaaattcgccttggaagccccctagaacatctcgcggatgccgaagcttcgagtaactctcaccagtgggacggggaacgcgcaatgacaacatacccaaaacaaacgaaacacatatcttaggggaacgccgacataccacaaaacaacaaacacaggaccttaacctctcctgggcacttgaacctcactaatttaaactctcacaacgcgctggaaccattctcaacaaaccctgtacttacaagacaaggttactggttgtagaaacctccacacgtggcggcataggaacactagaacgaacaacgtatctttcaaaagtactgcgtcagacacatcctggactctgtcaatctaagtacttggcatacgatgagcacgataccttaataggatatgtatccccgtaaaacgactaggttaacgcgatctcatctggggcggcaaacaatttatgagacatatcaactcgctgtgggataaatcccctccagcatctaaacaattccaatgttgcaacatcaccgtttagaaactgctcacatagtagttgtcaccgaggatctggattcaaaccacacaaatcctgagcggcctgtagaagaccaaatggcgcgacagagaatgtggccaacacatattctcgaacagccccagcacaatcaaacaactattatctggacagctaagaatatcgaccacaaacatttgacgagcg

SEQ ID NO: 528138 - DNA, 217 bp, Homo sapiens
gtattgggatttcgtatcgtgtatgaatagtacatacacacggacgtgaggtcacacattccccctccctgcctcccatgggacgtgtggtaagaactgccgaggacagactgttatcactgactttatgcgtaggtccagctatggtgtctgaaaaacaaacgatctcaaaaggcactggttttgaaacgaccaggtttatgcgtaattcgggttt

SEQ ID NO: 528139 - DNA, 424 bp, Homo sapiens
  misc_feature (406)..(406): n is a, c, g, or t
cacgaggggcgtcggcttgtcatgactcatccctatcatttgtcaatgagattcggcccgccccatcgtgaatttcagccatgacagcggtgaacaccttgtcggggccgagccgacgaagctcctcaccgatgagcatctgtacctcacgacggtccagggctactccgcgcgctggttctcccgggatccggtagacggcgtatctgccgctgcgacggcgtatctcgatgtcaccacctgaggtcgacatgacgatcgcggagatgccgggcgcgtcggttgtcacccgctcgaccgggacgccgagacgcaatcctagccaggctgccagcagcatcgccggcgcattaccggcggctgactctactcgagcggactcgacggtcgctggatgttgatccanagctgctgcggctagggc

SEQ ID NO: 528140 - DNA, 552 bp, Homo sapiens
  misc_feature (21)..(21): n is a, c, g, or t
  misc_feature (91)..(91): n is a, c, g, or t
  misc_feature (130)..(130): n is a, c, g, or t
  misc_feature (156)..(156): n is a, c, g, or t
  misc_feature (186)..(186): n is a, c, g, or t
  misc_feature (189)..(189): n is a, c, g, or t
  misc_feature (218)..(218): n is a, c, g, or t
  misc_feature (222)..(222): n is a, c, g, or t
  misc_feature (230)..(230): n is a, c, g, or t
  misc_feature (247)..(247): n is a, c, g, or t
  misc_feature (291)..(291): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (317)..(317): n is a, c, g, or t
  misc_feature (319)..(319): n is a, c, g, or t
  misc_feature (330)..(330): n is a, c, g, or t
  misc_feature (344)..(344): n is a, c, g, or t
  misc_feature (356)..(357): n is a, c, g, or t
  misc_feature (378)..(378): n is a, c, g, or t
  misc_feature (434)..(434): n is a, c, g, or t
  misc_feature (447)..(447): n is a, c, g, or t
  misc_feature (478)..(478): n is a, c, g, or t
  misc_feature (485)..(485): n is a, c, g, or t
  misc_feature (497)..(497): n is a, c, g, or t
  misc_feature (500)..(500): n is a, c, g, or t
  misc_feature (503)..(503): n is a, c, g, or t
  misc_feature (548)..(548): n is a, c, g, or t
gaatccatacaaaagtcagcnagttcttttataataacaattattctttcatttcaatttttattatgttttttatatagaacacagcacnaagtgcttttgaattaaagtttagaaaatatcgaaagcngccaggcgcggtggctcatgcctgtnatcgcagcacttcgggaggccgaggcgggnggntcacgaggtcaggggatccagaccatccnggcnaacatggngaaaccccgtctctacnaaaaatacaaaaaaattagccgggcgtgtgggcaggcgcctgtngtcccatcnacnggnagtcccaactncncaggaggctgnggcaggaaaatggngtcaacccgggnngcggggcctgccgtgagccgngattacgccactgcactccagcctgggagacagagccagactccatctcaaaaaanaggaagatatcgnaatcttattttccaaatatttctcttcagtngtcttanccactcttcccntgntcntttcatgcctttctagtaaattaatttttctccctagagaaagtnaaaa

SEQ ID NO: 528141 - DNA, 386 bp, Homo sapiens
ctgggtgatctagcaggactaacgggagccttaacctgtagtcaaataaatgttataccaaaaagacacttgcgcttgcatgtatatagcagcactattcacaatagcacagacgtggaatcaacttaggtgccagcaacagtgaattggataaggaacatgtggtacacctacacccataaaaaaagaatgaaataatgtcctttgcagcaacatgggtgcagctggagtccattatcctaagtgaataaatcacttggaacagaaatccaaataacacatgttctcacttgtaagtgggaactaaacatagggtacacatagacataaagaagggaacagtagaccctgaggactccaaaaagggaaagggaaggagggaggca

SEQ ID NO: 528142 - DNA, 206 bp, Homo sapiens
ctcgcgctgccggaacaagaagggcgcgatggtgtatcatcgagaaggagaagaaactgtggactctaattgaggccacaagaatgctgagagcctaggattaaaatatgaaatggtggtctgctgtgtgaatcaatcattcctgaagaatgaagaagattaattttgggagttctttgacgaactttgatatgcggtaaaagctt

SEQ ID NO: 528143 - DNA, 240 bp, Homo sapiens
  misc_feature (30)..(30): n is a, c, g, or t
  misc_feature (113)..(113): n is a, c, g, or t
  misc_feature (146)..(146): n is a, c, g, or t
  misc_feature (154)..(154): n is a, c, g, or t
tgaacatgagggcacagtctaccagatctnatctcctagctcaaagaaatccactgatttcctctgtagcatcttcaggttccatcttgacaacttcctctaaatccccaggngatgagttgtttagagactcctggatgccctgngggagcgnctccagagcttgccttccctcctctgttttcacaacggtccagcgataggcactgttctctgacaatccttcttggcactgtttat

SEQ ID NO: 528144 - DNA, 205 bp, Homo sapiens
  misc_feature (63)..(63): n is a, c, g, or t
  misc_feature (112)..(112): n is a, c, g, or t
actacagtgctgtcatacgcgtatcagtcgtcatcacgggcgatgcgcactagattttgactncgagaatacagcctatcatctgctcatccccatgctggattatctgctntcacatcgttcctagcttgtttccggtcctctgttttcacaacggtccagcgataggcactgttctctgacaatccttcttggcactgtttat

SEQ ID NO: 528145 - DNA, 247 bp, Homo sapiens
atagttgtagatatgtggcattatttctgagggctctgttctgttccattagtacgatatctctgcttttcgtaccagtaccacgctgtttttattactagtagcctatgtagtatagtttgaagtcacgtagcgtcatgcctcagctttgctctcatagcttacgatttacttcgcaattcgggctctttattggctcatatgacatcaaggagctcttccaatctttaagaagtatttggagctt

SEQ ID NO: 528146 - DNA, 353 bp, Homo sapiens
  misc_feature (16)..(16): n is a, c, g, or t
  misc_feature (96)..(96): n is a, c, g, or t
  misc_feature (111)..(111): n is a, c, g, or t
  misc_feature (173)..(173): n is a, c, g, or t
  misc_feature (245)..(245): n is a, c, g, or t
  misc_feature (250)..(250): n is a, c, g, or t
  misc_feature (279)..(279): n is a, c, g, or t
  misc_feature (283)..(283): n is a, c, g, or t
  misc_feature (342)..(342): n is a, c, g, or t
  misc_feature (352)..(352): n is a, c, g, or t
tgccaccaaagtatgnccctgggtgaagtatttattcaaatgaatccattggaaaaaacaaaggaaaatgggcatggtgacctcacgccctgtatnccccagcactttganaggctgaggttgaaggattacttgagccccggaatttgagaccagcccgggcaacaagtganaccctgtctcctacaaaagatacaaaaaattaggcaggcacaatggcatgcacctgtagttccagatatacnggaanctgagctgggaggatcacttgttccccanaaantcaaggctgcagtgagccatgatcctgtcactgcactccagcctgggtagcagggtaanaccctttctna

SEQ ID NO: 528147 - DNA, 132 bp, Homo sapiens
tattactccgggtactcgatcaccaggtgatgcacaaaattaaagaggataataaatagcttgtacaaggccatgaagccaagaaattattcgaattatgaattactgaatgcatattatgaactgtattat

SEQ ID NO: 528148 - DNA, 281 bp, Homo sapiens
ccccccctttggggggggggggggggagccggtttttttcccccccgtgatgggaaaaagggggggggttttccgggggtttttttttacccccccggggccggggggtttttcccgggaacccggggaggttcccccccccgggggggggggtggggggcgaaaaaggccccgcccccggggggattgtttttgggccggggccccccccccctgggggggggcccccccccgggcctttttttgtttttgggggaaaaaattttggtttttggttttta

SEQ ID NO: 528149 - DNA, 111 bp, Homo sapiens
  misc_feature (38)..(38): n is a, c, g, or t
gctcatgcaagaagtgctcggtcctttagtatggcctnctcactggacacccaagggcaccttgccacctgagtgagctgcactggacaagctgcacgtggtcctgagaac

SEQ ID NO: 528150 - DNA, 256 bp, Homo sapiens
tgggacgtgctggattgtggtcatgctcactacatgtggcctgtggcattgatgtcagagattggcaaaggataaggctgtggtgtgcctctgcccagcttctaactccatgtggcctgcctcaagaggaacttccatgtgaatggcggtcagaccgagcagcaggtgggtggatgagtgtgctccttgtgccttggtttggaaaatgatgatctgtgcttgtgctatgaccgcatgggtgttacctgatggctct

SEQ ID NO: 528151 - DNA, 1269 bp, Homo sapiens
  misc_feature (301)..(301): n is a, c, g, or t
tgcagtggctcacgcctgtaatcccagcactttgggaggctgaggcaggcggatcacgaggtcaggagatcgagaccatcctggctaacacggtgaaaccctgtctctactgaaaatacaaaaaaaattagccgggcatggtgctgcgcgcctgtggtcccaactactcaggaggctgaggcagaagagtggcgtgaacctgggaggcggagcttgcagtgagccgagaatgcgccactgcactccagcctgggcgacagagcgagactccgtctcaaaaaaaaaattggtgacttacggntgagctttaagcaactcttgtcaatgagatactgaaatatggggagtgaatatagaccctcaaaccattacttccttgcccttcgttttttatagaatacaacttttatagctgcgaacatttgtaagatttatagtcctttctggctttcatgcagagcagcactatcacatcctaacccctgcagctgtttatatcagcagcatttaatatttgatttactaatccctaattgttgcctttcaactactcattttcatttttgtagagccttaggcctgttccagctgaccattatgatggtaaacaactagctctctggcacaggggaagaggcccctaacaggatcttttggacaaaggcacatttgagccagaccagaatagatcagatgtaaaagcgcggcaacgaagggaagcccggaggtaactcagggtaatgcagaatccaaagaggctttagttgaagccgatcctccttttgctttcaacagaaaaatctcctggtccattttataggatactcttctaaatcagcttacccttttgctctcaaaccggccaacgctctctcttttgacggcctacacctcctttccacttgactcaactacgcaccattcatcgctccgatttcatcactcttttccatattgaaccgctccctagtcactattcacttctcctctcacctctcagcgactcactactatctcactccatcatctaacctctctcccttcgctcatactctccgtctccatcagctcgctcctatatctctcgagctgcactctctccacctacgctctctgctgctcgtacttaactacattctcatacttcctcctcttcacacctctctcgcaccgcttcgtacatctctactcacgtgcgctcacgctacattcctacttcatcctctctcatccccttttgagtctgctctcaactctctctctcgcctt

SEQ ID NO: 528152 - DNA, 297 bp, Homo sapiens
  misc_feature (246)..(246): n is a, c, g, or t
ggtcgatctagaggaccccgacatgtcgaggtctgtcataattttataaacgtaaaatcctttgtcatggtttatcattaaaaaattaatgataattacaataaatgcataatttacaaaagccctctattcatagggatttatacattacaaggcattacatgtacattctatttagaaagactaaatattagtgtatatagaactatgtatttgaaaggatatttatcagccgtggtatatacnatgaacaaagtacagtaacttatataacatgacagagtccattaagtttac

SEQ ID NO: 528153 - DNA, 229 bp, Homo sapiens
tcccatatcctcttggacctgcgagactcaccattgggtgacatttgtccctttggcgcgtggtgcctcttgccccacccccagtgaactgtgtgtgtgtgtgtttgtgtgtgtgtacgtgtgtgtatgtttagatggaccctcactctgtcgcccaggcggaggttgcagtgagctgaagttcgcgcccctccactccagcctgggcaacacagcgagacaatttttc

SEQ ID NO: 528154 - DNA, 162 bp, Homo sapiens
gcgctcggcccgaattcctaatacgcaatggaagataatataaggaaagaaggtgtgtgtgtatatatatgtgtgtgtgtgtgtatatatacttatatatacatatatatgtatatatgtgtgcatgtgtataactgtgttatatttctgtacagtagaaac

SEQ ID NO: 528155 - DNA, 408 bp, Homo sapiens
ccttggatggaaatatctggatacggtagaaatagaagaaccttgtattttctcacataaagggggtcacaggacaagctggaaaagaagccagactttgaggtggaagactcccactggaattgctggatcatttaactaaatacccaaccttggctatgcgccccaagctctctaaatctgtttcctaacctgggaagcagtgctgataaggcacgcatctcacagtggggctgtgagtaggaaatgatgtaattcagttggaagcgcttttttcaaatgctttattcaaatgcaaagcacatctgccgctaagtccaaaatgccccctccggttctctcagcccctccactcctatattcttcttccccagtctgtttctcatccggagacgcctttccacctat

SEQ ID NO: 528156 - DNA, 2055 bp, Homo sapiens
  misc_feature (331)..(331): n is a, c, g, or t
  misc_feature (866)..(866): n is a, c, g, or t
  misc_feature (934)..(934): n is a, c, g, or t
tgtgtatggcatgcagctctcggtctgttgtagtgttgtctgctgtctgtcgtatcagttggtctgtttctgctgtcgttatcgttctgatggtcttgtggtctgtgtatgatgctgatgttgtgctttggcgctcgcttgtgtactggtctcgttccttttgtcacgtatctgcgtcttgtgtcgagcttgatctctcgatgtgctctgctgcctgcttcgcttctgtataagtacaaccctgtgttgggggttgtgccgacgacgcatcgggcgcgcttttggggggtgatcacccctctgttatgattccttcctcgcgaggagagtntctcccacacgagcgtgtgtgtgtgccgcagaatatgtctgcgcgtcgcttgtgtgtggtagctctcccctcgcggcgctcgcttcttttctgcttttttgttcacctgtcggtcgctctctataggtgggtatgtctgcagatggctccctctcttgtgtgtggttgcagcagtgatttttccgtggcactctctaagagtggctcttaattgggggctccttgttaattgtccctggagaggtgggggtagatgtgcttgaggttgcctcacagttagttgtgttcagtccacccgagctcaacagtagttaggtgatgtgtttgtttcttctgtggtgggtaggagtctgtcggtgaagccaccagtgctggtgcctccgtctcggtcagctgcgtagttgtccatgtgtgagtcggcacacagtagcaggactggttttgttgtgtagcgtccaccagagcggagagaggtggggtcctctacggataggccttttttttctagtcggtgccgcatacgcctgatgttctnttgtgaatgattctccactccccgccttttggtggaaatggagagaaagagtgtatgttgtggacctnccgggtgtcgttcaggtgtactcactcctatgagtacctccccccagttggtgccgcccccagagaagagaaagaagagggggggtggaataccatctttgttgtgtggtaagagtggctctctctgtgttttgggaatgatcgcctactcgccacagatgagaacacaagcaccacagagagagtgggtgctctgtggtgattgatatgggagtgagctcgtcctcccctacttgtggggtgaaaagagataaggtgataggatatatgctacgcccaccacgtctcttggggtgtgtgaagagctctcccaccaagggatagatgatctgatataataaatatgttgttgcaagagaataggggtctcttttatatttcacttctatcttctctctcctcttcatgaggagagcgttttatacacactacgggtgattcgggggcctctttgataaagatattatgagatgatatgatacctccacatcatataagatatcaccctttaatattactttttttagatatatgacacccctctcattattcctctctcctcagctctcaatcctcataatctacacactcaagtctctacacctacactacacactttttcctctcctcccatactccacactcacacacacgctcaccttcacactcttcactcactccagacgctcacaccacacatactcagaccatactcagaccagaccaccagagtgtaaagagcgcacattacacatagttctcctgcgtttgtctccacccacagtgtgatacaccacctggaatgtgtcgtattgttgtttgtctcctgttgtgggcccagagagtagacctagagatgttcttgggtgtcgcccccaccagataggtggttgttctcacacataaagaatattagggtgccttgttgtgaaagaaatatagattgccagtggtttatatagagattaattgtggtaagaaattttagatgtttatatttgccatttggcttaattggtctgtgctgcatggttatatactcctggattatagatttaaagttctctgtagacaatctctgtgtaagagcccagactatcctgtaaccagtctggtttatc

SEQ ID NO: 528157 - DNA, 136 bp, Homo sapiens
gggactactcgcaaccgagctccgctagactaagcatcttctccttaagctagcaggtgtctccgtctactcttaggggccatcattttcatcacaacaattatcattataaaaccccctgggcataacccaatac

SEQ ID NO: 528158 - DNA, 414 bp, Homo sapiens
  misc_feature (5)..(5): n is a, c, g, or t
  misc_feature (22)..(22): n is a, c, g, or t
  misc_feature (31)..(31): n is a, c, g, or t
  misc_feature (55)..(55): n is a, c, g, or t
  misc_feature (100)..(100): n is a, c, g, or t
  misc_feature (145)..(146): n is a, c, g, or t
  misc_feature (336)..(336): n is a, c, g, or t
aagcnagttgctgataaatccncgtgccttntgccttcgcttcgatcttcccgtngctcagccgccgcacgacgcgccccggcatgcccgcgagcagcangccgcgcggcacgtcgtaaccggccttcacaaaacgcgcaggcgnnacgatcgtcgtcgcaccgatcgtcgcaccgtccatcaccaccgcattcatcccgatcatcgtgtcgggttcgagcgtcgcgccatgcacgatcgcgccgtggccgatgtggctgttgacaccgagccggcacgtctcgccgatcccgacatgcagcacgcagccgtcctgcacgttgctgccgtcctcgncgacgatcgcaccgaagtcgccgcgcaggttcgcatgcgggccgatgtagcagcgcgcgccgatcgtcacgtcgaccg

SEQ ID NO: 528159 - DNA, 436 bp, Homo sapiens
  misc_feature (419)..(419): n is a, c, g, or t
gctcgtatacacaggtttctggcacagcctgaatgtgaatttgttcgccactgtatccagaagtcccaggagcgggtagaagggaaggtgcaggtgtctgtcttcaagggccaagtgtacatcctcggtcgggagtctccactttcactctacaatgaagagctggtgagcatgaacgtgcagggcgactatgagcccatcgacgccactggcttcatcaatatcaactcgctcaggctgaaggagtaccatcgccttcagagcaaggtcactgccaaatagaccctgacaaagaggagcgggcctccccactctgcagctctcccaggcttcagcattaattgttgtgataaatttgtaattgtagcttgttctccaccacctgactggggctgctgtgtccccccccgtgtccccanagcctttgttccctggt

SEQ ID NO: 528160 - DNA, 470 bp, Homo sapiens
gataaaacgttagaacacattcgagcaggactctcgtagaacatggatcattcgatagatacttgcatatagtcaaggtgcatcgtgaaccagtgtcttactggctctaatgcaatccggaggtaaagagaggaaaaaactgtttacaatgattcacgctatcttaacgaaaacttcaactgctcataaatcacgcaaatgcatgcctgtaattacacggatcattaactaattttcattcttttcttctttctttatcatgatttagatatagaacctacggtgaaatttgctatccttattgctggctttaaaagtcaccaaagtcctcataactttgcctatcagaaaataattagtatgcctactttgcatattatcggcgataacgatcaagtcattcctagaggtaattaaaggagagatttactttttccttttatcaagtggccaattcattattatttact

SEQ ID NO: 528161 - DNA, 135 bp, Homo sapiens
ggacagcacagctgacaggcatgcccgagagtatcttggcatcctagagcttatctccacagaggagaacacacaaagcagcagagaccatgaggaacccatactacagcccctccctagcacacagccgcgtca

SEQ ID NO: 528162 - DNA, 808 bp, Homo sapiens
ccagacatgaggctacatcccacatggacatagcgaagaacgcttgggtccatatctctgcacgacctgcatgctctggtccttgtgcgtgtcacatcaggccacttcaattgctcattgatcacactccctgtgtgctttactgaggcctcgcatctcttcagttcagagttccacacctgaaccagataactaaagtccattgggagaagatcacgatgccgctccaggaaaagataaagtccaaaactggcagtcctaagcctcctgtctgtagccttcaagccccagttcgctctttcttgattgtcttggaaacggattgtcgcttggtgaccacacgggctgtgtgatgctgataaccgggccgcatagtgtctacgggactccactgtgcagatcgtcttctaaccgctccccgaacgtttcaagcacaatacttccgttcttacgcttccggtggctacccccaaagtatatcggttgacatacatcgagcgcacgtatgctacacgctggtgcccagcacataaacactgggggtaattacgaagggtattgtgcaccgaaggggttttcacctagtgtttgggcccacgtgtatagaatctcaaaattctctcgtgaacgcttcctgtagatgcggtgcccccgcatcaactaggttctccacagaagattgccgtgggctgtgttaccacggttgtattgaactaccagctgataccccagtggcggtatcctcaccctggctgttggactgtaatattgaccaagaggctcctaggaaccaggagttgacaatacg

SEQ ID NO: 528163 - DNA, 136 bp, Homo sapiens
ctgtatataaactgtagggttactaataatgttaacactggacactgatacttctttataatatctactattgagtgctgtctccatgtttgatgtatctagagcaggttgctccacaggtagctctagtgagggc

SEQ ID NO: 528164 - DNA, 704 bp, Homo sapiens
catacacccagatgacgagctggtcttggaagatgagctgcagcgtatcaaactataaggcgccattgacgtgtctaggctggttacggggactggtcctgtgctagtgtttggctccgttgagagacgacgggacgtttctggtggaggactattgctttgctgaccttgctccccataagcccgcaacccccacttgacacagataggttctgtgctagtgtctgattcggccctgggccatgaggtggacggtggtaggtcgagagcactgtctgggcatccgcagacttgtctggtgcgatgtggttgacggtggcagtcttggggtactgaaggggagtcggtgcggcagccgttccacgtcttcaccgggtttatcgctcgcatggtcaaacacctccctcagtccagcaagggacccatagtcagggagtatctatcgactaagggcagtgtacctcattcataggaaaatcccagtgccagtcagcgtggcacgcgctgattataggatgctgtgaattgagatcctacctgacgaagctgagtcgcctcacttagcccggtggtacgtgatgccaggcgagttttgatcccatccaatctacaacgctcccccgagtagtaccttctcaactcctttgcttgggcccggtggccgtctgactgactcctacgctccactggtcgcctttccctta

SEQ ID NO: 528165 - DNA, 420 bp, Homo sapiens
  misc_feature (194)..(194): n is a, c, g, or t
  misc_feature (209)..(209): n is a, c, g, or t
  misc_feature (212)..(212): n is a, c, g, or t
  misc_feature (223)..(224): n is a, c, g, or t
gtctcctctggtctcgtcctcgagacagcaccacccctggcctgcagaccctgacgttcaacgtaccatgttcaagtgagtgtgagccctgaggacgaggaggaagaagaggaggaggacgaggaggacgaggacgaagacctggaggagctggaggtgctggagaggaagcccgccgccgggctgtccgcggncccagtgcccaccgnccnctgccgccggnngcgcccctgatggacttcggaaatgacttcgtgcctgcctggctgcccctggggaccccttgcctggcctgctcccccctgtcgcccccggagctggcagcctgtctctgggaccctgagccctggtgtcgatcgacctgtgcaccgctgcgcatcccctgcttgtcttgctgcacgcaagtcctcgccactccga

SEQ ID NO: 528166 - DNA, 527 bp, Homo sapiens
cttgtttctcttagcccctgtttaaaattttagataatctataaaaattatacacggctagataattattgagatttagtttgtatatttctataagtgagattgcgtatgtccaataacactgtctgctgaaaattactgtgtgtgttataattttggtgcttaccagtggttctagggaacaataaatgtgttgagtagatagatgaagagatcaacacatgggaaaaactttgcaagtataggaaacataaaatattgaaaaacaaaacaattagggatttttaatttaaaaacagtattttaaaatatgagttttaaaaaatttattaaaatgagccattgtttgatctgttaatttggagaagttacatgtacttactttttacttcattaactatctggtattagggacataaaactagattcagactctagtgatagtaatgataattcctgtgatttaacttgcacttcgctattacttcatacttaattaatccattaaaattaactcaatcctaaaa

SEQ ID NO: 528167 - DNA, 204 bp, Homo sapiens
cgcagcacgggatacatcagaggcagcgaaggcattaactagtatgcacgaaatgaaccctcagtccttcaatatgaggttatctctgagtttaaagaacttctgcttcaaaatattatgcttccctcaaatcaaagagcataaaatataccttacaaactttatcacatccaaataataactatttgcaaaagacagttatct

SEQ ID NO: 528168 - DNA, 308 bp, Homo sapiens
ccagtgctgaggcagtggatgcttgaaggtgggaggaagatgttgcagtgagccgagatcgcgccactgcactccagcctgggtgacagagcaagactcagtctcaaaaaaaaaaaaaaaaaaaaggggagggggggaaaccatccgttggcttctgtaaggtcgatgtttcagggcctcttccctaaactagactagtgtcatccagtgcagcagccgttagccacgggtagctatggaaaactggagggctggggcgtggtgggctcagggctataatctcagcacttgggagagggctgaggcgg

SEQ ID NO: 528169 - DNA, 530 bp, Homo sapiens
  misc_feature (20)..(20): n is a, c, g, or t
  misc_feature (36)..(36): n is a, c, g, or t
  misc_feature (48)..(48): n is a, c, g, or t
  misc_feature (258)..(258): n is a, c, g, or t
aaaaggttaaccccttgaancaaacacggggttgangccaaattcaancccctcaaaccttttgaaaaattttgccgtgtaaactttttgaactcccccctaaaaccttaacctacctaataagccctgcctgttgacctagaaacccttaatgaatccatagtccaattaacacgtattttgccatgttatatgtataataaacccagattccttaaagtaaactagagaaaagaaatcgttaggcccgggtgcggntgtcacgcctgtaatcccagcactatgggaggccgaggcaggcggatcatgaggtcaggagatcgagaccatccctggctaacacggtgaaaccctgtctaaaaaaaaatacaaaaattagctgggcacagtggcggcctgtagtcccagctattcgggaggctgaggcaggagaatggcaggaacctgaggggcagagcttacagtgagccgagatcacgccactgcactccagcctgggcgatggagcaagactctgtctcaaaaaaaaa

SEQ ID NO: 528170 - DNA, 597 bp, Homo sapiens
tgttcgctgtggctcccagccctgtggaccccaccccgctggacagtgggggaaactgagtgcctgagctgggcccacacaggaccatgaaggtgcttctcctcacatgggctggggtgccctgttcttctgcctattatttggtgatgacaacttcgacccagcacagcctccagtggagcgcgatgtgctgctgacagtgggccaacgctggtgttggttgagtgagctggcctatcactacgcgcgtctgggctcccaactggtgctcactgcccacactgacggctctcctgcagaaggcactggtggctcacagcttgtagtcagcactttgggcaggccgaggacaagtggatcacctgaggtcaggagttcaagcaccagcctggccaacatggcgaaacctggtctctactaagaagacaaaaattaggccaggcatggtggctcatgccttgtaatcctagcactttggcaggccaccggcggatggctcacttgcggtcaggagtacaaaaccagcctggccaacatggtgcaaagcctggtctctacctcaaaaatacaaaacaataccaactacacatacaccac

SEQ ID NO: 528171 - DNA, 300 bp, Homo sapiens
  misc_feature (227)..(227): n is a, c, g, or t
ctctaatcccagctactcgggagactgaggcaggagaatggcttgaacccagttggtgagggttgcagtgtgctgagatcacaccattgcactttattctacttgggtgacagagcgaaactctgtctcaaaaaaaaaaattctatttaaaatagtggccttggccaggcatgtggtggctcacgcctgtaatctcaacactttgggaggctgaggcaggaggattncttgagcccgggagttcaagaccagcctgggcaacatgggggaaaccccgtcttttacaaaaaaatgcccaga

SEQ ID NO: 528172 - DNA, 130 bp, Homo sapiens
ctcatgttgtgatttattagagagatttgcacttcctataattctcccatattccctaaacgatattccctaaccgataatgaacacgatacgataaattttaggggttaaaataccgcgaaattttaaa

SEQ ID NO: 528173 - DNA, 345 bp, Homo sapiens
ggggttaaaatttttaattttttccccccgggaatttgttacccctgctgaagggggttaaacggggcccggacccggcctgattaaaaacccttggggtttaaacaaattcggttgttttttggggatccccccttttttaaaggggctgggccccgggttttttccccaagtcccaaaggcggggccaccccgtttgggccccccccccgtttttttttcccaaaaaaaaaaagaggggcccccgtttttaaagggggggcccaaaaaccaaaaaacccgggggttttttttggggaaatggcccggatttttttttgcccccttaaaaaaaaacttttgcca

SEQ ID NO: 528174 - DNA, 480 bp, Homo sapiens
  misc_feature (145)..(145): n is a, c, g, or t
  misc_feature (428)..(428): n is a, c, g, or t
  misc_feature (468)..(468): n is a, c, g, or t
ttttatgtgccctgggactctttatctaccagtcactggatgccattgatgggaaacaagccagaaggacaaactcttgctctcccttaggggaactatttgatcatggttgtgactctctttccacagtatttatggccatcgngcttccattgctgttcgcctaggaacacatcctgactggttgtttttctgctctttcgttgggatgttcatgttttactgtgctcattggcagacttaccgtctcaggagtgttaagatttggaagggtggatgtcactgagatccaggtagctttaagtgatcgtcttcatgttgtcaacattttggaggagcaacaatgtgggactatacgatacctattctagaaataaaactgaagattgttccggttcctggagttgtaggtggattaataatttccngttccaaataattccatgtgatcctccatgggtggtgttngcaagaatgggg

SEQ ID NO: 528175 - DNA, 603 bp, Homo sapiens
gtcgtggtggcgtggaacactgggccggaggaaggcagccaagaggaagtgggcggctgtgctggtccgacacctgggctacaagccagaagagtacaagatgggcaggaccaagatcttcatccgcttccccaagagcctgtttgccacagaggatgccctgagaggtccggcggcagagcctggtccacaaacgagtccaatgctgcctggacggggcttatcactggcggacagaaattcctccgggtgaagagatcagccatctgcatccggacgtgctcatccgaggcttcatcctgacgccaacgcacccccgctgcacccgagaacgccttcttcctggagccatgtgcgcacctcattttattcgctaaaagcctgaggcggcagctgccccggaatgtcctggacacctcgatggccctacgcgcacccaagactgccctgcggtgaggcctcagagcttctgcgggagttgtgcataacaggaacatggtgtggaaatactgccggagatatcagcgcctgagtggaagcaggaaagctgacatgcataaggccgtggctagttgagaatctttcaagggcaaggaaggataa

SEQ ID NO: 528176 - DNA, 645 bp, Homo sapiens
taatgtcttgactgcgaaaaaggaataggttaggaatatggatgtaactcatggatactgaatcacgtgtgggagtaggccttacctgtttcctaatcgataggggcggacctcatttacatttctcatcactcgaggcaaggcagtgatggctgtagccaaggcctgggtctaataagcatacccacctggcctggttgtgttggacttgtacagtgcatagtgtctcacatgtggggtaatatgtttgcatgtcgcacttcaacatgtgtccgatggctacgaccagtacgatgtctgatgacatggtgttcaacatgggtatagaagtctctattccaacgaaatagaccattgatgtcgaatgcaagaatagctaatcaacttgacgattgggcttctgcaggtcgatgtccagccacgtgtaatttcgtatggtctccactgatttggcccacgactgccatgattctatgccgtagtggacatccaaataacccatggtggcctaatggatagccgtgcactctgataagacttgtgaatcaaatcatagggatctgtacactgacgtgagcggtaactggaatttgcactcgggagccccgtctggctgcacaacatgaaaatcatacacaccaagcc

SEQ ID NO: 528177 - DNA, 408 bp, Homo sapiens
  misc_feature (359)..(359): n is a, c, g, or t
gatttagcattaattgacggtgaacaatataagcattacgcagaacagtcgattacagacaggcgcaacctaacgttgattgaggtagacgcatgagtgttaaaattgttggaggtgatcgatatatccaagccgttaaaaaaatggcggcaacagtaccgcaagctgctcgtgacacagtgaagagatacacagtagctacacaagcgcaggtttagattagagcctgttaaacaggttttcttaacgtaatacaacgattaaattcagacacgactacgcaacgactggtacggttacggctaacgctttcaaccgtggctacaattatggcgacgtcaggatttgcacaagttaanccacccaacggtgggcaagtaagtttatgtctactgcatttattcacaa

SEQ ID NO: 528178 - DNA, 970 bp, Homo sapiens
gcaaatgtaagagtatctgccaagttaggactatggattgaggccacagttttcccaggttgaccctgcccaggcaccattgcacttcagcctgggcacaagaacgaaactccctctcaaaaaaaaaaaaaaaaaaaaaaaacctttaaatattggagttcaatttaaaagttttccgggggattccccatatttttggctttggtacgttggggtagtgacaaagatgttttatattttttatgtctctcaaatcgtatatatagcaaaggggcgtaatatcctttaattaaccacctgatttagggcaccatttagggggtacatctctgaaagtttcctaaaacgatttacaaattccaggaaggtgtcaaatacctcggctactccgtgtgggccaccagtgcaggggttggcatcaggggggggttggtgtcccattcaaaaaacattcgggggagggggaccttatattgaaatagcttattggtgtgtttggaccccttaaaaatgtagctggttttctacttttatcattagcacttgggcttttgtaaattattcctcaaatggttggaggagggcatttccgtccatcaatggatcctaatataacctacattaagagtagggtaacaagggggttagagaatgttaattattttccttgaaggtatattaaaaattgtgtaaaggtttactaatttacttaaatgatttcttaaaagggggaactctttttttagttgctcctgatcatcaaattggagaaaaagaaaccctgtcgtgggtggaaacgaggtgagagaggggtaagggggggtggaaggaaaacgctcgagagaattacaagggattggcatgtgcaggaaaggaatggggacggaattgacaagaattaatccataaaaacgggagaagtaaatgagggggacaaggtgatcggacaaaaagtagaagggataattct

SEQ ID NO: 528179 - DNA, 593 bp, Homo sapiens
cggtgtgcgctacaggacctagtaatagtcaccaggaacttctggcctacaactgagaagttcctgcataaacgggaagtctggtttgctcatgaggataaagttgacagtctctatggcgacagctgtggctgaacagggccccggtcgtgcacagggaaaaccctagggggacaggtgttctgttacctcggactccagagtttggtcaccatggcaacagtggtggggtccaaaccgcctgggggtggagcatggagggtggtctggaactggagtgggcctgtttggtgacagttgggaaagggacgtcagaggacagggtgggtttgctctcccttcaaagaaatatctgaggggtgggacgtggcccccagtaagtgagccagctggctgtgtgtcagtctgaggtggcagatgggggtgctcgcccacgaaactagaggggtgtgccctgttacccagaaactgcaggggactctcagggagagggggagaatgggagtctccaggactcaggtcaccataagggacaataagcgcctcggcccacaaactccatgtgagcagggggagtgaccctgaagtacctt

SEQ ID NO: 528180 - DNA, 508 bp, Homo sapiens
cacagagcgagctactagagcggtggttcatctgcgttgctctaaaatgggacttgtttcattattggtgatggctgaaagaatattttcctagtgtatgtatatagagcagtactttgatctctttatctgtggatgaacagctactttgaaatatatgatacatttgtgtaaggctagtccgctgctgtggaatagaaggtcagaattgatcactatcatctgagagtaacttattgtacccatcactgatatcctatccgagactgcctccacttccccagcagcctctgaattacttcatgtggctgcagatggaaggatttacccaaaggtttataggctgcaacatattccgtggtgtatctaagtacaggcagtaacctcattcctgcagctgtgtatgaacaggtaatttaccatgcggtcctccaggttcaacagtatggctccaaatgatgaatttcattctgattttctggctgaagactattctgtaagagtataa

SEQ ID NO: 528181 - DNA, 428 bp, Homo sapiens
  misc_feature (6)..(6): n is a, c, g, or t
  misc_feature (39)..(39): n is a, c, g, or t
  misc_feature (95)..(95): n is a, c, g, or t
  misc_feature (117)..(117): n is a, c, g, or t
  misc_feature (148)..(148): n is a, c, g, or t
  misc_feature (195)..(195): n is a, c, g, or t
ccccgnttcaaccccgcaaggccagaaaggagccaaaanggaaaaaccatggaaccaagaggcctcctacctgtggaattccagtggccaaaagnaatgggaggggccagagtaaancaggttttaggaattatccgggtttgaatgnacttgaattgaagcctgtagggtgtaagagactgccctcctactgtnctggcacccaggggtaattagggcagtctggatagtggtctggagtgtgagagctccctaaaggaggtggttggaggtgtaggttttggattggttgatctgtatatgaaaggtgcacgtgcagggtgagtcctctactatcactagaaattggctggtcccaggagaagtagtctctctagagacagcaatgccccagatgtcaaagcatcagaaaatagcagaaaaaaaaa

SEQ ID NO: 528182 - DNA, 366 bp, Homo sapiens
  misc_feature (151)..(151): n is a, c, g, or t
  misc_feature (198)..(198): n is a, c, g, or t
  misc_feature (282)..(282): n is a, c, g, or t
  misc_feature (358)..(358): n is a, c, g, or t
agcagagttccagctcccagtgtgtgggggatgcggacatcttcctgtgcacagagggctctgctgaccctttcagtgacaggggaagggcgcctgcatttggaagaaggggcttgtagcggccgcctgctgggagggcgtcctccagaangggaggcatttgctcctgccctcgcagcttgtcctgaagtaaaattnctctcctgggaaaagtgggagaggaattaggagagccccagggtggcttgctgtgtggggtctgggcgtggcggtgcccttggnccgttaccagccataccctagcctaggttgcccaggtcggccacccagcttaggctactgttggggggctccggcnagccgccc

SEQ ID NO: 528183 - DNA, 178 bp, Homo sapiens
gcttacctgggggggtggggtgggctggaacacaggtgtgtcagcgtgctgtactggaagtttgtatcatagctcatcctgcattccactttgttatactctagccaagattgactgtattagatgaaatgtgaggatcttgttcaatcgcgaaacccccgcttacctcctctatttt

SEQ ID NO: 528184 - DNA, 327 bp, Homo sapiens
tccctagcgacccttagacagcggacccctccgaaactgtacacagttatgaaggttcatgtcaattattcacatcttgcaacacaagtgtatggacttgatttctcttacactacttcagtgtcaaacaaggaactgaaggccatcagatttgcagcttacaaattcacataaaggaaatataaaaatattctgtgcttctgagacaggctctgacatgtatactggtgaggattaccatacttctttattttgaggaagacagtgtaaaatattacataatagcacagatactattgtatgctcttggggttccctgctgtctga

SEQ ID NO: 528185 - DNA, 181 bp, Homo sapiens
ggtgcgctctatgcctaaggagctagtgtttctaggcgagctctctctacccaagtttgcacttgtagttagtgagtctttgtactctactggaatatgaacaggttcataaaaccgattccatggtgaaccaattctgtcggctgcatgatagtcctgagtgcaatcagatagcatttgg

SEQ ID NO: 528186 - DNA, 296 bp, Homo sapiens
actctcatacatattatacagagaacgagtgaatgaatgaatgaccgagcacatatgacatatagtaacacttataaaatgtgggcgaaggctatatgactattgtgagtactgtttttcaaacgtccacttatgctaccataaaaagttaaaaatttaagatacggcaggtgcagtggctcaacacctgtaatcccagcaactcacgaggctgaggcatgagaatcgcttgaacctcatgaggcataggttgaggagagctgaagttgcgccactgcactctagcctggttgaca

SEQ ID NO: 528187 - DNA, 1051 bp, Homo sapiens
  misc_feature (182)..(182): n is a, c, g, or t
  misc_feature (603)..(604): n is a, c, g, or t
  misc_feature (613)..(613): n is a, c, g, or t
  misc_feature (632)..(632): n is a, c, g, or t
  misc_feature (666)..(666): n is a, c, g, or t
  misc_feature (686)..(686): n is a, c, g, or t
  misc_feature (704)..(704): n is a, c, g, or t
  misc_feature (707)..(707): n is a, c, g, or t
tggggttgtcaaggaggatattaatgggggttccatgagtgcggggaaaagggcgggatgactggggagggggaaagaaaccccttcccctggggattccgtgcagcctccgggcctcccggtgggtggggggttagaagtgggagacacctattgaacatttcgtgtagggggcacacgtntctttcctccagcgggtgcctcccttacagtgcgttgaccgtgtgcagcgtgtaagctctcggggtggagactctccatgtggcctcgggcgtacaggctacaggtgatacgctggctgggccggcgatacttgtaggttgcgcctctggttagggaggggtgtttggggtggtgtcctccacttcccggctcttagaccgggggctggcacatcttgctcttcacagggcacacgtggtgcaccagctccccggggtaaagaatgctcactgagatcacaagaacacatctaatgtgtgtggggcccttggtatggcgctagtggaagctcctctacaaggagggagggcgccggggagaacacaagactgtgagacacacgtgggtgtggttagggggcctatgggggcgcttgagacnnccaagaganctgcggtagaacctgtggngctcccacagtgtctctcgagaaaagcacaatanacagcggcgcgacactacangagacgagcagtgtacanaangagacctggcgcagcgatcaatatacactccaggcgctaacataccatacaggctctgtggacgccccatgtggtatgtgcgcgcacgtgaatgcgcatagcagtggttgctcaagaccttgtgtagaccgccagaggaagacaacttcggcgctcaaggggtgactccccgtgaagggggccagatatgggcgggatcacgccataagatagagagaggtagagggggagcagagatcccctgagaaaacgcgtgggggggacaccacggtggacacatcaataacgcggcgcgccgaagtgttagagagcgtgccccaagtgcagggaaaatgggggacccc

SEQ ID NO: 528188 - DNA, 155 bp, Homo sapiens
gcgtatcgatgaaagggatgggtggagatggcgatgatatggaaatattcatggaagagatgagagaaatcgacgaagaaaacttagggagctagcagttgcaggaattgtctagcgtatccattatgggggagctctctcaatcaccatagacc

SEQ ID NO: 528189 - DNA, 130 bp, Homo sapiens
  misc_feature (44)..(44): n is a, c, g, or t
  misc_feature (70)..(70): n is a, c, g, or t
cgcggatgatggtcagaaaacatcttcagtactggacgcagtgntgcagcacagtagcacctatttgacncaacaccattccttcagcgaccacagctggatctgtgtcacacacgcaaggctccacaag

SEQ ID NO: 528190 - DNA, 193 bp, Homo sapiens
taatcacatgagataccccttcacatatcaattccacgcgcctgccaaatcggttgcgacaacatattgatattctaagttttgaatggccttcatcacccgacgacgttcacgaggttcgtcatcaccatgaatttcagcaaccttcaggccacggccacgcaaatttagaagcgatttcctttgggcacgg

SEQ ID NO: 528191 - DNA, 141 bp, Homo sapiens
acaatcctcaatgtaattgttgaccttatcagtgtctattccagacataaactcctgttccacggttaatttatcaagaaaagtcttcagaagtagtgacatctttgatacaattatgcaattgcaggtatggtttgcaag

SEQ ID NO: 528192 - DNA, 219 bp, Homo sapiens
  misc_feature (54)..(54): n is a, c, g, or t
aagttttttttttttggtttgttaaaccagtttctttgtcttaaacatttaaangccccttgaaaacaaaaacaaatgcgggggttccaaagtaaactgctaatattttatctttgggggatgaaaaaaacaaatattttgacttttttcctgggacaatgccccttgatttttttatgcccggcctttaaattgaaaataaacccaattaaattccca

SEQ ID NO: 528193 - DNA, 287 bp, Homo sapiens
  misc_feature (82)..(83): n is a, c, g, or t
  misc_feature (103)..(103): n is a, c, g, or t
agggggaacaaggtaacattaaacaaaaaatcaggatgagaaaggatatgggtacatatgaagattgttttgttttgttttnngagactgagtctcgctatancacccaagctggagtgcagtggcacaatctcggctcaatgcaacctctgcctcctgggttcaagcgattcttgtgcttcagcctcctgagttagctgggattataggtgcccgccaccacgcccagctcatttttctatttttactagagacggtgtttcaccatgttggccaggctggtctgg

SEQ ID NO: 528194 - DNA, 1037 bp, Homo sapiens
ccttttttatataaacacccttgggtaacactctatggcacgaaagcctctttggtggtgtcgaaaataggctttttttctgtggaggaatatagtgatctcttctcggggggtctattgtgtgttatattatttggggctaacagttttatgtgcgaagacacactgtggtaaataaatagacctctcctgtattgttttaatcacatgtttgggggggttttatctacgattattgttttcagcagcctttcgtcgaataattatgggggggggttttccaatcacaagggggcatctctgtccatgatgtgacttttcttggctttcttttttacgtgggggagaaaacaaatttttcaacgatgtgtttttctgccgaaaattaaaaatagggggggttttagagaagatatactttttttgagagcacacttttttgtgggggtaatttataaggtgagggataacccctcttaaaacccccctccaggagggggccaccctctctatgagattatcactagcgtggtcacaccaccttctctcgagctagctccgtcctcctcggtgttgttgttacaacaacactttggtggccatcaacaccgcgggtgggttttggtatagagagagagaaaaagatagtgtgtcccgtataatactggggtgtatagcggtcgctcatttttctacctcacacgttcgacacctccacaccctcgtgcctgtttttcacacagcgcgtgttctccacacaacacaggtgggagtaaaatacccatcgcttctaagattgctcccccgagagttccaccaaagacaacattggaacttttttgtgcggcagtatacaacaacggggggagccccccccgccgccgccgcaaaaagcaaaaaatcccacaaaagggccacacagggggggacggcggcagtcaaaaaaaacaaagaggagggaaaaaaccccccgtcccccccggggggggagagagttttgtttttccccccaaaaaaacaaggataggggctttaca

SEQ ID NO: 528195 - DNA, 293 bp, Homo sapiens
ctcatagtgtgtgcccacatgcccaaaggcagcaagaggcaaagaaaagtatcgatgaggcctactgctctgcagaggcgtgtatgcacaaactgccatatcgaatggtaatgcaggagcaacaggactccttgcgagaagccaacacagacaccctccgtatgctcagatgcacttgcacgtcctggtaaaggcaaggagaaagacagtatctgaggactgaggagggaaggcaatcagctctgccttcgtaaatattgcattgcactgttcccctcttgaacaaatgcatg

SEQ ID NO: 528196 - DNA, 478 bp, Homo sapiens
ctagacatgattctataattgatcactccctgagtctcaagacaccttccgagtgtgtgccctagtccccttccaccctcagcggatgataatctcaagacacctcccgatgtgtctgctcactccaccttccacccccgccgtaattttttgtatttttagtagccgacggggtttcaccggtatttagccatggatggtctcagatctctctgacctctgtgatccatcctgcctcgccctcccagatgtgctgggattacacggcgtcagccacctgtgaccgggcttcagagtgtactctttctagcccatctgaaaatacgtctacgtaggtcgaagataagattgtgtacagggtacatgttgtagaggctaacagaaaacatggcagattatttaacatcatcctgaaagtggtgctttatctgatgaaagtgcttgtactccatagggaaatgttccaacgtgcgcaagt

SEQ ID NO: 528197 - DNA, 620 bp, Homo sapiens
gcacagttggggtttgacaggtgcccagatgtgctcctgtctggggggcgcggaggttgctgtgtgtgtccatatgttggatgtcccgtggtttctttgtaagggtatcctctgttgtcaatttcgcgttggcccccacctcgggggttcccccttccgaggctgggtccttttggagctccttcgtggttgagagaaatccccttggtcacggtcccttcagttccggatggggtgtctgtgcgtagggccctgtcgcgagagatgtctgtgtagtgtcctggcggtcgggcatcgttgtattcccactatggttctggcactttatgacccttgtgaaaaagaagcccctgatgctatttgggcatctagacagacacgctacgggagatatattcacaaccacagagtgcgcagcacgcaccttgcggctcgctgccttcggccagctccacttaaagtcctaggcacgtggagccctctgccttccaagatgcccacagaaaccaaagaatgaaacccagtggatacaccgttcagattccaccaagcaccacctatgcccttacgcccatgaacgccccatggaggaggacggggaggagaaatcgccccagcca

SEQ ID NO: 528198 - DNA, 902 bp, Homo sapiens
gccccccccctgggggttctccggggtgccccacacctgtcctgggtggagaagtatccctccgccctaaccgtggggtgcccgccctctttttctttatcagggctctcctgggtggacgagcaacactgacgcttccttgggatagttccttctcccccggtgtcagtcccaatcgaaaccgtgctttgtccgcttatgaatcgagtagtccctctcgccctacatttgcccactcattcgggtgactgtcgcttctcgcctgctggtgtgcgcaccagcgtcgttttccacgcccgtcttaccaacttgctgcctggcaatcgtgtactgtaagacgcaggttctgggggaacaaccagcgccgtgcccaccggttggttagtattaacctcacgtccagcacctagcgtttcgttggttaggcccatagatccctggttcgctaagcgagaggccgtcgtaagcaaacatgacattcgcctgtagcgaccccaccacccccgccatggtctgggtcgaggcggcgaaccaccacgccctgccaggcagccacggggctctttcctcgtcgactttcttttgagtggcagcatgctgtggctggagcgagcccgactacgccagcgtcgcacctgattggccgtgcgcgcccgccctcatgccctccggagcctcttctctcctctctgtcagggttctactgaccatcgggcagcagacacgttagccctgcctcagttttcgttgacatctttgtgtattctcacaacataagatagactaacatcaccatatatgttacgccaataaaataaaaataatattacaaagaaaaaaagaaaagaggaagaaacaagaaaccatacacaaaatacaaaaaaacaaaaaacatgacgaac

SEQ ID NO: 528199 - DNA, 247 bp, Homo sapiens
catcttatcatagaaacataaggctttacatagggaccatttggggatatgtctttcactggctgtttaagataatatggtatcagagattaatgtttatattctacctcaaagtgtaagaaagaaaacaatgtttcaaattgtctatttgtggggagagatacatggctataggcacattggtaaaggtatacttaaatagcttcttgtcacctaaacaaaagcgaataaaaagtatccttgaaat

SEQ ID NO: 528200 - DNA, 1033 bp, Homo sapiens
cctccggcatctggggtcctgggtgatccaaagtttatcctccacgaaggaggtggaggagtagaaatggcgtgactcattgccgtatggtcctattcgcagtgagtgcattcggtatggtgtccctactcttaatgaccttcacgcggccggtccccttctatagtggaacttgtcgtgccatcgtcggggagtgcgttgccgtattggtggggcgtgccgacggccaccggcggtctgggacctcatggcactgtctgagctgctgccaaagtcctccctgaagtacctccatagagtgctagcacgagtaacattaccccatgagttgtgcagaacgctcacttctccaattgagctaaccacagtagaatgcgtcatctagtgagatattatcaataagacactcatcattcgcttggacaatctgagaggtcttgcccagacagacataggcattggataagatagtgaaagatccgaaatgatcaatcaccttacaccaacacgaagaacccatagagactatcataggcaagggcatcgcgatgctctcttgcgtgagttccacggcccttggattacccaattgagttgcaaacaaagacacaaaaccccttaggtgtatcatggcggtagatttgggcgccacaataggcactagtttttaccgtgcgcagcaagacgcacactttcacatctaggaagggttggacggcgttcatcgtatcgggacacattaggtattggacccttttgccccatagcccagtacgatttccccaatgcaacatatcaagtgccgctggggcctcacggaagcgattggcgcacgggacgccgttggatgttcccatatggactcgtggacaggcaccgagcaataacgcaaagtgacccccaacgcaacacacaatcggtggggtacccaattgggttagggattccaatttcgttgggttggggcattcccagatgggcaacgacatctttgggacaatgtggaagtaaacgaaacatgaccaacccaggg

SEQ ID NO: 528201 - DNA, 241 bp, Homo sapiens
gactttagaggatcccgactggatcgtgctgctcatcgtacgtgttcactgtgtgagacaggcgctggtctagctctcgtggcctgctggacctgctcgccagtgacggcagcaggcgggtagtgcccttggaaagctggcggttcccgatgataaccaggtcccctacagccccagtacgtgacaggtgcgtcccacagcatagctccacagaggtctgcagtgcggcgttggatgcagt

SEQ ID NO: 528202 - DNA, 964 bp, Homo sapiens
tggcgccgcgcagcccatggagccgtgactgacgacgaagtaatacggaagcgtctcctcattgatggagatggtgctgagatgatcggaaaataatctgctagtgagagagttccattaactggtgcacactctctgggccccgaggacagaggggaatatagcccagtaccaaggttatgctgaaggcgcgctggtctcaggtgtgcattttacaagtgcggcaaaacttttaccatagtatagtgcatattgacttctccaagagaacatgcacactctttcttgacaacacattttcccacgggacacatagaaatgtaccgcatagcttggaccacctatgaaaacaatttgggctgcaggtcgcaaaaaacggcaatttttttcaaggcaaaaggaataggaaaaaattcggcaaggaattatgattggtttgtgcaaaaggttgtttcaggcacctaattccagacgaggcattgagaactttacagggaactagaggcgtttcttgcgcaaaaaggaatgagggagcattttccacacttttaacgacggtgttgaaggatacggctgatttgagacgggaacaagtttcatggttcttctagtacccatccatgaatttcagcacacttgtggacattgatgcaaaacttctcagaggtagaaaggaaggtcagggaaggcaaggctggaaacagattctagcaatagacaagggtattgcccaaccaattccaggaatttgattggttactgaccattattgtgttaaatgtggtatgctcttgaaatattaaggtgggggaggaaaatactctgttcagttgaaggtttcctcatttttctccttaaaggaatgcttagataattgtgttaaagggctttcttaggggaggccacaaggttaatgtttgtcaaaaaaaaaaagatgggcgcgaataaatgtggcggaaaatgt

SEQ ID NO: 528203 - DNA, 389 bp, Homo sapiens
  misc_feature (5)..(5): n is a, c, g, or t
  misc_feature (23)..(23): n is a, c, g, or t
  misc_feature (365)..(365): n is a, c, g, or t
catcnttcatagatgagattagntgccttaccaaagagcttgaggggacaaattcagccctccacctcttctgccacgtgaagacacagcatttatctcttttgccgtctctccttccaccatgtgaaaatgcggcaacaaggcactgtcgtgaaaggagagccaaccttctgtagacgctgactttggcagtaccttgatcttggacttcccagacttccaagagctgtgagaaataaatttccatgatttaaattgcctagtttgtagtattttgttatagcagcacaaatggactaagctagcttccctagtgtgagtgcctggaccctgcctttccttgcaagtgactgagagcactgctngtgcatggccttgtgcattggaac

SEQ ID NO: 528204 - DNA, 376 bp, Homo sapiens
agccaaaagctgttattacagtttttctaacccttgccccctccgattcatcgcatccataatctccatcgcatgaaatagccggtctaggtgctcacttacgataacactatagtactttggttttctgattgcttgtgcatatctaggcgtaggattatagcctccagctggctccatggtgcatcacatgtcgtgactgagaaccctgtggcggcgtaatattccatgctctgtatgtaccacatgttcttcatctagtccacctttgatggagacgtattgattccatgtctttgctttgtgaatagggctgttgatgggcatgtctttttgctagaatgatttctgtgcctttgggtactacgctttggca

SEQ ID NO: 528205 - DNA, 165 bp, Homo sapiens
cctcgtggaagtagtttacctgttacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgat

SEQ ID NO: 528206 - DNA, 158 bp, Homo sapiens
cctgctgggccctggagagtcctgtttcacagcccaggggttgtccgctctggcccgccccggagcagggagggtggcttggacaacgcccgagggcccctgcaagcactttacttcctgttcctccaaagccttaaccccaaagccctcctgcaccc

SEQ ID NO: 528207 - DNA, 894 bp, Homo sapiens
cacggaaagcctcatttgtgtggaaagtcagaggaaaaatgatccatggtggacacttggcggattatctgtcatacaacgatccttcacttcatacacccaaggctcagtctcccatctcatttccagaaaggctcatacctggtcttgcaggataagcatctgtcttgtcattccaggtgccagtaatcctctcagaggtcattgaagggtgttcacccatcccagcccaaggcttggcaacactgccagatgtcttagacagggatcttgatgagggagctgaggcgtgcatccaggtcgacgtcagaacggctaaaggataccagcgcctatcccagtttcggacctcgtggcagtggtggcacgaacgaaagacacgtaaatgctacatcctatagttttacagaaggcatgttgcacattctggtcacttagctcatcatagagacgaacccagtggtgacttcgcttgactcagttgctagatagatctgactgcattctaccttgactgtcaagactgaattggttcaaccacgaggctagtatagaagcatgctgcccgaatgtgattgtggccaagtctgaagacttccatagcccgtaaagcgcatgcttgggaccggtggcccaggaagactgccagccaagcacgtcctgcttcgcccctttagttcaatattaatgccaaaaaattccaaggaacacgtgtattcgcaacagaaactccccgggggctttggtggaaagaggggaaagggctaatatccacgggaaacttgcaccaaccagcaatcccgaggttacactggttggcctccccagattacaacaattccttggccccattgggcaacatgagtgccaaagtactttcctttagaccattgg

SEQ ID NO: 528208 - DNA, 377 bp, Homo sapiens
  misc_feature (282)..(282): n is a, c, g, or t
ctggtctagaggatcccagagagtgtattacaaaagagtcaaaaagttttagaaatttataaagtaaaaatgttacagtaagatacagagaatttaatactgaagaaagaaaaatacattttttttctacaggcatgcatcaccagtgcccaggttaatgtgtttttttaattttggggtagggcatacgagtctcggctatgcgtgccgcaggttggtactttgagagcgtcctggtctcaagtaggttctcctggcctcagctctcccaagagggctaangattacagggtgagagatgtgagtcctcgtgtgccaggaccaataaatatatttttaagataagagttaagtgtaacgttaacgtggaacaggtg

SEQ ID NO: 528209 - DNA, 148 bp, Homo sapiens
ggggggggttttccccccccgggggcccccccccctttggggggccttttccccccccccggccccccccttttttccccccccccggggggggggggggggggggttttttttttttttccaatttttttttttttttttagggcca

SEQ ID NO: 528210 - DNA, 568 bp, Homo sapiens
atcatttaaaaaaaaaaagactttgatttgtagttagtttaaaaacaagtgttgcctaatctacctaaagagttaataaactctcttaggatctgctgtctgtcatgattcttgcctctgtgtgtgctttaaccttccgaaaatatgggatagaaaacatcactctgtttaaagtacagtgatgtgtttgctaggcagagtcattttgaaacttctgtttgggaagctatatcaaaaactgaagaatggcatggtcatctaaaaagtgatagctaatttgtactcaagagatagatgtgattttctcaaatctaattcttttaatcagaaggaacagataataccaggtaaaatggaacttaacagtttgttttgttaccatacttttaaaagttatatatgccaaaccattcttcttgttttagtgacccagtctattttggtaaacttattttgtaattttccccataaaaacatactagttacttccacattttattaataaaaaataccatccgttgggctatattggagcaaatgaccatattggtatgctttgtactttgac

SEQ ID NO: 528211 - DNA, 247 bp, Homo sapiens
  misc_feature (13)..(13): n is a, c, g, or t
catgaatggatgncctgagcttgaaaataaactgaaagagaataaaatatctttagagtcggaatatgagaaaatcaaagactccgagtgtggggactggaagaatattcgaggacccaggccttgggaagatcctaacctcctccaaggaagaaatccagaaagccctaagactaggacaacttgactctgctgattcttttttccttttttttttttttaagtaaaaatattattaactggaagg

SEQ ID NO: 528212 - DNA, 418 bp, Homo sapiens
caacctcagtccacctcccaggttcaagcgactcccccgcctcagtctcccgagcagttgaaaccacaggcacccatcaccacgcccggccaatcccctgtagtttccgtgtagagcaaggtgtttcgatatcgctcatcgttgttttaaaattccggacttcaatgtgatccacccgctcagcctcccaaagtgccgggaccacagacatgagccacctcgccgggcaagagatttaatttaaatctctttgaggagatttgaattaaaatactttaggaaaaaaaaatgtcctcagccaggcatggtggctcatgcctgtaatcccggcactttgggaggccgaggcaggtggatcacctaaggtcaggagttcgagaccagccttgccaacatggcgaaaccccgtctctactta

SEQ ID NO: 528213 - DNA, 961 bp, Homo sapiens
gcgcatccagatcccatcgcgctccgcatccgggaacaggggagagtgagatcctcgcgcaccgttcatcgcaaggcggctggaactgaccccaacatggtctgacaactggggacctggacctgggtgccagttggagacggagccgccctacgcctcacccaggattgcctccgcgttgtttcactctgactgtcactgacttttaccgcagctgtaactgtgctccaggcctttccatcttttcccccaggattccctttgaccctgtgtcgccctcagaggccacgattcttgggctcagggactggctttcggcctattggtggtggacgctgggggttctgggccggcgtttcaggcagtcgcttggagagcgagtgttccccgagagcagttcacggtggtgatgtgacttatgagcgggaggaagtgctctatgaagctctgttaatcgaggctgaatggtctccccttacctgaacaaggtcgtggtgagtgtggaattctcccaagctagtctatcacgagagaccttctgtggtctgacatagtggtccccatcatgtttggtccgtactgtgaacacccagtttgaacagacgattcttaccctggcaatgtattgaacagaggccatcctgtccatagaatgagatgccatcacctttcgccgtgacgaagcgtggttgggctcccggcgtgtggggagcatgcccgggaccccgatcgtgggcgttccatgtgcgggttcccaagcatattgacgggtccccttagtcggggttttaaaccccgagttctgtttgcgtttaggcgcctgtaggtggcctctacacggtgtcttccgccggtttgttgtgccggctctgcgagggggtgcacacgcgggggggcggacctgttcctctgtcccaggtgcgtgtctcacagctgctgtattccggaggagcggtgcccg

SEQ ID NO: 528214 - DNA, 333 bp, Homo sapiens
gatacaggccccacagatgtcgacacacatcacagcgacacaacacaccatgcgctaaatacatcacacatactacacacatgcaaatcacatcacagacaccacatacgcaccacaccacataccacacacacgacacatcacatgccacacatcacctgtcacacacatcaaacacacacacaatacaccacacacctcacacacatcaaacaaaccccacacacaccatatcacacacacatcacacacaccacacatgcaccatatgcctccacacacagagacacatacacatcacacaccctcacacacacacaccccacatgccat

SEQ ID NO: 528215 - DNA, 120 bp, Homo sapiens
cgttatagaggaccccggtgtttatccgatgccagtacacgtgagcactactttttttttaaatttattttttgtagagacgggggtctcactatgttgcccaggttgttctcaaacctc

SEQ ID NO: 528216 - DNA, 461 bp, Homo sapiens
ctaagacgaagataagaaactatctagctaagtggagacaaacatagtagagatacacgaggaaggaataggatgtacacatataacccatcaatatagcacccagagtaatttcagcaggacccttctgtaagcatctaaggtacaggtaaggacagacaagataaaaatacaggatgtaggccaggagcagtggttcaagcctgtaatacccagcacttaagggcaggctgagagaggcagatcatgaggtcaggagatacaagaccatcctaggtaacacagtagaaaccctatactactactaaaaataacaaaaaagtaaagttaggtaaagtaagtacgtaacgtaaagtaagccaggcttagtagtgagtagcctataagtaccaagccattcgggaggtagcggcaggagaatggtgtgaactaggaggcagagctagcagtgagatagcacc

SEQ ID NO: 528217 - DNA, 246 bp, Homo sapiens
ttttgtaattttagtagagaaggggtttcaccacgttggtcaggctggcctcaaacccctgacttcagatgatccacccacctcggcctcccaaagtgatgggattacaggtgtgagttaccacactgggccaggattagaattcttggtctcttaacctctcgttcagttttttcctcgtcgactcacatgccctccaaatgaataccgaagttagattttgcatattaaattgaaagaaagtta

SEQ ID NO: 528218 - DNA, 154 bp, Homo sapiens
tactttccacagggctgcagttggcagctcaggaatgccaagatttgaactgtagccaggactgaagggcacaaggaacctacatcttcagaacactgagagggaacatggctgcaactgtgagaaaacataggggaaacatataattgagcaa

SEQ ID NO: 528219 - DNA, 319 bp, Homo sapiens
ctgataccaccactcaagaatctgttttctttctttttctctttttttttgagacggagtcgcactctgttgcccaggctggagtgcagtggcatgatttcagctcactgcaacctctgccttccgctttcaagccattctcctgcttcagcctccagagtagcggggattaccggcgcccgccaccacgcctggctaattttggtatttttttagtagagatggggtttcaccatggtggccaggcttgtcctgacctcaggtgatccgcccaccttggcctcggtggtatagcctcagtggtataggggtggtataa

SEQ ID NO: 528220 - DNA, 453 bp, Homo sapiens
  misc_feature (12)..(12): n is a, c, g, or t
  misc_feature (36)..(36): n is a, c, g, or t
gaattaatgggnaccgtgaacgtcatcgccgcaagntgacgttgtccacaactgatgttggcctttaaaaccccgttctccccccacttatattacccctgatttttcgtttgctcacagcctgaagcgttgcactcccccctttttctggtgacgatggcatcgcaaaacgcaccgggtatcgcagcaatgaaagcagctggatattcggctcctgtttcgccattaattgtatttactggattgctggcactggttttttcccctttcggcgtttattccgtcggtattgcggcaatcaccgcggctatttgccaaagcccggaagcgcatccggataaagatcaacgttggctggccgctgccgttgcaggcattttctatttgctcgcaggtctgtttggtagtgccattaccgggatgatggctgccctgcccgtaagttggagtcgc

SEQ ID NO: 528221 - DNA, 360 bp, Homo sapiens
  misc_feature (1)..(1): n is a, c, g, or t
ngacacataaatgaaatttatgtttagacttgggtcccatcgaaatccaaaacacttctgatccaacctttttatgtaggaatactcaacttacaacagtcattcaccattcctccctacccccagccaccagtatatcaacttcccttaattatgaatttgcctattctgcacattatatataaataggattcataacctatatggtcatttgtgattggcttccttcatgttttcttcaagtttcaactatgttgtagcatggctcagtagctcatttcttttaagtgtcatataatactccggtgtgtacacaccccatattgtgtttatccatttctctatctattctcgtgccgt

SEQ ID NO: 528222 - DNA, 309 bp, Homo sapiens
cgcacggctgggggggcggtggagcccggggccggcctgctctccggggccgaggtgacaccgtgggctgcgggcgcggtggagcccggggccggcctgctctccggggccgaggtgacacgcacggctgggggggcggtggagcccggggccggcctggtgtccggggccgaggtgacacgcacggctgggggggcggtggagcccggggccggcctgctctccggggccgaggtgacacgcacggctgggggggcggtggagcccggggccggcctgctctccggggccgaggtgacacgcacggct

SEQ ID NO: 528223 - DNA, 120 bp, Homo sapiens
gggtgctctgtatgttgaggagagagctcagaaaaaaaggaggagctactctcaggctgcagcagtgacagtgccagggctctgatgtgtctctcgcgagttgtgaagtgtgagacagct

SEQ ID NO: 528224 - DNA, 273 bp, Homo sapiens
cctaggctgcagtgcaggtggtgcgatttcagctccctgcaactccgtctcgggctcgtgattcctcccgcctcatctcccaagtagctgggactaaaggcatgcaccaccacacctggctaatttttgtattttattttgtagagatgacctttcgccatgttgcccaggctggtcttgaactcctgggctcaagctgttttactgcctcagtttcacaaaatcctggaattacaggcctgacctctttgattttgaaatactgttttgtca

SEQ ID NO: 528225 - DNA, 469 bp, Homo sapiens
gagatttcttaatttcatggttctttaaatattataaacacagagtcaacatagaatgcaattgtatttgttaaaatacacacattggaggacaagagcagatgactacttttcgaagtaatgctgctccttcctaaaagtctgttttcaatcctggtaatattaggggctctccggcacctaagaagccttgaatgagagctaatccaatctagagagcgatggtgtcagcatttcggtttgcatatctgtgtgtccgtatctgcgtttgtgtgcgtgtatgtgtgcccctgtgtgtgggcccagttttcaggcatgtagaataagcatggagtcatattgaggacgggctcattgtcatgaagatcatgcttgttgctttaccctcgtatgtgagtatattttttagcattgatgcattcattcttcaatccaaatatgtttgcattattaagatattggagtttca

SEQ ID NO: 528226 - DNA, 861 bp, Homo sapiens
  misc_feature (35)..(35): n is a, c, g, or t
  misc_feature (61)..(61): n is a, c, g, or t
  misc_feature (63)..(63): n is a, c, g, or t
  misc_feature (68)..(68): n is a, c, g, or t
  misc_feature (86)..(86): n is a, c, g, or t
  misc_feature (91)..(91): n is a, c, g, or t
  misc_feature (93)..(93): n is a, c, g, or t
  misc_feature (111)..(111): n is a, c, g, or t
  misc_feature (120)..(120): n is a, c, g, or t
  misc_feature (125)..(127): n is a, c, g, or t
  misc_feature (151)..(151): n is a, c, g, or t
  misc_feature (175)..(175): n is a, c, g, or t
  misc_feature (177)..(178): n is a, c, g, or t
  misc_feature (181)..(181): n is a, c, g, or t
  misc_feature (186)..(186): n is a, c, g, or t
  misc_feature (196)..(196): n is a, c, g, or t
  misc_feature (200)..(200): n is a, c, g, or t
  misc_feature (211)..(211): n is a, c, g, or t
  misc_feature (218)..(218): n is a, c, g, or t
  misc_feature (229)..(230): n is a, c, g, or t
  misc_feature (233)..(233): n is a, c, g, or t
  misc_feature (247)..(249): n is a, c, g, or t
  misc_feature (251)..(252): n is a, c, g, or t
  misc_feature (266)..(266): n is a, c, g, or t
  misc_feature (275)..(275): n is a, c, g, or t
  misc_feature (280)..(280): n is a, c, g, or t
  misc_feature (287)..(287): n is a, c, g, or t
  misc_feature (289)..(289): n is a, c, g, or t
  misc_feature (292)..(292): n is a, c, g, or t
  misc_feature (310)..(310): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (344)..(344): n is a, c, g, or t
  misc_feature (352)..(352): n is a, c, g, or t
  misc_feature (363)..(363): n is a, c, g, or t
  misc_feature (368)..(368): n is a, c, g, or t
  misc_feature (372)..(372): n is a, c, g, or t
  misc_feature (378)..(378): n is a, c, g, or t
  misc_feature (403)..(403): n is a, c, g, or t
  misc_feature (413)..(414): n is a, c, g, or t
  misc_feature (434)..(434): n is a, c, g, or t
  misc_feature (436)..(436): n is a, c, g, or t
  misc_feature (469)..(469): n is a, c, g, or t
  misc_feature (517)..(517): n is a, c, g, or t
  misc_feature (550)..(550): n is a, c, g, or t
  misc_feature (600)..(600): n is a, c, g, or t
agagatacatgaacacatttgataaaataaaaggnttatgtgaataatagcactttttttntnaaaanaaagtgcctctcaaaganttttntnttttgacagtcgcttaantcttcagtntctgnnntgggcacagtggctcatgccagtnatcccagcactttgggaggctgangnnggngggtngcttggggtnaggngttcgggttcngcctggncaacatggtgnnacnggtctctactgtannntnnaattctagattttnctgggtgtngtggngcttgcntngtngtcccaactactcgggtngntggngngggnggntngnttgggcctggggggnggaggttncagtgtgccgngtttnagcnattgcnctccatcctgggcgacagagtgagnctttttctcnnaaaaaaagataaggaaagtntnagaaagaaaaaaacccactgtaaaacaaaagcnaaccaacttcagtatcttatggttctcacactttagcatgcataaganttcctgggagttcttgataaaacacagattgcngggtcccacctccagagtttctgatagagtaggtcaggggtgggccaatnatttgcatttgtaacaaattcccaggtgatgctgatgttgctattctgaggactaatagcaatgattgcaattcttggagtactaatggcctaggtcttgctctttagggaataggaatatatattctgttattctattattgctctacaggtgttataaaccgacaagtgatccacaggaagtacattttgtagatctttagcgcaaggaatattttctatctttaattttttacatctccattttatgaaagcatctaa

SEQ ID NO: 528227 - DNA, 391 bp, Homo sapiens
  misc_feature (4)..(4): n is a, c, g, or t
  misc_feature (35)..(35): n is a, c, g, or t
  misc_feature (42)..(42): n is a, c, g, or t
  misc_feature (57)..(57): n is a, c, g, or t
  misc_feature (120)..(120): n is a, c, g, or t
  misc_feature (220)..(220): n is a, c, g, or t
  misc_feature (340)..(340): n is a, c, g, or t
  misc_feature (343)..(343): n is a, c, g, or t
  misc_feature (376)..(376): n is a, c, g, or t
tttnatccctggctgaaatttagtattggattttncattttnacgctggtgtttttnctgatactgcgcaaagacttctcccacagtagcgccgcagccgggacaatttttgcatttatnagtttcacgacattactgttttactcaacctacggtgcgctttatttaagcgaaggttttaatccgcgaatagaaagtttgatgaccgcgttctattttncgatagaaaccatgtcaaccgtcggctatggcgatattgtccctgttttctgaaatcagcacgattgttcactatttcggtcattatttccggcattaccgttttttgccacatctatgnccncaatttttgggtccggttatccgcggggggggncccggtaccccaatt

SEQ ID NO: 528228 - DNA, 379 bp, Homo sapiens
gaatatatatatatagatatactcacaatatatatatttacagtactttatatatacaatatttatatatatataatttactatagtaaattatccttttccagtgaagaaaaccttgttttataaaaaggaagggaatgaggggagaaatgcatattgcaaagtacaaaaggctatttttaaacagtttatatagaaaggtcacagagaataactcaaaaatatttgaattgtagcactgatacgttaaaatggaacttcagattcatttgtatcctttccatttggaggtttaggttagcaaaccaaatgacccatccagtgaatttgtcaatatagatagatcattcagctcttcagggtttgtagacttaatatt

SEQ ID NO: 528229 - DNA, 481 bp, Homo sapiens
agcaaggttgaggcctagttccagagcatggggtctcggttgcctaaggctaactttttcgacgctatttagctaatctattatctatacctatcctaaacttcatcatctcctcttaattatctatgtcatgatattactctcgacctcatccactctctatcaccctatctttatcatgactagcatatagatccctctatactttgcatcacactcatcttatataatcaatcttctccctagcacttttttcaaactgtattttctcacataactatttcaatacattctctacatttcactctctcctcaacttcttagacatctataactcccttctcactaatcatatttttcatcaccatccttttactattctctctaataccatcttaactattacattcgctctactattcctgtctcccacttacatcatctttgactagtatgacctcagtccccattctattttcct

SEQ ID NO: 528230 - DNA, 595 bp, Homo sapiens
cgtaagtagcacagatgtgaggtagcaatgttgctgttggagttaacaggccaagcatgttgacagctatggaaacttgggtcaccaagccacagactgtgccacatattgaaagtaattcccagtttaagtctgcacacagctccaaaagagtaaggagatgaggggtggactccgtaattgctaaggtccttaagacagatgctgatgacattcaggaagaagttacctgactaaataccttctggatacatgacattggtctatcttggaataacatgcccagtagagcatatacctcagtgagggggtcggcagtactggctttaaagcttaaaaggaataactaaggtatctatttgagggaaatgaatttgaggactacaaatctatttgaggacaccccctcttgtaatttaggagttgctgggaaaaaagacaaaatacaatacacgtcctcacacatgtacacacagatgaatgcgtccgcaacttcgacggacgcattcaaaggcagtgtgtagagggcaatttatagcagtaaatgccccaagagcaagcggaagatcaagattgaacctgatacacattaaag

SEQ ID NO: 528231 - DNA, 690 bp, Homo sapiens
cagtccacacgaaactagacctgaactccagatcgatacagtcacataccctagagtcggaaacacaattacatacgtagaccattcatgaccaatgaatgcatacagaatactgaagtaagatgtaacaactctaagctggacattatatacaaaatacatacaatgggctcatggcctccgactgaatgatacaatgataccaatgcatacaaaaaggaactacactatacaagagcatccactatgttgtacaactccgatgtgtctgctaagaacttgacacaatgttaaactacgacgtcaagcgtcttataagcaagattcaaactatatcatacaatcaacctcaatctcctcgaatcctaacctctcattagggttggcttaggtcaaggacgagcaagtgggtacatgtggcaagtatagacaatgtataccagtcttgaggtagaaaagatatacagcgcaatatgtaggtcgcgcaagataatacggtgtcaagtcgggcattacaactcatataggtgtactacatcaaatacatgtccttttaaaaactcaaaagaaaagtagtgagggtaccacaaggagggttagtgtatgtcatgcgtatacacgaccctcgtgcacatctagtcaataacttgcgttggaatatatacacatcatcaagaaactcgcggaact

SEQ ID NO: 528232 - DNA, 830 bp, Homo sapiens
gaaacttacacacacctagacatagacatgaaattaggagacagataactgcggtgaacactctagaagaaaatatagggagaagcctagtaaacattgcttttggcagattttttccgaatatcacattgaaaagcaggaaccaacaagaagggaattagatcaacggtacatatatctagactgttcaaaaccttctgcatatccacacactctagggaaacactaagctggagtacaaatgccatccaccatgtgacttctgaaacatccaccaccaccaagggtgaataacttcatttttttaatggaccagtgtcttcaaagacatttccttacaacgacagctatgcaaataaccagagaggaattttgaaaagacaatcaaaatcacttatgagaagaatgcaaagcaaaatctcaatgaactctttaactctcacccattagcatggccactgttcatacaaatcaatagaagtaatcaatgtctgtcaagtatgtgaggatttcggaacctccatgcactagttggtggataaggatataatgcagcccatcaataaaagtaggatgcaggttttccaaaatattaaaaatgaactgtggctcatgcctgtaatttcaacattttaggagggctaattgatgggagaattatcttaggctcagaagtatgagttcagcctgagcaacatactgagaccccatctcttcaaaaaatacataaaattagtcagatatgctggcatgtgactgtagtcccagctacttgggtgactgaggtggacggatcatttgagcctgggaaataccggctgcagtgaaca

SEQ ID NO: 528233 - DNA, 403 bp, Homo sapiens
attggcgcagcactgctgtggaatctgtccatcaggagagatcgcacacagttgacaagcgctgtggtcgcactgtgaacttgaacttgatggggtcctcaagagtgcgcgcatatcatcgttcccgtggcagccggtatggcggctctgcttgatgccacgctgttgatgactttgttgtgtcctgtaatctcgcccattgaagaagcactatcgcagaggaagactgctccaaacttctcccttccttccccgaccaaggagaccatcttactgtcttccagtcaagcaattgtctttgatcttcccagcgaaacggtggtactcatacttcaacaggtgctccttctgcgtggtatcccagaacctcagattcccagacacatctccggaggaactgtac

SEQ ID NO: 528234 - DNA, 906 bp, Homo sapiens
ggctgtgtctccggagcagatgcctgtgcttttctgtcaggtcaagtgctacactgcttgcccacataacagacgagacattggggcttgagttgacatacacctgaaacctcgcgcctctgacctgcgcaggctctagagccccatggttaggttcgggtagctgtacctcctctagatcgtgcggttctctgctatgttgtgtcttggcctgtagggtactccgcacagggcgccacggacgaccaatagggcctacggacccattgggaggcagcgagccgtgatagcaaggctcactcgagccgtgccgatggattgaaactctcgatgctccgttgcgtgtgtacccgaacgtacataagctctagttgcgggccctggtcccagtattcgtccatgctggacgcggtgtactggacttcattgcgtggcgcagcctcacgactcgattgcagaggccgcgtgcatccacctgtgagacctcaattcgtacaataggtgagagtgataggttgggttggaaaaatgaccgtcacgacctggtcagaagacacaccaccagtgctccgcgggacgcgggggaccaacgaaaagtgctagaggactgccaagtcgcacgcagaacgggccactagccagatcttgccccgtgcgtcggccccccgactggctcggagcgccctggttgatgaatggggcgcaccagtagtgatggcacagcatagcaaagcaggcgcgtggggaacgcgtaatcacgcgaggcatggtcaccacaggcgctcataagcacgatccacgaggtgagacttgagaagaagctactttggtgacgcctacgcctgccaggcagttagaatctctccttcattgcaagcgtagaatgctaatgctgtacgctataag

SEQ ID NO: 528235 - DNA, 327 bp, Homo sapiens
agccggccctggtgtagcacataaggaagggtccccaggtagtggagagcccaagttgagaacaataatgaacaattattgtatgaacaactgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 528236 - DNA, 100 bp, Homo sapiens
cattgtttatggaattacggcgtcaggatgttttggtagtgaacaacaacgcgcaacaggaaacgcgcactgacagcctaggcaacttcagcctgaagat

SEQ ID NO: 528237 - DNA, 578 bp, Homo sapiens
  misc_feature (267)..(267): n is a, c, g, or t
ccctggggcaccaacttggttgggggggacaccccagaggattttgttccggttcccatgtgcaaggctttcatttccttgcgcgcccttttctgggtggggttccccttcctgccttgtttttaaggagattgggcaaagggcggcccttctctcccccccccacagtgattttccttatcctggtgggctttgaggggcggctcttcctcattttcaccccagtgatgtttggggcccaggtgccctccctctgccccaattagncggggatagccccattttaaaaggaagagagaagatgggcttaaaaaaccaaatgggtgaacctgaaagccgtttttggcccccccttctttttagggtggggcagccccttttccccgcccgaccaagggaaggcagacccgttcccgtttgtggttttaagggccccgcccggcatggcccctcagacccaagtcccccccccagccctaccgtcccctccgttttcttgaatgttttaatcgaaaaagccaaacccctcctttttaaactttttttttgtttccagtaaaatgggtgggccttgccga

SEQ ID NO: 528238 - DNA, 172 bp, Homo sapiens
tcagcttattggaccagtcactgccactgtccgctagaaggccttcctccactgttacacagtgcgagggcatggacgagatggagtcaccgaggctgagagcaaataacgacctcgtctctgagtatcagcagtaccaggatgccaccgaagaagaggaggaggatgtcga

SEQ ID NO: 528239 - DNA, 536 bp, Homo sapiens
tcggggggccactttgtttgtgtcggctgcctaatgcgggcccccttttttgggtcgttgctctcagttgggccactgcccgcctttgtccaccatgggtcgaataattggggtcgccctcctcgggttctttgcgcttcttggtagcgggcgcgtcctcctcccctctctcggtttgagggcgccctcccccctgttggcgcgccctctttgtccccccgttgcagcacagtcctgtggggccagttgtctgcccacacgccccctccctctttatgaggtgtattggcgtctccctattatagtattatggtgggccccaggcgtgtggctccaccaccccgccgtttctcttcgcagtcttcagttgcgacgcccccaggtgtggagaggagtcccgcggggccccaaggggtttgccccccactcctgggcacctatgtcgactagaccccccgtctttttatccaagtactggctccccgccgggtgcatagagatttctattttacacaaagaaaaacaatatcaaagaa

SEQ ID NO: 528240 - DNA, 492 bp, Homo sapiens
  misc_feature (25)..(25): n is a, c, g, or t
  misc_feature (265)..(265): n is a, c, g, or t
atgaactcactggttttttggcagntactgcttttcctttgtgccacccactttggggagccattaaaaaaggtggcctttgtggggaattttagacccacaggccagcaggtagaatccctgggccttctggcccccggggagcagagccttccgtgcaccgaaaggaagccagccgggcctgtccgccccccacaaccgccagatccccgcaccccagggggcggtgttggtgcaacgggagaaggacctgccgaactacaantggaactccttcggcctgcggttcggcaagcgggaggcggcaccagggaaccccggcaaaagcgctgggcggggctgagggggcaggtgcggggcagtgaacttcagaccccaaaggagtcaaagcatgtggggcgggggcgggggggggcaacgtagggctaagggagggggcgctggagcttccaacccgaggcaataaaaaaaatgttgggtaactccctgaaa

SEQ ID NO: 528241 - DNA, 105 bp, Homo sapiens
ccagttaccacacagatagcatcagtctgcaaatgcatgcacaggcaggcaacagcatggcatgctgtcctcatgccctatgcctctagtcccgggctcctctgg

SEQ ID NO: 528242 - DNA, 108 bp, Homo sapiens
tatacaactcagctcggtacctgcaacattcgtgatcctaccctaatctcatcttgaattgcagctcccataactcccgtcgctgtcatggcgaggtacccggtggcg

SEQ ID NO: 528243 - DNA, 123 bp, Homo sapiens
caacgatggtcctcagctgttgattaggcaggacaggtgcaggacagtcgcgactcccgggttcgagagcccgctactacctcggggctttcggggctcggacttcaacgcctcggaaatctt

SEQ ID NO: 528244 - DNA, 826 bp, Homo sapiens
cgtggcaacgttgctggtgacagccaaagtgacccaccactggaagcagcatggcttcactgctcaggttgattatcccgaaccatccaggccaagactaacgcgccgcgtatgcacctgtattggattgccagaacggctcacattgcatgcaacgtttgctgagctgaaggacaaccgcactcgctacgcacgtactggctacaacagctggctcgatggcccctaacactccttgaaagtcatggtgaatgctgcccatggaagaaatggttccctggccaaaccccatggtgatgaatcgtagaggcatttctacataacggttattacaagtgattattggggtacagcatatggattgtaactgtcgatacttgagcacaagtaataggttggacggatgggatgtaactctataaagtcatgatgggcacacagaaggggatgatggacgctcggacaaaccaggcaactcaaaggctcttggcccaaggaaaaggcttcaagacgacgcttcagaatcgaactctttaatacctcttacataccctggccaaacccccaacgtcctttacactccacgtggagtgagaaagagaccgcgcctcacagaaactgattgagtatgtcacacaatggagcctagacaaaagggattaaacgcaagttcaataggagtgtagataaactcgaataaccaagaatggacagtagtacaaaagccgttccaggatagtgaaatgggcacacatgatcaggggtgcgacccacattgaggtatatgcatagactattgcgtatgagagcaacgataaacgataaa

SEQ ID NO: 528245 - DNA, 788 bp, Homo sapiens
tacccattagatcactctgttccttcttcctcctagattaagaaatttgcaatggttgtacgctcatttgaggaatttccgcgttgctgttctgaagagcgcgttaatccacgagtaaaagcatggattgcatgggaagcccgttctgtgcatggtcaccgctaacagatcgcgccgaaatccttgtaaaaagccgcttcccagcaccctgcatactgaggcaccccatggtttccccatggtgtgtgatctctcttgtgtaaaagtgtgttgataaacccaactcgattcaaccgcgagatctgttcctcatgatctctgacgggtggacgttgacgataattttttgagcttagattataactccattttatattttagttgtagatctgcagtacttgatttgctaaaaaatgcaattaccagttaagtgagggaaggttgtagtctttgtgcagtacgtaaccaagagtattctatcattgtaaaaagtatcactagtggtaacattgctcatggcatttgagttccaggtcaaaatactgcagtagtctgcatttgtagtgggtacattaatggtaattatatgtacatattgcaagcatctaatgattgtgtcatcaggaagtttggccatctccaggattgaatttacacgttaccgtaagttgcttccttatacttctctgtacgttacagtgagatcttcaaggatcctttaatcatgatagatgatttacaacactttgcctcaggtaagttaaattggaaggcgtaaagactaatag

SEQ ID NO: 528246 - DNA, 411 bp, Homo sapiens
  misc_feature (2)..(2): n is a, c, g, or t
  misc_feature (14)..(14): n is a, c, g, or t
  misc_feature (44)..(44): n is a, c, g, or t
  misc_feature (59)..(59): n is a, c, g, or t
  misc_feature (74)..(74): n is a, c, g, or t
  misc_feature (92)..(92): n is a, c, g, or t
  misc_feature (205)..(205): n is a, c, g, or t
  misc_feature (324)..(324): n is a, c, g, or t
  misc_feature (330)..(330): n is a, c, g, or t
  misc_feature (342)..(342): n is a, c, g, or t
  misc_feature (376)..(376): n is a, c, g, or t
  misc_feature (387)..(387): n is a, c, g, or t
gnaacaatggcaanaagaacaaatgaagctcaaaaaaaaagggnaagtaactgcttttnaaaataaataaagtngaatacggaagctggggnattttcaaaatgcctttccttcaatttaaaatcttccttaatgtcttcaacatccttaaaaatgaaaggagctaattctttgttcacttatttcttttttcttttttgagacnggagtctcactctgttgccccaggctgaagtgcagtggcaggatctcggctcactgcaagctccactttgggttcacgccattctcctcctcaggctcccgaatagctgggggtacagntgcccnccactaggcccnggctaatttttttgtatttttagtacgatgacangggtttcaccngtgttagccaagggtggtcgttca

SEQ ID NO: 528247 - DNA, 734 bp, Homo sapiens
tctctgttatattttactttttaaaaagaaaaagcagctgggcgcggtggctcgcgcctgtagtcccagcacttgggaggccaaggtgggtggatcacctgatgtcaggagttcgggaccagcctggccaacatggagaagcctcgtctctactgaaagcacaaaaaattagccgggcgtggtggcgcatgcctgtggtcccagctgcttgggaggctgaggcaggggagtcgcttgagcctggggggcagaggttgcagtgggctgggatcgcaccactgcaccccagcctgggcaataagagtgaaactcccatcgtcggaaaaaaaaaacaaaaagagagggtcacctgtgaaacacctttttgaagagcaaaaagagtgtgaagagtctcccccagattcttttctcctttttctcccagagaggtgtgaatttttgggggtggcccaaactctgggggtttctcgaattctcgcgctttcccaaagaaccactttttgtcataggggcatctcctatatgtggtgcgcttccataattctcaccccatttatttataaccagaaatatgagggagagttttttcccctgtgggtggcttttcccctgtttaaaagtgtggggccatatatgtgggtacctcctttgtatccaaactcttcgtttgtttatgttcttcacccctttatgcggggggaaactctctgtctaaaatatcccccttttttaag

SEQ ID NO: 528248 - DNA, 871 bp, Homo sapiens
tgtagtggctcacgcctgtaatcccagcactttgggaggctgaggcgggtggacgacaacaaggtcaggagttcgagaccagcctggccaacatggtgaaactccatctctactaaaaatacaaaaattaggtgggcgtagtggcacatgcctgtagtcccagttactcaggaggctgaggcaggagaattgcccgaactcgggaggcagaggttgcagtgagctgagatgacgccactacactccagcctgggggatacagcgagtctctgtctcagaaaaaaaagaaagaaacaaaaaaggcaaagggagaagaaaatttacttttatagagtgactactaggtggctcatgcctgtaaccacagcacttgtgggagactaaggcggatggatcgcttgagcctaggagcttgagactagcctggttaacatggcaaaaccctgtctctacaaaaaataaaaaaattagctgggtgtggtagtatatgcctgtagtcccagctacttcggaggctgaggtgggaggattgcttgagcccaagagacggaggttgcaatgacctgagatcacaccatgtactctagccctgaagacagagcgtgatgctgtctcaaaaaaacaaaggactccctaggtcctaggtaccaggagcatcattattcatacgtagtgataccctattttccttttccgatagaaaacgttacccatggctttaggccgaccgggtcaatcggtcccctacggcgggggtttaaccaggcttaaacctcgatggttggctaacttacgggccaagaggcgaaaacaaggttcaaggggcgagggtgtgatggccaccgggccccaactggtctcaccgctaggg

SEQ ID NO: 528249 - DNA, 285 bp, Homo sapiens
cctttttgggaatttccccccccccccgggaaaaaaaaaacccttttaaatttggaacgttttgttaaatttttttcccccttccccccccccctttttaaattttttccttggccaccgggggggtttttttggggcaatttttaattttttcccccgtttttttaaacaaaaaaaaaggggggttttttgccccaggttttttttttttttttttaaaaaagaaaatttttggcccccccttccttttttttttttttaaaaaaaagttttttttttttccca

SEQ ID NO: 528250 - DNA, 375 bp, Homo sapiens
cgtctcatcctccttcagcacaacacaaggactttcctgtactttttcctacaagatttccttttaaacaagtgatactgtagtaagtttatttatttttgagagcagagtttcgctctggtagcccagcgctggacgtgcaatggcaacagagcgagactccatctcaaaaaaataaaaagaaaagaaaagaatatagagttacaaaacaaagctgtaacaatcaattttatatttgcccatatatttacctggactatgatctttacttcttcatgcagcttcaaattactgtctagtgccctttcatttcaacctgcaggactccatttagcatttcttacagggaagatctagtaaaggagggatgagcat

SEQ ID NO: 528251 - DNA, 290 bp, Homo sapiens
  misc_feature (277)..(277): n is a, c, g, or t
ccgagacgggctgatcatgaggtcaggagattgagatcaagaccatcctggcggctgggcgtggtggctcacgcctggaatcccagcactttgggaggtcgaggtgggtggatcacgaggttgggagatcaagaccatcctggctggcacggtgaaacctgtctctactaaaagtacagaaggttagctgggcgtggtggcgggcgcctgtagtcccagctactcgggaggctgaggcaggagaatggcgtgggcccgggaggcggaggttgcagtnagccgagatcgcg

SEQ ID NO: 528252 - DNA, 310 bp, Homo sapiens
gtttcttaaatcccgaagaaaaatataagtgttccacaagtttcacgattctcattcaagtccttactgctgtgaagtacaaataccaactgtgcaaattgcaaaactgactacaatttttggggtcttctcttcttccccttccgtctgaataatggggcttagcggggtctagtcttcttgcaattagctcgggcttggtcaccacacccttcccaaaagggaccctatctctctctctcacacaagtctctctcccactctttccaaaccccacactttcaactagagagggtgtccacataatgct

SEQ ID NO: 528253 - DNA, 319 bp, Homo sapiens
acctttgtacgtagctccatactctttaacttcagtgatctctctttcagattaagtcacaagtcctagaacaatatgtaaagaattggacgggcgaggtagctcaggcctagtatcccagcactttgggaggccgaggtgggcagatcacctgaggttgggagtttgagaccaggctggccagcatggtgaaatgccgtctctactaaaaatacaaaaattagccaggtgtggtggcgggtgcctgtgatcctagctactcaggaagctgagccaggagaatcacttgaacccgggaggcagaggttgcagtgagcca

SEQ ID NO: 528254 - DNA, 381 bp, Homo sapiens
ggggatggttttctctgagctggttgtcacttccgtgttttagcactagatggcgaccaggttcattcagctttgcctgttctcactgttgctgtttttagacacgaatcaacgcccagatttgtttcaatacatttcttggagtgttgtttaaaaggaaatttgagatcttgaaatgacctgcccccaagaaatgcttgactattagggttagatgcctcttccatagtctgtggttagagtctgctggattctaccctcttctgggcacagcaccatggatagattctctttcattgtgtggtctttttgctctgatgatgattttctttgttgtacataatgggttttttaaattaagttttggaataattccatttg

SEQ ID NO: 528255 - DNA, 256 bp, Homo sapiens
  misc_feature (101)..(101): n is a, c, g, or t
  misc_feature (106)..(106): n is a, c, g, or t
  misc_feature (117)..(117): n is a, c, g, or t
  misc_feature (121)..(121): n is a, c, g, or t
  misc_feature (128)..(128): n is a, c, g, or t
  misc_feature (135)..(135): n is a, c, g, or t
  misc_feature (144)..(144): n is a, c, g, or t
  misc_feature (151)..(151): n is a, c, g, or t
  misc_feature (157)..(158): n is a, c, g, or t
  misc_feature (197)..(197): n is a, c, g, or t
  misc_feature (201)..(201): n is a, c, g, or t
gagatggggtcttgctgtattgcccaggctggagtacagtagtgattcacaatgcagtcatagcacgttgtagcctcaaactcctgggctcaagggatccntctgnttaaggcctcngagntaacctngggctancaggcaccntgctctnggtttnntgtttttcctaaatggtgtcttttaaggagcagaaagtncgtnttgatggtgccaatttgtcaatttttaatgatagtgcttttccatacattttata

SEQ ID NO: 528256 - DNA, 621 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (600)..(600): n is a, c, g, or t
  misc_feature (604)..(604): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtggaaaagtaagtccctgtggaaaagtaagtccctgtggaaaagtaagtccctgtggaaaagtaagtccctgtggaaaagtnagtncctgtggaaaagtaagt

SEQ ID NO: 528257 - DNA, 3321 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3312)..(3312): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 528258 - DNA, 156 bp, Homo sapiens
caatacatttattatttggctgggtcccttaaggttatttaatatgttgtgataacctttcattctccctctcctccctctgggacatttagaactttgtaacatacgtgcatcgccgttctctctctctaacctcttatttctttgggttctggg

SEQ ID NO: 528259 - DNA, 336 bp, Homo sapiens
ctccctccccggtaccaatttactgtattagtctgtttttatgctactaataaagacatacccaagactggggaatttacaaaagaaagaggcatattggatttacagttccacctggctggggaggcctcacaatcatggcgtaaggtgaaaggcacatctcacatggcagcagacaagagaagagagcttgtgcagtgaaactccctatttatatatttatttatttttgtgatggtgtttctctcttgttgcccaggctggagtgcaatgatccaatcttggctcaccgcaacctctgcctcccgggttcaagtaattctcctacccggggag

SEQ ID NO: 528260 - DNA, 3033 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtcaaaaaaaaaaaaaaaaaaaaaaaaaaaaaaaaaaaaaaaaaaaaaaaaaaaaaaaaaaaaaaaaaaaaaaaaaaaaaaaggggggggggggcgctcaaaaataccccgcggggagggcacgcctaactatcacggccagcccgccttgttgtgtgcaacagaggcggcgcccaacaaaaggagacggagtgtctaataaaacgacgcacgagagggcagcggcggcgcgcgtaaataaaaacacacacggcggatgaggaggagacaactacgatccccaccgggcgcaccattcgtgtggagaggacgcaccccaccactgctggagcgggggcggaacaacactaggggggcaaacacccccacacaagagaaagtaagcagcgccacggaggggagcagtaaaacaacactcatgagcggacgtcatagag

SEQ ID NO: 528261 - DNA, 3009 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtcaaaaaaaaaaaaaaaaaaaaaaaaaaaaaaaaaaaaaaaaaaaaaaaaaaaaaaaaaaaaaaaaaaaaaaaaaaacaatcaacacacaaaaaaaaaaaaaaagaaaaaaaaaacaaacaccagaaacaaagacaagggggtggcccgtatatagcgtcgcgagcgcaaagctagagagagggtagtaagaaggcgagcacgcgaggcggggagaaacaacggcagaaggagcgcggcgatactatagagaaacggagagaggaaaaagagaaagaaagcagaagcgagcacacacatgtaagggcaagagaagagacgcgcccccaagacacgaagagcaggagaaaaaaaacgaggagtggaatagacccacggaggagagagaggagaaggaaaaaaaacggggcgca

SEQ ID NO: 528262 - DNA, 3072 bp, Homo sapiens
  misc_feature (29)..(29): n is a, c, g, or t
  misc_feature (38)..(38): n is a, c, g, or t
  misc_feature (71)..(71): n is a, c, g, or t
  misc_feature (120)..(120): n is a, c, g, or t
  misc_feature (3063)..(3063): n is a, c, g, or t
cctcccggattcaggggattctcctgccncagcctccnaagtagctgggactataggcccgcaccaccatncctggctaatttttgtatttttagtagagatggggtttcaccatgttgnccaggctggtctggaactcctgagctcaagtgaacctcccaaagtgctgggattacaggcgtgagccactgcaccagtcaagtcaatgagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 528263 - DNA, 2330 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaa

SEQ ID NO: 528264 - DNA, 313 bp, Homo sapiens
acctgagtacttaattgtgtttattttcccagtgatcttaaataaaagtttacattgacatttcaatgaattaaagttgaaaataaaattcagtttcagccaggtgcggtggctcacgcctgtaatcccagcacttagggaggccaaggcggttggatgacccaaggtcaggagtttgagatcagcctggataacatggtgaaaccccgtctctactaaaaatacaaaacttagcggggtgggggaagtggcgcatgcctgtaatcccagctactagggaggctgaggtgggcagatcccgatgatttgcatt

SEQ ID NO: 528265 - DNA, 2668 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacaataaagccctggcctcgttggcctcagcggtggagctctgcggctagacaacaaactctcaaataatatataatgaaaaatatgattctat

SEQ ID NO: 528266 - DNA, 3267 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3258)..(3258): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctctttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 528267 - DNA, 1176 bp, Homo sapiens
  misc_feature (1176)..(1176): n is a, c, g, or t
ggagttagatgcatcagcagggcccctagggtctctttctcggataaggttaatctcacgctgggtagcatatgaggatcaagatcaaggaacctttatctctgaggcaaggatcgataacagacccaggctgagtggcggatgtggtgcccagcgctgaggaaactacccgagggcatggcggaccaagtccagagggagactcaggggaagtgcagagaaagatgagcgcaggaggcctgggaggagacattcaaaactcactctgacagcaagccgtatggacccatgtcgtgtgggtttggagcttctcgtcatgccaggcatggagcatgtctatgggatcccatgagcatgcagacgaaccatgacggcgtgaagcgtcacatgcaggcgtggagggacgaccgatatacgtcgcatcgtagcaattctggatagtagtaccaagtagtgagctagtacaaaccaatggccttagtatgggtctgtgcctgtgctcctggcacacaaacctcatcgcgagcttgggcatcttctggctcaagtgctgcagagacctgggttgatatatcttccaacactgccgggaagaccctgtatgggacagatgatggactacctgcagggctctggggagaccccacagacagatgttcgctcggatgtcagagactggccatcattgacgtctccctgcttgacttggtggccctccactctcatgattgtcatcactggcaatattgctagtattcacaggaacccatggcgttgacccaatacatctcccttcggctacaacagagcgttgaacttaccggacgacgctctacatgtcgctgaacttgatcaggccgtgagagaaaccaccgtgcactagaacgaataagcaagaacatgacacatcgaaggcagcgggctatcccgagaccccagaggtttccgaccgaagcggcactaacgtagagcgtgtatatctaagctgcaacgttcggtacaactgaaacacaatctcggtacacagcgacgggaccagagagtcaccgccgtgtgtaaacgcggatcgtcataagggaaaaggatggtaactaacaaccagcagtgactaactatgcatgagcgcgaatgacacgatgtccgtcacactaactcagatgctgtatacgtattttn

SEQ ID NO: 528268 - DNA, 3276 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3267)..(3267): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattcttcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 528269 - DNA, 357 bp, Homo sapiens
cgggctggagtgtagaggcgggatctcggctcactgaaacctgtgcctccccggttcaggcggttctcctgccacagcctcctgagtggctgggattgcagcgtgcgccaccatgcccagctaatttttctatttttggtggagacatgatttcaccagtttgggtaacatgggaagagcttgtctctgcaaacaaaagtttaaaaacaatgagctgggcatggagtcgaccctctggccccagctactcaggctgaggtgggaggatggcttgagcccgggagttcagggatgcagtgtgctttgattgcactactgcgcttcaccctgggcaacagagtgagaccccatctcttt

SEQ ID NO: 528270 - DNA, 3264 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3255)..(3255): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctctttgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 528271 - DNA, 361 bp, Homo sapiens
ttttaagaccccattttaaaaaattattaatcggggggggacttttaattcctatttcaaaaggggtttccctgaagaattcaggaaacaactttttggggaagacagctttccttcccccccaatttttggggggggggaaaaatctgatttgggaagaatttaaaaaacccaaagctttttaatttgtttgaaacaaacttttcgcccggacactttttgcttttacccaataaaaaaagccaagggcattttagttttaaatggggttttccccaaggaaaacccgggggattgggtggggccttttattaaccgcccttttttaaaatttttttcaaaaaaaggaaggaagatggga

SEQ ID NO: 528272 - DNA, 601 bp, Homo sapiens
  misc_feature (591)..(591): n is a, c, g, or t
agaggatcccggtacatctatgtgtcgtgctagtaccagcaccatgcttttgtaccagtatcatgcagttttggttactgtagccctgtagtatagttatgaagttgggtaatgcgatgcctccagctttgttcttttggcttaggattgctttggcttttggggctctttttgggtttcaaataaattttaatgctttttttttctgattctgtgaagaatgttatgggtagttggataggaatagcattgaatctataaatggcttggggtagtatggccattttaacaatatggattcttcctatccataagtatggaatgtttttccattggtgtcatctctaatttctttcagcagtgtttggtaattttggtggtagagatctttcatctccctggttagctgtattcctaggtatttaattcttttggtggcaattgtgaataggatggcattcttgatttggctctcggcttggatgtcgttggtgtataaaaatgcttccatattgtgtatatggatttggtctcctgaaaggttagctgaagttgttatcagatctaggagcttgtgggccaagatcatgnggttgctaga

SEQ ID NO: 528273 - DNA, 579 bp, Homo sapiens
tggtcccctcccatgcctagctggattgcaaagttaagtttatgattatgaaataaaaactaaataacaaaaaaaaaaaaaaaaaaaaaaacaaaaaaaaaaaaaaataaaaaaaagaaaaaacaacaaaaagaaaaaaaaaaagaaaaaaaaaaaaagaaaagagcgggccggcgcgcgcgccgcccaatattccgcccgcgcggcggcggccccgacgcgcgcgccgccccccaccttgtgtaagagagacgccccctctcactgagagaagagatgcgtattatattatagaacagaagagcgagggcgcggcgccgcgttgcttgataatacaacaaaacggcggttgagagggtgagagtgaacaacatacgagcgtgagtagagcgagagggcgagtactatgtgttagcggggagaagaacgccactcttctcctttcttgggtggacgaggagctaaaacacgtaggggggagacacacctatcgctcctcaacaacgtaaagataatatcccgtgcacctctggaggagaggaaatacaataaataaaaataagtggtgatagataaaaa

SEQ ID NO: 528274 - DNA, 358 bp, Homo sapiens
  misc_feature (318)..(318): n is a, c, g, or t
cggccgaagatggtttacgtccgtatccattacttcgacccacaagtacttcggaatttgagtttgaggctttaagaagctggatctcctgccgggcgtggtggctcatgcctgtaatcccaccactttgggaggctgaggcgggcggatcacggggttaggagatggagaccatcctggctaacacggtgaagccctgtctgtactagggatacaaaaaactggccgggcgtggtggtgggtgcctgtagtcccagctacttgggaactcgggaggctgaggcgggagaatgacctgagcccgggaggcggagcttncggtgggcagagattgcgccattgcactccagcctgggcg

SEQ ID NO: 528275 - DNA, 878 bp, Homo sapiens
  misc_feature (1)..(1): n is a, c, g, or t
  misc_feature (132)..(132): n is a, c, g, or t
  misc_feature (163)..(165): n is a, c, g, or t
  misc_feature (167)..(167): n is a, c, g, or t
  misc_feature (170)..(172): n is a, c, g, or t
  misc_feature (174)..(174): n is a, c, g, or t
  misc_feature (177)..(178): n is a, c, g, or t
  misc_feature (192)..(192): n is a, c, g, or t
  misc_feature (195)..(195): n is a, c, g, or t
  misc_feature (202)..(203): n is a, c, g, or t
  misc_feature (206)..(206): n is a, c, g, or t
  misc_feature (210)..(210): n is a, c, g, or t
  misc_feature (215)..(215): n is a, c, g, or t
  misc_feature (218)..(218): n is a, c, g, or t
  misc_feature (222)..(222): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (244)..(245): n is a, c, g, or t
  misc_feature (248)..(249): n is a, c, g, or t
  misc_feature (252)..(252): n is a, c, g, or t
  misc_feature (265)..(265): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (296)..(296): n is a, c, g, or t
  misc_feature (299)..(299): n is a, c, g, or t
  misc_feature (302)..(303): n is a, c, g, or t
  misc_feature (308)..(308): n is a, c, g, or t
  misc_feature (311)..(311): n is a, c, g, or t
  misc_feature (315)..(315): n is a, c, g, or t
  misc_feature (319)..(320): n is a, c, g, or t
  misc_feature (325)..(327): n is a, c, g, or t
  misc_feature (332)..(332): n is a, c, g, or t
  misc_feature (334)..(334): n is a, c, g, or t
  misc_feature (339)..(339): n is a, c, g, or t
  misc_feature (360)..(360): n is a, c, g, or t
  misc_feature (363)..(364): n is a, c, g, or t
  misc_feature (370)..(371): n is a, c, g, or t
  misc_feature (374)..(374): n is a, c, g, or t
  misc_feature (376)..(377): n is a, c, g, or t
  misc_feature (382)..(382): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (402)..(402): n is a, c, g, or t
  misc_feature (407)..(407): n is a, c, g, or t
  misc_feature (409)..(409): n is a, c, g, or t
  misc_feature (419)..(419): n is a, c, g, or t
  misc_feature (434)..(434): n is a, c, g, or t
  misc_feature (463)..(463): n is a, c, g, or t
  misc_feature (491)..(491): n is a, c, g, or t
  misc_feature (494)..(494): n is a, c, g, or t
  misc_feature (501)..(501): n is a, c, g, or t
  misc_feature (508)..(508): n is a, c, g, or t
  misc_feature (510)..(510): n is a, c, g, or t
  misc_feature (515)..(515): n is a, c, g, or t
  misc_feature (520)..(520): n is a, c, g, or t
  misc_feature (525)..(525): n is a, c, g, or t
  misc_feature (529)..(529): n is a, c, g, or t
  misc_feature (531)..(532): n is a, c, g, or t
  misc_feature (540)..(540): n is a, c, g, or t
  misc_feature (545)..(545): n is a, c, g, or t
  misc_feature (557)..(557): n is a, c, g, or t
  misc_feature (569)..(569): n is a, c, g, or t
  misc_feature (572)..(572): n is a, c, g, or t
  misc_feature (611)..(611): n is a, c, g, or t
  misc_feature (646)..(646): n is a, c, g, or t
  misc_feature (657)..(657): n is a, c, g, or t
nacatgcaaaatacagtccatgcatctgccattttaaaaagtctctcatcctatagcagataaaaccaagtatatttcgtctatcaacattcagtaaatgtttcaaaatgctttagagtgtaaagataaganatttagcaaaatttcaacaaacctgtataannnanggnnngnggnnccattttatttcanggngacatgnngtnatgnaaatngtnagtnattgtnatcngngtntctttgnnaanngtnaacaatacaaggncttaanaganccnggcctcagggctacacangcnaannggatngtnaganagtnnagggnnnccaangngtgcnatttttaagtgtgtatatgtngtnngttttnnaangnncaggngnggngggggngttaggggngggangntggggggggnggggtttcggggggngggggggggggggggggggggcatggggngagggttctgggaggttcatacatttcngangaacatnttgggtnanttccnttgcnattgngatngnncacaactngggtnggggcttcagcnagcgcgcgcgtngcnagggcggcgggggaggcgtgtttgaggttcctgaagggnacgggctggacgatgtctcgggaacaggctctccnttgggtgaccncagaatcccatcatcaccgtccagcatctgcatgtcactgaagtcagcgttccctactcccacgatgatgactgacatggggaggtgggaggcatggacaatggcctcccgggtgtcggccatgtctgtgatacaccatctgtcaggatcagcaggatgaagtattgcgatgcctccttggtgttagtttcctctgacgctgacttggcaaccttctggat

SEQ ID NO: 528276 - DNA, 131 bp, Homo sapiens
cgccactaacgacgtgcacgatcgtggaagcctgtggctacaaacaaatgttgagccgtagactgccgtcggaacatggtgaagggagactcgaagtactctgcaggcttgtacggacgggtaaaactaga

SEQ ID NO: 528277 - DNA, 446 bp, Homo sapiens
  misc_feature (11)..(11): n is a, c, g, or t
  misc_feature (43)..(43): n is a, c, g, or t
taagggaattnaaatccccttggggccaattggggtcccttantttgcggatacgccaggtttatggacttttaaaccttatttttcccaacactaatttcccagtgcttcaacatcaactccctctcttttcaacataaaattgatgaagggatgtggcagagtttgatttttcaaaaatatgtaacaatatttttacagttttcagattgagggaagcagaaaatggaaataattaacttttcttatgtgtctataatagtatactaaaacaaaatataaggcaccgttaaagataatttttattttgcttatattaaacatgtgagttgtatgtttttaatttgggttgtttgactaatgggaacatcctaaaagcatcacagtggttttgaaccatttaaattcaaacactatgatctgaaaataaatgagttatttgaaca

SEQ ID NO: 528278 - DNA, 321 bp, Homo sapiens
  misc_feature (12)..(12): n is a, c, g, or t
  misc_feature (112)..(112): n is a, c, g, or t
  misc_feature (127)..(127): n is a, c, g, or t
  misc_feature (254)..(254): n is a, c, g, or t
  misc_feature (289)..(289): n is a, c, g, or t
  misc_feature (306)..(306): n is a, c, g, or t
atccgccagttncacgcgtaggacacagcactaaagcctgggtttgaaatagcgacctctttacactggcggaggatccactgcgggctaagcggaagtgtttcttgttcancggtgtagcgtgctnttcgcggataagtatcggccaggcatccgctcccggtgcaggtaagtgattatgtctggcggtaaatgtcacccagcgacaccactgggttactgactcctgcatcgacaatctgcagagtatcttnaaattcgctataaagtagccctgctcatgaaatgntctggctccaatctccntggaaagtcatccca

SEQ ID NO: 528279 - DNA, 878 bp, Homo sapiens
gggttccaattggggatggtcctgagaattggacttttttttctgttgttgttgtttttgagacggggtctctctctgtcaccaggctggagtgcagtggcacaatctcggctcactgcagcctctgcctcccgggttcgggcgattctcctgcctcagcttccctagtagctgggactacgggtgcccatcaccacgcccagctaattttgtatttttagtgaagacgggggtttcaccatgttggccaggatggtctcgatctcttggccttgtgatccacccgctcgactccccaaagtgttgggattacaggcgtgagccatgcgccggctgagaattggacactttcaatctgtggccctgagaggctggtggcagcaacaccagggtcaattcagtggggaaggttcccggagtagggacgaacgatggagatggggtggcttgggatcaggagtgagcgatggcaatgccgatggaatcagcaggggacaatgggacgatacagattggcaatggagggccaagtgcggtggtcacagtctgggaactccccagccatttggggaggtccaggtgggaggctcacttgaggggcaggagtccagaccagctgggcaacatggaggacccccatctctacgacaaaaatttcaacatcgcgggcttatgggcagtccgttgtccccacggtcaggagaccgaggtgcagaatgtgtgacccgaattgggctcgggggctgctgaaccgttacccgcggggagggaacaccccaaagaaaacaaaagttcggcgccccagaatatcaacatttgggggccaagaggactgatcagacggaccgttcccaagccgcgctcagagcgtggataag

SEQ ID NO: 528280 - DNA, 126 bp, Homo sapiens
gcgaccgatagtttgctcggttcggtcacgacatggacacgacttccctgcggtgcgcccgccctcgaagttcgcggacgtcaacagtccgcatctggtcacaccatggaggtggagcgtgaccat

SEQ ID NO: 528281 - DNA, 283 bp, Homo sapiens
ttgggagcataattgctcacaaagattcatagattttttttttattgttaagctgcaacgtacatggtttaatacaacaacaaaaaaaatttaatcaagtgaaacgtaataaactgaacaataaacactcaaaacattttccattagaacatgtaaagacatatgaggtttgttacatctactgcatttctatgtattactagtctactaccatgttctgtatcatgcagatgtgatgagtgatgataatatgaagtcgtactgcaggatcatcaagcgcacg

SEQ ID NO: 528282 - DNA, 268 bp, Homo sapiens
  misc_feature (203)..(203): n is a, c, g, or t
ggaccgcctcgctgtcgctgggattacaggccctgtcactatgcagctattttttgtatttttagtagagatggcgtttcaccattgtccaggctggtctcgaactcctgacctcgtgattcgcccgctcggctcctgaagtgccaggattatggctggagccactgcgtctcccccatcttcaccattttaagtgtacagcntttcaagtggcgttaagtacatttcaccttattctgcaaccaccaccactgtccagcgacagcga

SEQ ID NO: 528283 - DNA, 107 bp, Homo sapiens
tctagaggatcccggatccttattaaaaatggttacctcaggatgacgtgcagaacaatgggtaatggataaaccgttgagacgtggccccacgtgttaggatgtgt

SEQ ID NO: 528284 - DNA, 794 bp, Homo sapiens
cctgacgtcaggctcgggtgtcaacctctgacttattctgcagatgctctggtgtgtgtgtgtgtgtgtgtgtgtgtgtgtgtgtgtgtgtgtgtgtgtgtgtgtgtgtgtggggggagaggggggggcaggggggcgggggagagagggaggaggagggaggaagagaagacatcacctcaccctcaatcatgctgcagagcagcagcagcatgatgtgtgtgtgcagagaggagagagcagcgtgcgcgcgcagcgagggggggggaagaagaagaagcagcagcagtagtgataaatatgtagacgcgcgaccaccatcacacagcagctagagtgcccggccgaagacagaagaagaaagaagagcgagcggaggcgggccgcagcagcagcgggggtgggtgggcagcagcagagaggacagcacaaagagagaggagagaacacgagagagagcgagcggaggagcgaggaagaagaaagtagtagtagctgcgcggcagctcctacttaccgacagaggaagacgcagcatgtgtcgctctagtattacaacaagagaccgacgagggcgtgcggtgatagtgagtggagcggggaagacgcactcacgtaatagtgaggggaggaggtgacgaggaggagcgacgtgctggccgcaggcgccgcagaggggcgacgccagatgcaagagccgaggacgagcaacaacccacagaggcgcgcggaaccaacagtaggtggctgcatcacgcacccgtggtgaccgaggcgaaagtcgccgcagagga

SEQ ID NO: 528285 - DNA, 258 bp, Homo sapiens
agcaatcccaggggcctcacagtgcacgtgagctgcgacgcagtcaccgtggagttggagctgacgcggtgtgtccacgtgccatgagctcgtgaacgcagagcgggtatatggcttgagcttactgtcaagtggagacaggcagtgacacatgaaactacaaacgagttgataaggcggagcttgtactgatgagcatagccggccgtgagcctacgagcacccctgctcgtggagttattgttgtcatggcggggg

SEQ ID NO: 528286 - DNA, 332 bp, Homo sapiens
tcgaagatggcggttgggcacctaggtgcagcatcggggaagaatctatggtcctagaacctttggtatggttccctccaagggctgagtgtgcctgccactgggcttggacagtctgggtgccttgacccaagcaggttctttctagggagacctgaggccggcacctggcccaggtgctcttggcatatgggaggcagggcggagggggagctcaggctcttgcctatgtggcgctgtctcctgtcagagtttcaggagtaagcaggacgtgatccgccactacaagatgcacagagaagcgcgacaactccctgcatgcgatgcctcag

SEQ ID NO: 528287 - DNA, 961 bp, Homo sapiens
gagaaccaactcatctttattaaatgcatcgtgtgtgtgtgtgtgtagtagtgttgtgtgtgtgtgtgtgtataccacatactacgggcctgcgggaccggaccccatagagctggtgaggaaatcaacttgtggttcatcattgcaagctgtagaatcccggggggacgaaagattgccgacgggaggggttgtggtccatcagggcctcctcaaaggtgggtatcccatggcctgtgctgtgatcacaaagtgaacccgggtcactcatatagtcctcgagctccccatgagaggggctgtgacgtatgcgggatgagttccgccgcgcgccccgcagggaactccccgtatatgaccagaagtgctccgcccgtgaaagaaatctgggcgcctcatgggatcgtggcaagctcagggagggcctccgtggtgtccccatcaacgtgtcgcgtgttcttcactcgggtggagccctgaatgcggggtcttccccattctccctcctggcccggggtggcagtcgtgtgtcccttcgtgtctgacaccctggatcaagctcatccctcctgtgtccccaaggttttcttcccggccccattgtccgtggtccctttcgtgggttgttcccccctcaagtgtactattatcttcccgtggaagcaactgggtgacggccgcttggctctcaatccaggggggttagggggggcccccgggggcatgaggcgtgccccccagctgccctgagatggagccttggggaaccgacctgggggtcgcctcaagaaggaacgccgggggggcacacaaataccccggtgccaccgttgtagaagggcacaaccctcaccaatgggggaatctgcgccgcacatagggcacccctgggagggaccccacaccacgtgggaaagccagaaccacctcttaaaatgggcccggcaaacaggccacaggc

SEQ ID NO: 528288 - DNA, 325 bp, Homo sapiens
  misc_feature (78)..(79): n is a, c, g, or t
  misc_feature (82)..(82): n is a, c, g, or t
  misc_feature (87)..(88): n is a, c, g, or t
  misc_feature (94)..(94): n is a, c, g, or t
  misc_feature (104)..(104): n is a, c, g, or t
  misc_feature (109)..(109): n is a, c, g, or t
  misc_feature (112)..(113): n is a, c, g, or t
  misc_feature (115)..(115): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (130)..(130): n is a, c, g, or t
  misc_feature (134)..(134): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (147)..(147): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (167)..(167): n is a, c, g, or t
  misc_feature (172)..(172): n is a, c, g, or t
  misc_feature (188)..(188): n is a, c, g, or t
  misc_feature (214)..(214): n is a, c, g, or t
  misc_feature (263)..(263): n is a, c, g, or t
  misc_feature (267)..(267): n is a, c, g, or t
acatgtgatgtgtgtatacacattcttgctcgaaaccaacatagtcctcaaacagttggccactgaacgcgagaatanngcncagannatgacntccatgtatntgggnacnntngtnttgnctcnagtntcancctancncntagnatatcattnggcntncnttncgcangcccctgtgaacttcngtttcctaaagtaattattccaaatnatcactactttactcagcttcctccttttctcttaatagatgatctttntccngtggcacagttggtcgacgatgggggaccatcatgatagtcgagcggcaggcaggcaa

SEQ ID NO: 528289 - DNA, 352 bp, Homo sapiens
  misc_feature (105)..(106): n is a, c, g, or t
  misc_feature (109)..(109): n is a, c, g, or t
  misc_feature (114)..(115): n is a, c, g, or t
  misc_feature (121)..(121): n is a, c, g, or t
  misc_feature (131)..(131): n is a, c, g, or t
  misc_feature (136)..(136): n is a, c, g, or t
  misc_feature (139)..(140): n is a, c, g, or t
  misc_feature (142)..(142): n is a, c, g, or t
  misc_feature (145)..(145): n is a, c, g, or t
  misc_feature (149)..(149): n is a, c, g, or t
  misc_feature (153)..(153): n is a, c, g, or t
  misc_feature (157)..(157): n is a, c, g, or t
  misc_feature (161)..(161): n is a, c, g, or t
  misc_feature (166)..(166): n is a, c, g, or t
  misc_feature (168)..(168): n is a, c, g, or t
  misc_feature (170)..(170): n is a, c, g, or t
  misc_feature (174)..(174): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (194)..(194): n is a, c, g, or t
  misc_feature (199)..(199): n is a, c, g, or t
  misc_feature (215)..(215): n is a, c, g, or t
  misc_feature (241)..(241): n is a, c, g, or t
  misc_feature (290)..(290): n is a, c, g, or t
  misc_feature (294)..(294): n is a, c, g, or t
ggtcacatttcaggcccagataatcgtatgtgggacagtgcatgtatataccatttatgctgtagaaaattcttctcaaccacttagcctctaaatgctgaatanngcncagannatgacntccatgtatntgggnacnntngtnttgnctcnagtntcancctancncntagnatatcattnggcntncnttncgcangcccctgtgaacttcngtttcctaaagtaattattccaaatnatcactactttactcagcttcctccttttctcttaatagatgatctttntccngtggcacagttggtcgacgatgggggaccatcatgatagtcgagcggcaggcaggcaa

SEQ ID NO: 528290 - DNA, 821 bp, Homo sapiens
  misc_feature (442)..(442): n is a, c, g, or t
gcgggcggctgagacgcctgcctgcctggcacctaggagcgcagtggagccccgagcaccgccgtccgccgctcattggacgtcctgatgatccgacagcccgatggcccgtcacgctcctgtgtgtaaagacgccccaaccagtccgctcaccgcgacttggagtctagagtaggctgagccgtcgtgtcatggagctgttgaggccatcctcagaaggacccacctgcagtccgactggtacataccccggaatgcgatccagcgataccagatgtggaccaagagtggtattaacttgtattcatgggtaggacgtcatgttgtctaggatcaccaactgtctcagcggtacttttgctatccacacaacgtcaggaaataaatcgggcaactgtttatgtgcactcatggctgtgccagattgtgacacgagttcccnttcaagacatagttgccaagaacaatctaaacggcgctatatggctgcgactggaactccacagcaggaagtcctgcgtggcttctaactcggggacagtatcctgaggattcctcaagtgattggtttaaaggcggactgggtacgtctcttcgcgacacgctttcttcccctgggattggggaaaaacgtctccaaggccttgaagctgcccaggcaggcattccaaaggcctgtgcgtcctgggttctccggttacactaccctatgggtggatttcagcttcctggtgccaggcgatattgccgatgtacttctgcatatttgcagcactgtcgtcagggctttgtcccaccatgggcgggattcgggttcgccg

SEQ ID NO: 528291 - DNA, 217 bp, Homo sapiens
ctaattggttcttcgatgacgctctgctccaggcgtcctgcttacagcactgtgcctttgtcgcgctctaggatgcccttctcttgcctttgaaatattacctcactcgctgatgaggatatactatatcccatgtgttattcgactatgaatcagcttgtggaggacttgaagccttccttgcatcctctccgttcgtcatcgaagaaccaattag

SEQ ID NO: 528292 - DNA, 174 bp, Homo sapiens
gagttacgcaatcctgctcatacatgtgccaaattactcaaagtggcatcaaagagcgaaacttcagagctaaaactatagaacttatagaagacaaacgggcacatcttcatgaacctggatttggcgaaggacacaaagtaaaccagaatattaaccaaaatacatacttag

SEQ ID NO: 528293 - DNA, 187 bp, Homo sapiens
  misc_feature (2)..(2): n is a, c, g, or t
  misc_feature (14)..(14): n is a, c, g, or t
  misc_feature (33)..(33): n is a, c, g, or t
  misc_feature (51)..(51): n is a, c, g, or t
  misc_feature (87)..(87): n is a, c, g, or t
  misc_feature (90)..(90): n is a, c, g, or t
  misc_feature (175)..(175): n is a, c, g, or t
tnaaattatttaanagatgtatggtaccatttnaaagtggttgtatctgantttactgtggggattacatacactgtaatggggganaantacctaaaaccaattttaaaatggctttctttgtatttcagtttaaaaacccagtgcatgtacgcccttttagatgcaataaacnccttgaccaaag

SEQ ID NO: 528294 - DNA, 327 bp, Homo sapiens
catctcaatactgtactttttgcacggattatataatttaatctacccaacaatcctatgggtaggcactattgttaactctgaagtttagagaacttgatcagagtcacacaactagtgagtggaggtggcagcattcagacttccctgagtctgaccccagactttacactattgttaatatcctgcagtcttacattcgcctgtagttgcatgttaattttctttctcaattgcagcatcagtttcttcaggagttctgcttttatcagatactttgcagactcatcaaatactcaatgttcacatagagaaggaaaaaaaatt

SEQ ID NO: 528295 - DNA, 1239 bp, Homo sapiens
ctgtgggctgactgtgcagactccggtccctgctgagccaccctgaggggtcccgtggcctccgctggaccctggaatcttggtgccctcgcagtgaccctgctgcccctgcccgagtcgccaccaagtggcttcccctacacaccgactgtgatgtgaagtcgagccgttgtgagccatgcacgtggagagtgaactttagccgtactacctgcggcaacacggtggccatcgcagatgtcgtcgcggccatggctgagacgggtgcaggcgacgactggccctgattcgcccatgggaccccctgagaatgcttgcgcgagtgatcaccacccggccgtgtgcctatagacgtcatgggcacatcccctggcatatcacctgctgcggcagccccgtgccatcctgacacatccacccgaatacccatcacacctgacgcgctcgtcgcggaccagagccaagatcattgcatagacactggcactccgtggccctctggctcagtgcccagtgcccagcgtgaggcgcaacccccagacagactcgtgacgtcggaaacacccactccccaggtcaccagacacttacttacctgccatcgcagacacctgcgattctcccgtcacagatgcccagggaggctcagccaggaagccttccccaccctcacgaccccctgacaagggtccacacattcccattaagccagcctcattcccttccctcggacccactaggctggacaccgagcatggcagcccccgccggctgttggtcacatcacgcgctcctgagtggcctcaagaatgacctctgtcagagccacctggcgattgactcaaagccccgtaccatgaagcccttcctacagcacgagcattccacgacgcactcagcgcggcaccgtcgaccaacgggcatccatacgcccagacgggaccaacaccgctgcacccccaacgacacgaaccgcccgcaccccacatggcccgccccaacaccgtctacccaatgatccacaaattacggggggcacccagacaacaccgatccccccgactatcgacccagagacgccctaccccacacaactgatgtgtacgcaacaccaacaagctgattgacaactgccaactcgaggcgataatggatacgatcgctacaccaatgacatacatgcctcaaccttaccaacgaacgtgagagcagccgtccacaatcacactagcaacttcc

SEQ ID NO: 528296 - DNA, 2768 bp, Homo sapiens
  misc_feature (12)..(13): n is a, c, g, or t
  misc_feature (18)..(18): n is a, c, g, or t
agcgggagtatnncgctngcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttgggcaattttacatttggaattttatcactgtgcttttttatatgaggcactgtagtattttcacatagtatagtactctggatgttaaaagctcaaaaattgtggattccttgaacgtcactaaatcttcaagcaaaaacacatttttacattcattttacgtggatattttagtgaagagaccatatgaagaagcatttttaatattaacttgtgacatacttagatccactttacatcatttctctgtgttgaggtagggaaattagggttcagtttatcactggacattcaggaggctagtcaatcttgtttgtatttccttataaaattgatcttcaaaagccgtttaaacagagagttatcttaatttttattggcagtaggaggaaatatatttaaaatatttgtcagatttatagcaagaatagagactcgttatttaaaggttagataacaattgtgctttgtagttttgccagtttagggcagtagctgctttgtcataaatatcttcctaccacatgcaaaaatgctgcttttaaaattttgtgtataaattgagaaggaatgttgctctctataagttctgtcattgaacagatcaccattaaaaagaatattagaatccagtatgaagattatggtaataaaaatgaggtacatactttataaaacattatcagatttgaatgaggaatggttccacattctgaagaaaactgttggttaagtttgagaatctgggaagaagtttagatccattctatagcagaaagatgttagttgcgcaataaagaatatgcatcgttgctaataagggatagcaaaaagaaaaaaattggggcggcgaaagttaaaatggggggccggaaaagtattcg

SEQ ID NO: 528297 - DNA, 439 bp, Homo sapiens
ccccagtcggtagccctttttttgcggaatcaccatggcggctgggaccctgtacacgtaccctgaaaactggagggccttcacaggtctctcgatcgtctgctcatgtacagcgtgggctcatggtccgacgtgctctaccgcaccaccccgacttccatttctggccaaaccaaccgtcaccccctggatttctccgcaacatttcctggccggcaagcgtcccagacatttgagcggtgatgattggattctgtgctgtttgagagcaacgcctcttgcctactgatgttagcaactgaggagctgcgggagaagtactccaatagtgcagcagccctagctcgcgcagtgggtgagctttgctgattccgatattgtgcccccagccagtacctgggtgttccccatcttgggcatcatgcaccacaacaaactg

SEQ ID NO: 528298 - DNA, 417 bp, Homo sapiens
  misc_feature (15)..(15): n is a, c, g, or t
  misc_feature (110)..(110): n is a, c, g, or t
  misc_feature (113)..(113): n is a, c, g, or t
  misc_feature (181)..(181): n is a, c, g, or t
  misc_feature (188)..(188): n is a, c, g, or t
  misc_feature (192)..(192): n is a, c, g, or t
  misc_feature (232)..(232): n is a, c, g, or t
  misc_feature (264)..(264): n is a, c, g, or t
  misc_feature (269)..(269): n is a, c, g, or t
  misc_feature (278)..(278): n is a, c, g, or t
  misc_feature (332)..(332): n is a, c, g, or t
  misc_feature (334)..(334): n is a, c, g, or t
  misc_feature (354)..(355): n is a, c, g, or t
  misc_feature (395)..(395): n is a, c, g, or t
gtcacaatgtgagangagaaataaaaaaaaaaattaaaaaaaaaaaaaaggaaaaaaagaggaaaaaaacaactaaaaaataaaaaaaaaaaaaaaaaaaaaaaaaattnttnataaaaaaaaaaaaaaaagaaaaataaaaaatacaaaataaatagattacccacttttaacataaacnaaaacanacanacaacccaaaacaaaaaaagcaagaaacaccaccaaaaancacttcattacaaatcatttgacaacatgctnctacntttcctacnccgaagcaacaaaccccccagaaaagtaaaccttcccctccgttaccatcaccntnatcacctctatgaaagaagnnaaagacccccacataacattcccgttacaacccaaggggntatttcttttagctgctggagc

SEQ ID NO: 528299 - DNA, 2690 bp, Homo sapiens
  misc_feature (12)..(13): n is a, c, g, or t
  misc_feature (18)..(18): n is a, c, g, or t
agcgggagtatnncgctngcgagatcttctctgtggcggagacagccagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttgggcaattttacatttggaattttatcactgtgcttttttatatgaggcactgtagtattttcacatagtatagtactctggatgttaaaagctcaaaaattgtggattccttgaacgtcactaaatcttcaagcaaaaacacatttttacattcattttacgtggatattttagtgaagagaccatatgaagaagcatttttaatattaacttgtgacatacttagatccactttacatcatttctctgtgttgaggtagggaaattagggttcagtttatcactggacattcaggaggctagtcaatcttgtttgtatttccttataaaattgatcttcaaaagccgtttaaacagagagttatcttaatttttattggcagtaggaggaaatatatttaaaatatttgtcagatttatagcaagaatagagactcgttatttaaaggttagataacaattgtgctttgtagttttgccagtttagggcagtagctgctttgtcataaatatcttcctaccacatgcaaaaatgctgcttttaaaattttgtgtataaattgagaaggaatgttgctctctataagttctgtcattgaacagatcaccattaaaaagaatattagaatccagtatgaagattatggtaataaaaatgaggtacatactttataaaacattatcagatttgaatgaggaatggttccacattctgaagaaaactgttggttaagtttgagaatctgggaagaagtttagatccattctatagcagaaagatgttagttgcgcaataaagaatatgcatcgttgctaataagggatagcaaaaagaaaaaaattggggcggcgaaagttaaaatggggggccggaaaagtattcg

SEQ ID NO: 528300 - DNA, 2809 bp, Homo sapiens
ggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccaggtgagatggagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttgggcaattttacatttggaattttatcactgtgcttttttatatgaggcactgtagtattttcacatagtatagtactctggatgttaaaagctcaaaaattgtggattccttgaacgtcactaaatcttcaagcaaaaacacatttttacattcattttacgtggatattttagtgaagagaccatatgaagaagcatttttaatattaacttgtgacatacttagatccactttacatcatttctctgtgttgaggtagggaaattagggttcagtttatcactggacattcaggaggctagtcaatcttgtttgtatttccttataaaattgatcttcaaaagccgtttaaacagagagttatcttaatttttattggcagtaggaggaaatatatttaaaatatttgtcagatttatagcaagaatagagactcgttatttaaaggttagataacaattgtgctttgtagttttgccagtttagggcagtagctgctttgtcataaatatcttcctaccacatgcaaaaatgctgcttttaaaattttgtgtataaattgagaaggaatgttgctctctataagttctgtcattgaacagatcaccattaaaaagaatattagaatccagtatgaagattatggtaataaaaatgaggtacatactttataaaacattatcagatttgaatgaggaatggttccacattctgaagaaaactgttggttaagtttgagaatctgggaagaagtttagatccattctatagcagaaagatgttagttgcgcaataaagaatatgcatcgttgctaataagggatagcaaaaagaaaaaaattggggcggcgaaagttaaaatggggggccggaaaagtattcg

SEQ ID NO: 528301 - DNA, 427 bp, Homo sapiens
aatcgggcaggccgacaaacgtccgcgcacgtccactgtgtagcctttgagccccaggtagtcggccaggttggcgaggatatcgcggttgtcttcaacgcaatagaattcgcatgggcagtgtctccggtacgcggtaacggccgtgtggctcgcgcagcttaaggccaagcggggctcagggatagaggtgagaggcccgccgataaaggttttcaactgtttgtaaagccaaacaagtttttcactatagcttcacaatctaactacagtgtcaggacgaagatcgccccccattgatataaggaacgtagacatgggttgtttcaaaacagcgccaatgcgctattgctgttgatcaccggtgcctggttagtggttttcctgctcacccgcagtgtgctgctcattacccacctcagtgagg

SEQ ID NO: 528302 - DNA, 3032 bp, Homo sapiens
  misc_feature (12)..(13): n is a, c, g, or t
  misc_feature (18)..(18): n is a, c, g, or t
  misc_feature (784)..(784): n is a, c, g, or t
agcgggagtatnncgctngcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaaggtaatgagagaagatgatgagtgagtcctacatcttatatttcgtctttgttaattataacttttccttctttctaaatccagggatagtctgggtccctgaagcattcacctttggaaatagatcattatacattttagataatctttanagattgttattgtttgaaaatcagtatgctctatctgtagatagtatgtgtgtcctatacctataagtggcttttttgtggggcatttattgatcaaataatttatattttagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttgggcaattttacatttggaattttatcactgtgcttttttatatgaggcactgtagtattttcacatagtatagtactctggatgttaaaagctcaaaaattgtggattccttgaacgtcactaaatcttcaagcaaaaacacatttttacattcattttacgtggatattttagtgaagagaccatatgaagaagcatttttaatattaacttgtgacatacttagatccactttacatcatttctctgtgttgaggtagggaaattagggttcagtttatcactggacattcaggaggctagtcaatcttgtttgtatttccttataaaattgatcttcaaaagccgtttaaacagagagttatcttaatttttattggcagtaggaggaaatatatttaaaatatttgtcagatttatagcaagaatagagactcgttatttaaaggttagataacaattgtgctttgtagttttgccagtttagggcagtagctgctttgtcataaatatcttcctaccacatgcaaaaatgctgcttttaaaattttgtgtataaattgagaaggaatgttgctctctataagttctgtcattgaacagatcaccattaaaaagaatattagaatccagtatgaagattatggtaataaaaatgaggtacatactttataaaacattatcagatttgaatgaggaatggttccacattctgaagaaaactgttggttaagtttgagaatctgggaagaagtttagatccattctatagcagaaagatgttagttgcgcaataaagaatatgcatcgttgctaataagggatagcaaaaagaaaaaaattggggcggcgaaagttaaaatggggggccggaaaagtattcg

SEQ ID NO: 528303 - DNA, 490 bp, Homo sapiens
  misc_feature (50)..(50): n is a, c, g, or t
  misc_feature (118)..(118): n is a, c, g, or t
  misc_feature (291)..(291): n is a, c, g, or t
  misc_feature (297)..(297): n is a, c, g, or t
  misc_feature (312)..(312): n is a, c, g, or t
  misc_feature (368)..(368): n is a, c, g, or t
  misc_feature (378)..(378): n is a, c, g, or t
  misc_feature (397)..(397): n is a, c, g, or t
ctgctgggggcattttaaaactgttttcctcctggaaatcaaaagcccanccttccctcctctgtccctctgggaatttggttttcctgagggcacttaattaggtgaatagccatgncctgaactgccctcactgacccacttcccagatgagggttactctccctcacagcacggccttgaaggccaggctcatgccccgggatgcctgccctgtgttcccaactgtggatcctgcattctggggaacagcccaattgatctgatggtgccagggttactttttatttnttaaanttgaaaattgggggnaatatatccttagtggtgattaaaacttcagaactgtttttgaatactaatttggnttttggaaanagcccaactccattcgggnaaatctggggaagagggaatcaaatctgggcaagctgggtgacagtattttagtttaaaaaacaaaacaacaaccttcctctctcccccacct

SEQ ID NO: 528304 - DNA, 127 bp, Homo sapiens
cctgggtcttctaccagagaaacatttagcattcactgcctcgaccagtccctcggaatcttgaaggcgctgaccaagttttttcttggcctacctaccagctcttctagtgtcgctaggataggcg

SEQ ID NO: 528305 - DNA, 1829 bp, Homo sapiens
  misc_feature (12)..(13): n is a, c, g, or t
  misc_feature (18)..(18): n is a, c, g, or t
agcgggagtatnncgctngcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagattctaaaagggccatagcctatccttatagaattcagaatgcccatggatgtaagagaatttgggagtgctttgttttaattttg

SEQ ID NO: 528306 - DNA, 1158 bp, Homo sapiens
ggggggctgcggagagggtgcttaactgaggggtcactgatgggggaggcggtcagtgagccgcgtgggccttgtccgttgcgctgaggacagtcttcaccgcgcttctcgtctgctagatgcaatgtgtagcgggtctggccggcggtggctcgggtcgggcgtcggggagcctgcttggtccgccagccttacaggcaagggtgctcgggttccgctacctagagaactccggacagataaattccggcgcagtggccgaaggcagctgcgaggttcaactacattcccgctggcatgcggagcattgtctccatcgacactgtttgaacaagtcaccccccaagcggggtctggtggtggggatcgacgttcatcgaaggattcaggggcacgaagggccagccccttcctggaacatttactggcgactacgagcccggctctgagtacaaccttgaactctgttggcccagagctgcctgaacctggagctccagttcactccgttccagctgtgccatgcggaggtccaggtcggggcatcaacttgagactgtgtttctcttgagtgggaacgacccggccattcatctctacaaggagaacgaggggctgcatcagtgttgaggaacagccgtggaaaactcttcccagagctgacgaacctgagcagtagcgtctctggctggacgtccacaatttccccgggcacgtcccggcgccctctcagctctgggctgtcagagtgggtatgtccagtgtcgccacgtggaccagcggagtcgagaggtctgcgattgtggcccgtcctgcggacggtcccatctcccgagtgatgtgtgtcagcctctggacggccaagggacccaagggcagggccctaacaggatgagtacaagggctgcccgtgggcagcaattttggagccccaggggtgtattggcgaccggctgaaccggggggtgtaacaacacacgctccggcgggagagagacatgtcaccgccctagcctggaacccacgtattgatgggagcaaaaccaggggcaccagcgcagaaggtgacatacgcgcagcaaatgtcttagccagaagagtggagaggcacaccttcgctacgacagagaggagtgcgcaggcggcatcatcagcagg

SEQ ID NO: 528307 - DNA, 1433 bp, Homo sapiens
  misc_feature (24)..(24): n is a, c, g, or t
  misc_feature (36)..(36): n is a, c, g, or t
tagccgtctctagagtatcccccnggaaacacgctntaacggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttgggcaattttacatttggaattttatcactgtgcttttttatatgaggcactgtagtattttcacatagtatagtactctggatgttaaaagctcaaaaattgtggattccttgaacgtcactaaatcttcaagcaaaaacacatttttacattcattttacgtggatattttagtgaagagaccatatgaagaagcatttttaatattaacttgtgacatacttagatccactttacatcatttctctgtgttgaggtagggaaattagggttcagtttatcactggacattcaggaggctagtcaatcttgtttgtatttccttataaaattgatcttcaaaagccgtttaaacagagagttatcttaatttttattggcagtaggaggaaatatatttaaaatatttgtcagatttatagcaagaatagagactcgttatttaaaggttagataacaattgtgctttgtagttttgccagtttagggcagtagctgctttgtcataaatatcttcctaccacatgcaaaaatgctgcttttaaaattttgtgtataaattgagaaggaatgttgctctctataagttctgtcattgaacagatcaccattaaaaagaatattagaatccagtatgaagattatggtaataaaaatgaggtacatactttataaaacattatcagatttgaatgaggaatggttccacattctgaagaaaactgttggttaagtttgagaatctgggaagaagtttagatccattctatagcagaaagatgttagttgcgcaataaagaatatgcatcgttgctaataagggatagcaaaaagaaaaaaattggggcggcgaaagttaaaatggggggccggaaaagtattcg

SEQ ID NO: 528308 - DNA, 404 bp, Homo sapiens
ccctacaacttccttacaacctttctgtcattggttgctatgtacaagatatgctatacaccagtacaacagcatgcaattaatcaattaagaaaacatagtacatgttatgtgtaattaaattaaatctaacaaagtgcttttccactcgctggatttgattccttatttggaggaaggagtaatcctggagcaaccacttgcccgtctcagactctacactataacatttctggttgctcggttggatttgccagtgggccagtgaggtcagcgggaatgagggaacagcgggtgacactgcctcagatgataccattaggggggccacagatgggccctaagtcaacaccgttcttcatgtagtacttctccagcttggccagaatgtgcttgccataggt

SEQ ID NO: 528309 - DNA, 1108 bp, Homo sapiens
  misc_feature (12)..(13): n is a, c, g, or t
  misc_feature (18)..(18): n is a, c, g, or t
  misc_feature (784)..(784): n is a, c, g, or t
agcgggagtatnncgctngcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaaggtaatgagagaagatgatgagtgagtcctacatcttatatttcgtctttgttaattataacttttccttctttctaaatccagggatagtctgggtccctgaagcattcacctttggaaatagatcattatacattttagataatctttanagattgttattgtttgaaaatcagtatgctctatctgtagatagtatgtgtgtcctatacctataagtggcttttttgtggggcatttattgatcaaataatttatattttagactttgcataaaaaaactttctactatctggaacagttaattctgaaatatggaatgcatcagaatacacttcgtatcaaagagattcatggtgagttaaaactcaaaagcatttgaaattatgtcagatttttatttcaacatacctaagtaatcttatatttactgataatatctggattagtactgtccaaaagaactttctgttagg

SEQ ID NO: 528310 - DNA, 654 bp, Homo sapiens
  misc_feature (12)..(13): n is a, c, g, or t
  misc_feature (18)..(18): n is a, c, g, or t
agcgggagtatnncgctngcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcttaacgtgtggggtttcccctgtgtacatctccctggttttatggtccccgtctaaactttgtttgcctatacatttctctctgcctttcctgt

SEQ ID NO: 528311 - DNA, 113 bp, Homo sapiens
gctcacttctagcatggtcttcaggcccctggcactggttcgtaattgtccagggtcccccctgaacaactctcctttccggccgcatgcgattggttctgcctggtaggccc

SEQ ID NO: 528312 - DNA, 147 bp, Homo sapiens
agggttctcagagttacccgtcttgagccgaacctaaaataaaagtaagcaggaaactttttgggcttgcgggccagcttccagaggtggaagttacacgaagaggtggtatcaaggggtaccgttgctcgagattcgctaactcat

SEQ ID NO: 528313 - DNA, 382 bp, Homo sapiens
  misc_feature (324)..(324): n is a, c, g, or t
  misc_feature (352)..(352): n is a, c, g, or t
gaaagatttgatcccagaagtttgagaccaacctgggcaacataggggagaccccatctttaaaaaaactaaaaaaattagctgagtgtagtggtgcttgcctgtagtcctagctacctgggaggctgacatgggtagatcccttaagtccagggaggtcaaggctgcagtgagtcatgatggggccactgcacttccagcttgggtgacagagcgagatattctgtcttcaaaaacaagcaaaactatggaaaaaaaagttcaacattttctttgaaatactttcttcattattttgggtaggagggaggggagatatatttnggggattaaagggacattaggggaaggntagggttttttatttattaattatttaatt

SEQ ID NO: 528314 - DNA, 118 bp, Homo sapiens
ctaacagctataaccatgcacttggccgtcgttgttacactaacagctatagaccatgcactgggccgtcgttgtacagcataacagctataaccatgcatgggccgtcgttgaacac

SEQ ID NO: 528315 - DNA, 910 bp, Homo sapiens
tcaaaaaatttatctcattagagactgctgagcaatacccctgatgtcctcgtgcttaatcccaactcaaattcctcccaataacctctttctactaaaattctaactcccgtgcataaaagaccccgtgcccctacggcctttagaccccggtaattaaggccaacagggtaggccaattacaagaactactttttgccaaaaatctggtccggtcccaagacccccacttcattcttcctctcacagacaacccgtctgtttccctaggggcacactccatccagcacccgtataaaagggaccccaccttattccagacattcaaacttggcccctgtattccccctcgtctcctagaagcccgattttgccgagtgcccccctattaaataaaaagtgttaaagtcatatcatacggctcacgatataccctccccgacctttcccaattacccactttaacctccccatcaaatgtggagtaccacctctgctacaagcatctattggtaatcctgccctcacacacaccgcgattattgcgctcccaataaccagttaagttatactcaacccttttcgcaatagtagtccaagtatccaatttcctccccaggccatttctcttccaatcgccactattatacacactccattcctttgatgactcccctgtttcttccaaaataccctcttccaacatattcctaagtatgtcttccattcaacaaattaatctagtgctattacctcgacatcacactcctatttttctctatctagtatgtcgaagaatgtgaatatgccctgaaccctggagagtgcaaaaagttgctaatgtatgctcatgaaccggagtcccgcccctcgcctcccccccgctgtgtaaaagcgccaaacatggccc

SEQ ID NO: 528316 - DNA, 816 bp, Homo sapiens
  misc_feature (690)..(690): n is a, c, g, or t
gaactccggaaacggcggcggcgagctacaggaccgaggtgccttagttggtgcggcaagtcggggatcccagaatgataatcgtgacccggaatgctggagacgtggtgtcctgtcccagctccgtggctgctagtgagcttctaccatcatggacctattgttcgtgcgcccgagtagagtacgccataggcacgctacttgcggcagaatccagcacgggaccttgaactcgtgtccatgctgggagcttggtacccgggcagcgagagaaaactagtagcacccacggagcaagaatacatcattgtccgcacattgaagcatcatgtgccagagctattgccagagttgatgcttgtttcgccacttcatggtcgaacacgccttgagttgcgcctacccttcgggacgcgtcactgttgctgcaccagttctgtactgtggaatagtctgcggccagagcatccccaagtgcctagtttgattccgctctaaacgaatgccaagtaccaatcttccgaaaagttcctataataaacttcggaatggaggcaggcaaaaggcctaattgaagagtgggttgtacaccgaaagggtccatcgtggtcaaccttatgacacaagagcacgtctagaagttgtccccgtgattccagaaggatcactgatggcgagtttgagtgcgcncatgcgcagagactcatcggatgttgacctggacggaggatgattgacatgatggccattagatgagtgccatggtgttgcttgaggaagatgaacgaggaggagtgatgctgggggttgtgccag

SEQ ID NO: 528317 - DNA, 80 bp, Homo sapiens
aaaacttcagtggtacagtgacccaataaacccatcttagcatgaaagtccattaaaggagggcagtcatctctaaaaaa

SEQ ID NO: 528318 - DNA, 183 bp, Homo sapiens
agaaaattgagacggagctaagagatatctgcaatgatgtactgtctcttttggaaagttcttgatcccactgctcacagcagagagcaaagtctctatttgaaatgaaggagattactaccgttacttggctgaggttgccgctggtatgacaagaaagggatttcgatcagtacaacaagg

SEQ ID NO: 528319 - DNA, 143 bp, Homo sapiens
cccgcagcaatggactcgtgatctgctggactggattctggatgacacgcacagtcaccaccatctgtgacctgaacctgcccctggctgacttatatctcacggccacattaccacttctaattgactgcatggccatgtga

SEQ ID NO: 528320 - DNA, 109 bp, Homo sapiens
cagggatgatgagaatgacagtgtgactctgaagtgccatcgaagcctactcccctgtaggacaatattcactacagttgtgtttcacaatgtagagcctcgatctcaa

SEQ ID NO: 528321 - DNA, 840 bp, Homo sapiens
gaatgctgctgagtccgtatgattccttagcgaatgattgtcgcgggagccgtggactaacaagaagagtccaatatgtagtgatgtgcgaagaagccgtggaacatagagcctatatgccgagaggttttccttgtgtctgagatcctatcgatcgggtgtgcatcactatcgtctgggttctgacatgcctgggcctcctctgtgtgctggtgcatcctggtggagcaccactgtctttgcatcttgttacaggccgtccaataagcccctgatggtcattcattctgctttgcatggataacaactgcttgggttgtctatggtctatgctctagatcctgtattcccgtggtgcatccaaagccatatgatcttagtgctcatcgaatatagtaatcatggagtaagtccgtgcaagaccgttttttagacgtctgagtcgtcgacccctcacgcgtgtctaatagtatgctatattcctccgcatcctgtgcttatcgtattacgcaccagggaaatgtctcgattgacgtcctggatgtgcttgccatcctgtagggatgattgtcatatcttcactatgtatattgcatgattcgattcgtcttgacgctggggcgaggaatgggtttgttggtaagagtgcaagttcgcggtcgtctctatttagcccgacatttacttggcgttgatcgcgaattagcgtttgggttgtacaaggcatgctgaacccagtgtcgttgttgtacttcctaggttctcaggccgaatgttttatccgtttgttcttacccacgcttgtcccttcgttcgagtcttggattctggttgggaacc

SEQ ID NO: 528322 - DNA, 220 bp, Homo sapiens
caaaagggtagtgagagagcatgtagcacgagtaataccagctctgagaatggatctacaggcacagttgctggggcatccgagaggcaggaggcacagcagcatcagcactgccatggcattctgaaagcactgatgcaggcacacatggatattctcttagcctgtggcttggggagcaggtagaaggctcaggaggtagagaggctgtggccaggag

SEQ ID NO: 528323 - DNA, 457 bp, Homo sapiens
attcagaaagcactgtacactcatgggtccaatgccgaggtgatgtgtgtcttcagcctggaccctgccacagggggcattgtaacatatcacttggctcatcagatgtttgatgttatcccctcccctctcctaccctgtgtttgcctataagagacattgtcacaaagtttctgggcccagcacctaggtgatatcttcctgggacctgccatatggggatcgtgatatatcgcatggcccagtacttacttgatgtgactctcctctcatgcctgggccctgcttacaggtgtgattgtgacacatagcttggcctagcccctaggctatgttactctcctcttatccttcagttatttacacaaggggcattgtgacatattgctggactgggaacccaggtgatgtgactctcctctactggctgaaatacaacacaaagaacgttgaccta

SEQ ID NO: 528324 - DNA, 326 bp, Homo sapiens
attcctgattttaatttaaataggggctttaattttacagctttcaaaagtagttactgtaaattttactcctgttaatgctggattggtttaaaggatttataagggctgtgtttgctttttacaaggcaaaatgccaaacagtgttcaataataaaaggttttgaaacaaccgacattttaaatattttttaaacatgaggactgggtttttttccctgcccctatgatttccctgtgagtagggtgaactggactgcaaattagtttatttgttgccaaaatcacatttttgaaaaataaatttaaaagtttttttttaagta

SEQ ID NO: 528325 - DNA, 661 bp, Homo sapiens
gccattatggccggaagcgtggaataaattggttccttaaggggggtgaccaatccggtttttccaatgctctgggtgaataaagcctgagggaatactacggttttgcggaatggcttacaactgggcattacaaagttaatatggaaattatggcctggggtaaaatggagtttcaaattaaaattaggaccagtaaaatccaaggaactatgtaaccaaaaaagctttggtttggcttacaaggtatatttaaggataattctgctgaaaattcaatttaaaagttttccttggaagaactaagtaggaaccacattgccaacagttggccagtatttagggttgggcacttcatgtcattaatcaatttctcaatagttcttaaaattagggagattaaaaatttaaaaattttgcatttaatgctatcagaaccagaatttctttcccaaatcaaattaaaggaattatgatcagagcttgaccacaggcttatttttaaaataaaaatatttttaccatgggtttccttcttgaaaaatcagggaattaagcttaaaccaccatcattaggattaatggaccattaaagttggctttcagatgcagttttcaaattaaaacccatttcaatttataccgttctcagtccttggta

SEQ ID NO: 528326 - DNA, 276 bp, Homo sapiens
gagatcccagaagtttgagccgacgtgacccccgaagactccagctctgcagagaggggcctgggcatgtccccgtcaggacgtggccctgcaggctccggcaagcatcatcgccaggccccaggctccgtgtgggacgccagtacgcagcaggagcagccaaccagcagcagccatcatggaggcgctggggctgtggagatccggagtcgccacagctcctaccccgcgggactggaggacgacgaagggatgggggaggagccagcccctttc

SEQ ID NO: 528327 - DNA, 5061 bp, Homo sapiens
acgcagagcgctgctgggctgccgggtctcccgcttcctcctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagtcgctggtgctgctgacgctgctcgtcgccgctgtccttcggtgtcagggccaggatgtccaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtgggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcaggtcctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggtcctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggaaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggcgcacagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaacggcgagaagggagaagttggacctcctggtcctgcaggaagtgctggtgctcgtggcgctccgggtgaacgtggagagactggcccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccatcgggtgagcccggcaagcagggtgctcctggagcatctggagacagaggtcctcctggccccgtgggtcctcctggcctgacgggtcctgcaggtgaacccggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggtcctgctggtcctcctggaaatcctgggccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagta

SEQ ID NO: 528328 - DNA, 759 bp, Homo sapiens
agcggggccgtgggtgatgccggcgtcctggcgggcgggagcagcatcgaggccgatctggccgagtccggaactcggtcgggcgaagtggactgcggggtaactactggccccccgtcgtcggctctgctacccggatggctcttggggacttgcgccttgcgagggcctctgtactccgtacataaggtagacccggatttccagctgcttgatgaggggtgcgggcgggagtctgctacaccatttttgatttgggcttccgctttgatgtggcatggttcctgacggagcacttcgcccttcatgtggtccaacctgggcattggtccttacctatctccctgtctgtggttggggcagagcctaagggcactctatatttacccgcgctcactccattcacttggtgagaggagatgaatcggcccccaaggagtcaatgaaccaacgaaccctaggttcagtcagtcagtcgttactcgtgagtgctagtgtgccagtgctacggacatctatacatggcaaattgtcattacgcaacatggctgagcctttcagtgccacagaacccaaggccatcggccatcggaactaccatgcaggctactccatgtctggggctggcctcaccggtagcctgtctaacctcttctgtggagtctgcgtgcgcatcgtgggcagtggggctgccctggccgatgctcagaaccccagtctctttgtaagattctcatcgtggagatctttggcagggcc

SEQ ID NO: 528329 - DNA, 100 bp, Homo sapiens
ggcttcagttcagtcgggactgaagcaaaggctgagaggctgggagatggatacctgacttgtgatccacgatgggaagcccaagttaagtcgggacctg

SEQ ID NO: 528330 - DNA, 199 bp, Homo sapiens
cgcacagattcaagagtactgcgacacaatgactatcagcgagataatccgagcgtcaaacaagataagaagatagatcgcgggaagttgcttcgccacagccattacaccatcttgtgttgagcagcagcatatggaggcgttactatactacgaatgtcggctcgaccagttgagctctcgccctcgtcatccatga

SEQ ID NO: 528331 - DNA, 430 bp, Homo sapiens
acaatggaacatgaggcatagatagacagcaccatggtacgagggaactaactatgcatacctacagatacagaccgaggtgtagctgatagatcaaagtgtatggtgatacagcaggccaggacatgagttttagtatgtagtcagcacaggcagggctatatgtactgggccataacgaaaggcagacctatagcatatctgcttcttcttttggtttatatgttctggaccatgaggaaaggcagaacctgtagcttattagctttccccttgatcctgccagcctgagtccatttccctaattaggactccacaatagctctgactatcacttcaccttctgcctaaagcctgtaatcaaaaggaagcaaggtctgatgatagcactccagcatatgtatttctgtggtttatgcttgatacgcag

SEQ ID NO: 528332 - DNA, 148 bp, Homo sapiens
gtgttgtacagaggtctcaatgtctacgaagagtcctcttgtcttcttctgtcaccatgttcatagccacacctttacggccaaaccgtccacctcagacgattctgtcggatatagttttccctgattggatgtgaaggtcatagtt

SEQ ID NO: 528333 - DNA, 844 bp, Homo sapiens
  misc_feature (24)..(24): n is a, c, g, or t
  misc_feature (68)..(68): n is a, c, g, or t
  misc_feature (71)..(71): n is a, c, g, or t
  misc_feature (103)..(103): n is a, c, g, or t
  misc_feature (114)..(114): n is a, c, g, or t
  misc_feature (121)..(121): n is a, c, g, or t
  misc_feature (133)..(133): n is a, c, g, or t
  misc_feature (144)..(144): n is a, c, g, or t
  misc_feature (173)..(173): n is a, c, g, or t
  misc_feature (180)..(180): n is a, c, g, or t
  misc_feature (195)..(195): n is a, c, g, or t
  misc_feature (200)..(200): n is a, c, g, or t
  misc_feature (210)..(210): n is a, c, g, or t
  misc_feature (311)..(312): n is a, c, g, or t
  misc_feature (361)..(361): n is a, c, g, or t
  misc_feature (369)..(369): n is a, c, g, or t
  misc_feature (379)..(380): n is a, c, g, or t
  misc_feature (383)..(383): n is a, c, g, or t
  misc_feature (391)..(391): n is a, c, g, or t
  misc_feature (402)..(404): n is a, c, g, or t
  misc_feature (421)..(421): n is a, c, g, or t
  misc_feature (432)..(432): n is a, c, g, or t
  misc_feature (440)..(440): n is a, c, g, or t
  misc_feature (447)..(447): n is a, c, g, or t
  misc_feature (470)..(470): n is a, c, g, or t
  misc_feature (477)..(477): n is a, c, g, or t
  misc_feature (510)..(510): n is a, c, g, or t
  misc_feature (542)..(542): n is a, c, g, or t
  misc_feature (590)..(590): n is a, c, g, or t
  misc_feature (634)..(634): n is a, c, g, or t
  misc_feature (741)..(741): n is a, c, g, or t
  misc_feature (767)..(767): n is a, c, g, or t
  misc_feature (771)..(771): n is a, c, g, or t
  misc_feature (792)..(792): n is a, c, g, or t
cgcggccacgaatggatcgcagancgacctcagcacagcaacgcagagcgcatctgcagaaaaaaaangangaatgtatctggagtattaaactttgtaactntctcatcaacnaagcaanaaaaaaaaaaanaaggaaaaaancccacacgaaacaatcagaattagaattngattaanaagacgcgtataggnatcangctgactacncctcagctccgtcctcggggagggtgaagccagcgtgggacactttggaaggcctatcaatcacaggggcgccaaaatcaaaaggcgggtcagtaggccannccgggaggcgcgaaaggcgaggccagcgggtgttaagaaggatatggtnagaagagntctttgtctnnatncaaggggncgtctgatcannncgtgtgtctcggtgagnaattcgggagnaggtgcangcctgtnctactcgctaccacgcgtcttcngggaggnagtgaatgagccggttatcttctcagggagggntagtgctggccactgtgcactgccgctgccancacgcccggtcacagccagtgtctatgggcgtctggcgcggctgcgangctgtctagaggactcctacccttctgctctgagtgcgcaagtnttcctggactctccggctgtgggctgtggtttggaaacgaggttgttcatagaggctgctctggggccaccatgcagggcaacggtgacgtccagaggccacctgcntgacatctccatcaccaaatctccangaanaccctgtttcctatgtgaggncattgcccagcccacgtttgcctccttttcctccctctgccacacgcgaatt

SEQ ID NO: 528334 - DNA, 128 bp, Homo sapiens
agtgctgactgcaaatgatgtgagcagtacaacccacatggttgctgacctgaattgccttctccaagcacatctacaatgcctacctgaaaaacttcaacatgaccaaaaagaatgcctgcagcatt

SEQ ID NO: 528335 - DNA, 129 bp, Homo sapiens
gggtgtctggcatgagaatggctgttactactcagggccatctggctcattgaagagtctgccatgagcgatttcacgtctgtttgtcgttaccgccgatcgagcttgttataattatgcctcatacgg

SEQ ID NO: 528336 - DNA, 263 bp, Homo sapiens
  misc_feature (2)..(3): n is a, c, g, or t
  misc_feature (7)..(7): n is a, c, g, or t
  misc_feature (11)..(12): n is a, c, g, or t
  misc_feature (18)..(20): n is a, c, g, or t
  misc_feature (22)..(22): n is a, c, g, or t
  misc_feature (24)..(24): n is a, c, g, or t
  misc_feature (37)..(37): n is a, c, g, or t
  misc_feature (51)..(51): n is a, c, g, or t
  misc_feature (87)..(87): n is a, c, g, or t
gnnctgnggtnnctagannntncnctacgcgaagtangaatggcgcagcancagcgcgtgagaacccgggcgcgcatccggcgcagnggcgatccgcaagagcccttacccggcacgctcgccgccgacgcgagcgtcgagcaggcatgggatggcgtcgagcttccggcctcgacgtggtgtgccgaggaggcacaccacatgaagctgcgcgagttcaagcacagctacgcctcgagagatcgcgtagcgcattgtccata

SEQ ID NO: 528337 - DNA, 452 bp, Homo sapiens
atgtgcatatattgatgggtcacagtatagcgtgcagatagaagctaacgaacaaatgtttagtttgctgaagatggccttatatggacaggtttctaccagaaatattactttatcaggtgtaacatctgcttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgtaagctttacataggtgttggaggattcctaaggtgtcagcattttgtaaaggtaccacaaaggagaagttgatagggaatctaattttagaatgtgccaaatggtctgtgctcaacaatataattgaaccggatagcttg

SEQ ID NO: 528338 - DNA, 1025 bp, Homo sapiens
tcccggcacgtgtctcggcacgtggcagcgcgcctggccctggtgcttggatggctgcctggctgccctgtgatcctgcctggcctgtggtcgccgagtcggtgtcgtccttgaccatctgccgactgctgttcatttgcagcctggctgagagctcagctcctgacccctgccgctgccccgctgcttcccaggaggttcatctgctccttccctgactgcagcgccaattacagcaaatgcctggaagcttgacgcgcacctgtgcaagcacactgggggagagaccatttgttttgtgactatgacagggtgtggcaaggccttcatcagggactaccatctgagccgccacattctgactcacacaggagaaaagccgtctgtctgtgcagccaatggctgtgatcaccaaattcaacacaaaatcaaacttgcagaaacattttgaacgcaaacatgcacctcaacaaaaacaatatatatgcaggttcttgacgactgtcacgaagacctttaagaaacatcagcagctgaaaatccatcagtgccagcataccaatgaacctctattcacgtgtaccaggacggctgtgggaaacactttgcatcacccagcaagctgaaacgacatgccaaggccacgagggctatgtatgtccacaccgggctgttcctttgctggcaaaacattggaccggaacctctgacaccatgtgacagaacccataacgaggcacatcctatgtgaacgaggccggaaacatttgacgcaagattccttagccacccctacacccatgccccacacacggcgattattgtcgtgatccgaagcagcgcgtgtgaataccaattccctggtcgctacctccagccaatccctcgtcatgagaaaacggcgctggtggtaacacgtgtgtgcgaagctgggagcacgtcacgcgtgatgctcactcaacagcatgtgcaccccacctcacgcatggccattggtatcccacggcggtcgctcgagcagaggc

SEQ ID NO: 528339 - DNA, 147 bp, Homo sapiens
ccctcccctgaaggattaacagcaatgatgggcattcgtgaagttgggggggttgggggtgggattgtgtcctttaaggggaggggttcatttgagtaaacataaaccccaacttgggccattttttataaaatgattttaaaggca

SEQ ID NO: 528340 - DNA, 539 bp, Homo sapiens
tagaggacccggtgaaaactgtaacgtaagacgtgagaaccataaaactctacaagaaaacctaggcaaaaccatacagtacatagacagggcccaagacttcaatactaaaacaccaaaagcaatagcaacaaaagccaaaatggacaaagggcatctaattaaactaaagtgcttctgcacagcaaaataaactaccatcagagtgaacaggcaacctacagaaggggagaaaattttggcaatccatccatctgacaaagggctaatatccagcatctacaaagaacttaaacaaatttacaagaaaaaacaaccccatcaagaagtggacaaaggttatgaacagacacttctcaaaagaagacatttatgtggccaacaaacttagaaaaaaaaaaggctcatcagtcacgggtcattagaataaggcaaatcaaaaccacaaggagataccattccaggccagttagaagggttatcattaaaaggtcaggcaacaacagatgcgggggaggatgtgaagaaacaccactgag

SEQ ID NO: 528341 - DNA, 198 bp, Homo sapiens
caggatatcttctcagcagcccaaagctacagtgtgactcagatcaggatgtcttctcagcaattgagggttcatattcttacctacttttgttaccgtttaaccccaagggaaaaatagtttaaaaacgagtcattcatttctttcccatgtagatagagtctattgatcgttgacagacaccgagaagataccggg

SEQ ID NO: 528342 - DNA, 140 bp, Homo sapiens
ctcagactagtaggatataatttgttcatgctgtcccaaaggcatgggagctttttgaaaagaaagaaaacagtgtgttggcttttttttttaagaaagttagaattgttttaccaagagtctatgtggggttaggtctg

SEQ ID NO: 528343 - DNA, 573 bp, Homo sapiens
aagtacagtgtccctgtctgtctggggagcacgatgcactgtcccctcttcgtaccctccctgagcgctgtgtcgagctatcacgttccggctgctactctgctctgggcccatgtggctccggctcgtgggaatggtagatgcctgatccgggtgctcacggctggcgcctcgaagaggcaaggtggggagttaggaaagagctgggccagttctgtgtaccccctcgggcccctgccccccgccactgctgtccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagccaggcccttgttgggtcaggacctgacagcaggggatgaggcactgaggcaggtgcatgccgggctgaggctggagcagtgggtcccaggcctgtgcagagaggacactggcccttttgggatggtggggtgcaaagggaggtgcccccgt

SEQ ID NO: 528344 - DNA, 958 bp, Homo sapiens
tgagcgggccggcggtgtcgtctagctgggggagtgtcgtggccatgctggtgggccagggcgctgtggctgctgttggcccgcgtgtgtgtcacctgcgcggtggtgctgctgctgagctggcgtggggccggcgcacggctcggaggacatcgtggtgggctgcggtgtgcttcgtcaagtcggacgtggagatcaagctactcgctcatcgagataaacgctgtacaccaagcatggcgactttgaaataccagacagactgtgcccctaataatggtaacttgatgatccctttgtatgcatcaagggggatttcattctgaacgattgagcctcccctagggtgcacgttctctgagccgacgaccagtggagctccatgtgcgatggagtcagtgacatctgacacacagcggtggggacatcgaacttctgtacttcactgggttctctgctgaattggccaaggcttcgcactacctcaaagcttctgcgctggagcatctactgaacatcctcgcaactcatccaacctgggccgttgaaaggaggcaagcgaacacagtagcgtgtaaccaactcccaatagccacatgccgtgcacgtccccctcatagtctgcttggctacaatgctgtctggcctctgtcgcgacagtcgccgcggagacgccattagaaagtgggtagaacaatccatgcgtctcaaacacctaccaactcggctacacgacagcagcgactcaagggcgccaacgccacagagcgtgccgccaacgctagccctgcgggagcgaagagccacgcgacggcgagcaggcccaggcgggacagtgctagggaaacaaacgcgcgcgacgagcacgacagaccgcgacacagtacaacagagcacaaacaacggtggccaaacccaccaggcgcacgcagtgctggcgaacaccgacaacccagca

SEQ ID NO: 528345 - DNA, 576 bp, Homo sapiens
  misc_feature (62)..(62): n is a, c, g, or t
gggaaggtgttggcttaaaaagacaacaggccaggcgcagtggctcacacctgtaatcccangactttgggaggccgaggcgggtggatcacgaggtcaggagctcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccactgcactccagcctgggcaacagagcgagactccgtctcaaaaaaaaaaaaaaaagacaaacaaaccaagtaaggggatatcattaaccaattgaggacgggctcccttgtcccctgccagggcctgcagggaaggttaagggccaggttccttttaaacaaagccaagtcatcagggccctcccggggttggagacgctagagttcgccacggaagccgggtttcctaggggcaccgcctagggaagtgactcaggactctcagtggcacccggtcggggctccacccgagggggtgcacttttgatgagatgtctctg

SEQ ID NO: 528346 - DNA, 779 bp, Homo sapiens
ggggaccacctcccccttctttgatcccagcatctcagtcaccctcccaaacctccatatggctctcaatggtgctcacttgcttggaagcaggctcccaatagagaggcggctgccctctacagtctctttgactgtaagacagggctctgtatcagtgagacgcatgagaaaagtcccacggctaatggcagacaatttgcactttgaccatgtgtgttcagtgtgtggaacctgagataccttatttattaacaggaagtctgattttttcacggggagtcttgggtgctaatatttgctggggctagggagagagagatccagattattcttgacatgggatcccttccataacaggtacttttgatgggcaagacatacgggttggccacagaaggcacagccagcctctgaaatcatagctctccagtggcttttaaagaaacgctggtcctcagcactaagcaaaatcactacaatagcctagttgctttttgggaagccttccttagggaagaatgtccacggtcccagtggtcaactagtatgctctttgagcaattttgacacgtcgttgaaactctaagaacttttcgagaggggtcggcgagggttgtccaagaatctaagattacggatagaatgatgttcctcgggaatttgcagctagtcgctttttagggggcccaccagtgtcccacaaatccctggggcccatctcggacctgctaaggccagccggcaatcgaaattccacccccttagaggacactcgt

SEQ ID NO: 528347 - DNA, 120 bp, Homo sapiens
agcaagttccaggccacgccagcagcgtggccactgggtggatagtaagggccgactatgtggataaatcccagggttctacgaccatcgcccaccatcacagtagcggctcaccaaata

SEQ ID NO: 528348 - DNA, 361 bp, Homo sapiens
tagtacatgttaggacacaaaacaagtgtcaacaaatttttataaattgaaatcgtatcaagtatctcctcagataagaagtggaataaaactagaaatcaagaataacaggccaggtggggtagctcgcgcctgtaatcttcgcactctgggaggccgaggtgggcagattgcctgagctcaggagctcgagaccagcctgggcagcacgctgaaaccccgtttttactaaaatacaaatcagccaggcatggtggcgtgcacctgtagtcccagctactcaggaggctgaggcacaagaactgcttgaacccaggaggcggaggttgcagtaagctgagatagtgccactgcactccag

SEQ ID NO: 528349 - DNA, 100 bp, Homo sapiens
tcagtcggtaccactgcaccatattatttcgtctcattaactgttgacttctactaggtgttacttctaaaacattacgtattgagtttaatggtgaaca

SEQ ID NO: 528350 - DNA, 86 bp, Homo sapiens
caatcacatctccaagagccactgagagcatgaaatgatatgagaaggggttgcccttccctccagtcgaaacggccgcgaattta

SEQ ID NO: 528351 - DNA, 290 bp, Homo sapiens
  misc_feature (76)..(76): n is a, c, g, or t
tgcctgcttactcgggaaatttgcttttgccaaaaccgcttttttggggattccgggcccccctccttacttgggntggttttggaaccccaaccgggttcggccggtttgggggtttggaaaattaattaccttgttcttcgaattggttgaaagggtaaagaacccccaaaaaccccaatcaaggttttgaatgcattaagacccgacattctcgggtatttattgtctgtccccacataggacccccacccccgaccctcgcgaataaaaggccttccatttgccca

SEQ ID NO: 528352 - DNA, 259 bp, Homo sapiens
  misc_feature (7)..(7): n is a, c, g, or t
  misc_feature (107)..(107): n is a, c, g, or t
  misc_feature (147)..(147): n is a, c, g, or t
  misc_feature (156)..(156): n is a, c, g, or t
  misc_feature (210)..(210): n is a, c, g, or t
ctcaggnggctgaggcaagagaatcacttgaacccaggaggcagaggttgcagtgagctgagatcacgccattgcactacagcctgggcaacaagagcgaaactttntctaaaaaaaaaaaaatcactgggcttcttcatgctctgntcacatctntcgtaaaagcttaagctctctccggggtccgggtttggccgtgccgtggaattntgggtggcctggctggggtctctggaaatttggctgcagcagagaacag

SEQ ID NO: 528353 - DNA, 943 bp, Homo sapiens
gagtcaagaagaaagctgatttatacatccatggtgacatacatacatagaaagtgggatatatgtgcgtggataatgccatcttaacaagccctgagtggggtgcggacatatgagctatccctagagctggtagaacgaaactcaaagattcacaactggattgcagacggtcgattgaacggagggactccctgactagacgtcagaaatgaatccaccatggtccctggatcggcaataagctcccagatcctagtacactagtacagtgacactcaatgagtcaataactgattacagggttacagctgcttcatcagctgcaacattgcgttagtcactgaagattgctggcacagcttcagaaggattgtgtggcagactatgcactggcttaacgcgccatcccgcaactttattaaacgctattccatagaagcatcacgagatcttatttctctccctgtaatagaatgcaacatatcacgggaccaatgggcttgctattgtgtctcagggtattgtctttattcttggagagctattttcatacagttgtgcatacacaaggtcgacatatctatacttgtgtgaatagaaaatctgtagctgcagttctacattgtccagtagaggtcatccattgtgtcacaccaaatcatcagggaatcctttcagcgtggttcaggtgagtatttcactatagacattctggtctgaccggaacacgattcgctatctggcgtcaagactgtgccaatataatctttacctattatattctcattgacaacctaagggtcctgggggggatttaaagccctaagtgagcatgggaaatgctcgggaaggccaccctttggtttatattccaccacaggtggcgttcttgtcccggcatattccgtgcgttccatcacaaaagttctccgccggccta

SEQ ID NO: 528354 - DNA, 503 bp, Homo sapiens
  misc_feature (13)..(13): n is a, c, g, or t
  misc_feature (143)..(143): n is a, c, g, or t
  misc_feature (390)..(390): n is a, c, g, or t
  misc_feature (423)..(424): n is a, c, g, or t
cgatcccttcacnggtcgagtcacagtctgataggattacgtctactcatgtattaatagcatggggaatagctaacttttaaaaaattattgatttcctccctgttaaagatttcaccagaaaacttcatataaaatcaggncctttttggacaatttttaaaatttgtatctttactagaacatgagaatctttttcccttggaagcttgaattataaatgtggtgtttggcctggctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgnggggacggggtccaccccaagaagaaagaaagnnccgtccacaggcccggctctgggccacgttgccccggaagcaggtgctccagagtcagtgagggctctccccaaccagc

SEQ ID NO: 528355 - DNA, 84 bp, Homo sapiens
ggatttgctggtgcagtacaactaggcttaatagggacatggcaaaactctgtctctactaaaaatataaaaacgttagaagct

SEQ ID NO: 528356 - DNA, 329 bp, Homo sapiens
tctagaggacatctctacgagcgcatgtccccaaatccatcatggcagctgctgggatgaatgcaagtttttcagccataaggtagcgaaatctacagaatcagattacatccacttccaatcacgcgggttgggtaatccacttagttccaggtaacatacgtaagatgtccactgggttgaaaccacaattatgatgcaatcaggactgtacttgacgatctgaggaataatgaatttgaagacattaacatttctctgcaccagattgagccgactctccccttcttgctgacggactcctgcagttaccactacaatcttagaat

SEQ ID NO: 528357 - DNA, 251 bp, Homo sapiens
  misc_feature (66)..(66): n is a, c, g, or t
  misc_feature (186)..(186): n is a, c, g, or t
cgccgcctctgcgtgggccggccgggagggcctcgggggactgactgacagagtttcactcctgtnacccaggctggaggacaataatgtgatctcgggtcaccacaacctccgcctcccggattcaagcgattctaatgcctcagcctcccgagtagctcagattacaggcatgtgccaccacgnccggctaattttgtattttcagtcgagacggggtttccccatgttggtcaggctagtcttgaatt

SEQ ID NO: 528358 - DNA, 166 bp, Homo sapiens
tatctataagtcttcatatgtcatccaacttcaactcgttgactttatctatcagtccttcaatgtcgcccataccaagaagtttgctaatacatggatagtatgaatgatcaaggtaagatggcagattattttcctcaggcgaaaatgttctgagtatcagtaa

SEQ ID NO: 528359 - DNA, 1064 bp, Homo sapiens
ccctgttcccaggcacattcccatgggtggccctgttcccaggcacatgacccttctggcctcccaggtgttcaggtatctcccagctccttgtggcccctcatcttgccccaccccatctcccccagggagcagaggcagaaggggagggggcatacctgcttctcaacctcatgtggggtgggcatgggtgggtggacggaggttgcccagtgggccaggcatggggaggagcacaccaggagccgaagggcccctcctggaaggccagagactcgcgggcactgggtcacactgctggaatggaagacggcagagtctgtgcgtctgggcactgtggcagcgacagtaacctggactgcagattctgcggggcaatcccggcgagtgtgcgcagcagtgtgcggcaagagccaagctcccaggcactgccctcctgcaagtgggtgcccatgcgctgctcacgtcgcctgccacggggctgccctcctgcagctgggctgcccactgctgtcgctcagcgctgcctgcccatgtgctgagggcctgctgctggccgcggcagcgcgtgtgtgcccacggcaccgctcgcttccatctctgccactaggaaccacgcagcgccggcgcgcgtggcaggcctcccgggcagcaccacgctgcacgccccctccccagctgctgcaccgtactgtgccaccgcccaggtcctgaggacggtgcccatgctgggcgcccgcctttccgaccaggctgatgcccagcccaccgggcaccgccccgctgctcccgggccgttccctgcgcgcctgcagctccagccgcacgcagcacccattgccccttctgggctctggcccctccaccctcacgcctgatgcgcccgagcgtcctacgccgccctgttcgctccgacgacgacggccgccgcttcactctacccacgccttagactctccgccctgctccccccccagcgcacgcacgccctgccctccccctgctccccccaggcgccttcccccccaacccccccccacgcccgccccgctcccgccctcgcc

SEQ ID NO: 528360 - DNA, 118 bp, Homo sapiens
ggcctggacttcttagggtatacagcctacagggggaaacagcttctgacacctctattattgcggtgcctctcactgccttgacttcagaaaggcatggaggcaaccagggacaaac

SEQ ID NO: 528361 - DNA, 375 bp, Homo sapiens
tcctttcgcgactagcttatgataagaatttgactcatcttcaagccatggcatcacacagcaccatcactcgaagatctattgtgctctatccgcatggagactgatggcttcctcccttcacacttggaatctgagcacttacctgcccactactcagtgcaacaatgcacctgctggatggtttcactgagtcacattactgatgtgcctctcgggtgaacagatctatcttatacacagcatcccttctgtgggcatcactacctgtctaaatttcaggtgattctgaagggaacatgagtaacagaacctgaccatcacccatgacccaagaacactcacgaaaactaaaaagaaacgtacctttaagac

SEQ ID NO: 528362 - DNA, 874 bp, Homo sapiens
tgggcaacacccccgctgggataatatgctgcccacaaggccccttggggtcatacccctggcgcacccccctgtgggggcccgactccgccccgagaaggtgtgtgggccccccacaacagatgttattttatcccgccccgtttaggacacccttgtggggtcgcgcccctggtgttgtggaccccccgcgggttaatttttctcggggcggttcttcccgccgtgtaggggggtctcccctcggcgtcctgttctcccctgcgcagttattttgttgcgccggtggaccaagcgtaaggcgttttagataatttgatagacaagaaggaaagactggccgcccccgaggggaccgcccaatgcggccccacggttctccctgagaggaggagtcctcgccgccctcctctggagcggccccgaattaaggaagccgccctctctctccgcccgtggaagaaaaacccgacaaataaagggttataggaagtcacattatatatgtggggagaaaacagtgtgggcgccccctggatatagatgggcgccccacacagggcgtctccccactgccaagccgtccgagtggcccgctctgttgcacacccggggggtcctgcccgcctcggggtctatagtgtgttgttgttccccgctcgccgctcgtccctcgtggttgagaaggccagcgaaaactagaagggggattacaaacccccacttccctcgctcgtgatactctctttgagcacgccaccgagattaggagaagttgtgggatttgtggggttaatttaattttcctcccacttttgtttccggaaattaaagtatgcccaaaaaaaaaaaaccctttttttgcccaaaaaaa

SEQ ID NO: 528363 - DNA, 415 bp, Homo sapiens
ccgagatggtgccactgcactccagcctggttgacagtgagactccgtctcaaaaaataaaaagataaaaattagccaggtgtgatggtgcacacctgtggtcccagctacttgggaggctgaggtgttggggatcacgaggtcaggagatcgagactatcctggccaacacggtgaaaccccgtctctactaaaattacaaaaaatcagccgggcatggtggcgggcgcctgtggtcccaggtactcgggaggctgagataggagagtcacttgaacctgagaggcggaggttgcagtgaactgagattgcgccactgggagacagagtgagactccggttcacaaaaaaaaaaagttaaaagggaggttaatattatcggggttgtgcaaaacagggtgtgatgtgtggggcg

SEQ ID NO: 528364 - DNA, 1376 bp, Homo sapiens
  misc_feature (413)..(413): n is a, c, g, or t
  misc_feature (491)..(491): n is a, c, g, or t
  misc_feature (1376)..(1376): n is a, c, g, or t
cagagcgagactccatctcaaaaaaaaaaaaaaaaaaaaaaaagggggttatttgggccaaatggatttatcccctctcctcgggtgtaaccggtgagggaaagtgaaacccagaacggggcaaatgtgactgggctccgctccacaaagctgtagtctcagaggcaaagctgtggccaagaacatctaagtggtctcttgctcccagtgccagggcccagtggaagggaattgactctaagggagaggagtctcagtggggaaatagggccagacgcttcttcattatttcttctcacacaacttttctctctcctctctgtgggctcccctgtgtgtctcttttctccctctcacgattctccctgtgagagagtttgaggcaaagtgacacaccactgtgtgtgactctnccccaaagacacacctgtgagacacaccccgtgtgctagtgtgtgcgcccaaaggctctccctgaatatactcagagnctctcacagagtgttctccctgtgagagagagagtgtgagagtgtgtgtctacacacagagggggtgtgggggcgacagtgcggtggggaactcacgtgtggagagccccccccttggtgggccgagggggtagtgtcaacaagagcgggagaagccgagagagagagagaaggggaacatacccgcaatataaatttgagtccccccctctagtaatataactgcaccccactagtatagtgagggagcagagtggggcggcgacccacagctgaagagttgtggtggggagagctctccacgagaagaaggggggcggaggcctcatacagaagactctcctgtggtgggcacccctgttgttgttgacacaggaaggggccagaagaacactcctcctttgttgagggcgacgccgccccctgttgggtgtttgtgtggggggcgacaccccccttcttgtgtgggaacaacttgttgatgcccaccagttgtggggcgctattctcgtggtggagcaacatgagcaggctgctgagcaccagcggcacacccgccaactattatttgtttgctgcacgggggcaccaagagggtggttggttggcagtatggggcggttgagggcgcgggcacataatttcttcctacaccacaaaccatcctttttcatgaagaagcaactcactaatattttatgtcgcccgcccgaagggggtggtcggcgctcctcctcattatttattccccccccacattttttttattaagacagagggtcggcggcgccaccttctccttccgccgcaaagtatttattttgtagcagacaggagaacacgtaattttctcaccacactgttggtgggggggggataaaaacn

SEQ ID NO: 528365 - DNA, 160 bp, Homo sapiens
  misc_feature (135)..(135): n is a, c, g, or t
acagaccctcaccactactatcttcctaggaacgacatatgacgcactctcccctgaactctacactagatattttgtcaccaagaccctacttctaacctccctattcttatgaattcgaacagcatacccgcnattccgccttatccgtgaactatct

SEQ ID NO: 528366 - DNA, 683 bp, Homo sapiens
ggtctaagtgtagtttgcttcacaataaaatttctagagattatctgtatctgtgctattgagatcatgaaacttgagtattcattaaaaaaactcatgaagaacacatacttaacaaatgtatatggattacctttccgtcatgtgaagagctgcattatattataggtattctgaaggataaacataagctacacatgtgacaaagtgcttacactaagcgggtgtatactatagtgtccaacaggtatggtgagcatatgttcaaatggaggatggctaggaacagaaaatttagaagacaaatacatggtggattttagcaaaggtggcttgggtatctattgctcacctgttgggcactacagtgataacccttggtaatgcttagccaaatccttaaatacttcctggatactataatagcagagttaccgcacaggagtgagtatgagagaaataatatgacctgaggaaggtatagccatactgcaacgtgtagagtgaggaagaatagtggaggtgaatgttgagaagtcaggcctggagaatactccccgctcaggaaaatgtcagcccttcttgcctcttttgtgccgccccagttctgggacttgagattgtctaccatagagtccagcttggtgtgctattgactggaatcattggtgttcatcctaaag

SEQ ID NO: 528367 - DNA, 176 bp, Homo sapiens
acgatcccgaattcccgggatcgagctcacgcgtccgattgaaataagactcccactggtccgggaatctctccagcttctctctctctggttattcaggagacacatgttcggtcttaaaactggcatggagcgcatgccctcccttgcagaaaattatcaaggaagagggagtt

SEQ ID NO: 528368 - DNA, 892 bp, Homo sapiens
gatccgatctctgtaccgagacttgctcctgtcgtgtagacaaggtacttcttttgctgcactgcactactcgtcagaatcttagtacttactgcaatacccaggtagggtgcaaagagctcggagagttgaggaggcaggacgccgcgggatgaagacgaacaaatacctgttagtcaataacatgccgtacgactctcatcacagggttaagtcacctgtactggagattcaagccagggttgcataacccgagaccacaagcacgtcacacgatgacatacatgtctgttaaattgtttcccatattgtcagtacttcctcactaacgtatcttcacgcgtacctatataacgtcaaagtgtaaaagcaatgccaccacaagcactaagaatgcactgaacttagctattacttcgtcacaacgtgacatttagtcccggcatacacttatctggatcatatatgcaagcaccctctgagaatatgcgcacctttccaaacacgcgtcttgttctgccactaggagtaggaggcatgcctgcgccacagaaaaagatccggggcatatccttcgacacattttaggtgggcccactttctagtccggcacggaaattgttgcgccaaaccaaaacccaagtgggtccgtctaatcgaattgcctctacttatgcaactgagttcacatttcgatcagcccatcgccattgaaaccctgcataactgttcctagcgcatgagcgggcccattagaatccctatatctgcaaacccattcaaattcaaggagcgttaccctcacccgcaattcagtgttatcactagccggttaattcattgttacagagcgttgcagacagctatggtgagaaccctaaccccgatattc

SEQ ID NO: 528369 - DNA, 303 bp, Homo sapiens
atgagtgcttcaatggacaatgacctcgagatcgacgagctgcagaatgctgcctgggctccgtggccgtcaagctgggagcagtgggagaaccacctgtcggcgctccatcgtagtcatccaccctgacacaggccgcgacctgtccccggaggaagcccaccgtgccgggctcatggactggaacatgtacgtgaaactcagaagccaggagtgcgactgggagtagatctcagtgaagggtcccaatggggcgagtcctcagtgatacaccgacaggaagtctggcaaggaagttctcca

SEQ ID NO: 528370 - DNA, 406 bp, Homo sapiens
actatacctatctatgcacaaaaagtagtaaggctatagaagacatgctaggtcatcatccaaatactaacctcaagatccacacataagacatacaacactattctccaaagagcacaccatggctgcagtgtacctctccttctctactacctcttaagataccttaactttatcttaaagcttctccttattacgagtgaactggattggataagccgctggtcttgtccttaaatattacatcccagtcttcaaaccctgctaccagccgtagaagtgcatactagtgagtaagccatagttaggcacagcaatgtggatgtacaaagataggctttgatcactgaaagcacctctctcagctgccatcttgagaacagatatctgagagatttcccacaca

SEQ ID NO: 528371 - DNA, 449 bp, Homo sapiens
agggcatcaataactccaagtttcggatcaatctctcaaaactgataaaatgaccaaaaagggggaattgttaaagcgaactaaatatggcctgagaaggactccgtacttctgtattggagtccctgtgaacaaactgagcctaacttaataggtagacaagattgaaaacctaaattaggagtatgtacctgtcacaattgctgagtctcggccagtcccagcagccgtacttcaatcactcatacactgctgaatgttcaaactgtgtgtaaatagggcaaatgccaacctgtaactaatccaggtgtttctctacctcacttccctttttttgtctataaatcttccaccacgtggctgcactggagtctctctgaatctgctgtaattctgggggctgcccgatgtgcaaatcattcattgctcaattaaactcctttaaattt

SEQ ID NO: 528372 - DNA, 180 bp, Homo sapiens
gcgttgtacggctgaactttgctggtggatacgtgcatcttccatttcaggcatgttgcacatcagtgctggcaggtgtcttgtgtgacacacagcatcaggcactttctatattcaaccattacaggtgttcatctgtgcccagttccagcaccgcggccatgtgtacctgcagctcgc

SEQ ID NO: 528373 - DNA, 247 bp, Homo sapiens
cagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacataagtaaaaag

SEQ ID NO: 528374 - DNA, 133 bp, Homo sapiens
ttagatcgagctcgtgtacctgcagtgaactgagattgtgccattgcattctacgcctgtcgacagagtgagactccctcaaaaaaaaaaaagggggctctagtggcttctggtgggggcaagatgttggtgt

SEQ ID NO: 528375 - DNA, 970 bp, Homo sapiens
gatttgatatgcgtgatgtctcacagaaagttctgcgctcgcagacgtgggtccctcgcgcttcctgcctcggaagcgcagcagcaggcatcgagtgaaggtgacagagcttccctaacgatggacccgtccaagccggtccacctcatagcctttctgggattacactggctggacatgactcagatcgtgcaggaagtcagagcaggccgcggacttgaccggtgacccatgaccgcgcggtggtctgcgaggctgtgatcctacttgtggacacacgcgacccagtggtggttgtggtcgctttgtgtggctagcgtcggagcacccctcgagggcctccgcaccttccagagtgtgttggctgatgcacatcacgcgctgactcgcgagaagccgtgatctctcctccttggcctatgtctgagaagaaggccttttatgccatgtactgcgaccatgtggccgtgatgtaccgatggccagcggcagctggtgaacggaccttcaaaccaggcattgacatcaagatatcgtggcacagctcatccgttgtcacttcgcccgactaggcgcaagagtgccggcctgcgtctgctcgtgcgaccaacaaagcagcgggccccgccgtgcactggcagactccatgctcaacgcgagtgcacatgagggcccggcagcacagctgcgacctgaggtcccctgcccagagtgcttggcggcaatgcagcgctgcctggttcagcccagtgtctcgcggccgcgatgcacatgatccccgtccctcggggctgcgccacggccaaaggctaccacacggggtcaccagtcggttcggccccccacggcacctgtccccgcacgacccaccctgcctcgcacgtggcctgtctttgggcgccggctcccgctcggctcccctcctcgtcgcccgcccccgcacacgtctccccccccccgcgcttcccca

SEQ ID NO: 528376 - DNA, 833 bp, Homo sapiens
  misc_feature (252)..(252): n is a, c, g, or t
gcccgcccgccctgccggaggcggggctcagtgccctgaagtggaggcgcccgtgggccacctccctccctgcagccgcagccgctgcgcagaggcgctggctccttctcctcccacctgggacaggtgtctccccagcccccgctcccaggggcctctctctctctcccgccccgcagggtcgagtcccggcaggggctcggggatcgggtagtcagtacctctctgcgtctccagccgccggtagttggngaccctgtggctggagtgcgttttcaccaggaaggagcgcggcatgttcccctcccgggcggcaggccggggtgggctggggcgggaggggcgcgcctgggtccggactgctgcgtccgccggcgcttgaaggggtcaggctcattagcatagcgcgccgcctccgccaaccagcgcccggcgcgagtggggcggggccacgggggcggaactgagggcgaggcggggtctcgggcaacacgcccaggacaggtgcgcgggcgggacggggcggggagcgcgtggccgccggtgtcctccccacgggaattctctggcgtgcgcgccgcgagtcacacaccgaccgtcggggcctggacacccactcgccgtgagtgaagggcagagtcaaagctgtgtggaaaccgagcgagaatctcttcccacagaaatgtggaagcgtcggcgagcgccgtcctttggagaaccttgttgcggagaatgagctcactctggggctggctcgctcccatccctttgaaatccaaggcaggattgtggggagagccagaaagagtgccagtaacacctagggggctgac

SEQ ID NO: 528377 - DNA, 577 bp, Homo sapiens
agtaaaaatctttttattgtgggaaatcttttctttatttttatttaaaacattttatatggtaagaaaaagagggttttgggggtatatatatatgggcgccaagagatgtcctgatctaggcatgcgacgcgtaataatcacatcatgtaatatggggagaacatcccgtgaagcatttatttgcgttgcaatcaattcattatcctcttttacccatattggaacatacaaataaattgctgttgcaaatagactccctgaagtgctgtggactaccaggccttattcattcttttcaaaaaaccccaacgggtaataagttccattgttcatgagcaagatgagcaggtttgttacataggtaaacatgtaccatgttgctttgctggacagaacatctcatcaccctggtatgaagaccagcaaacaccagctatgtttactgatgctgtcactgggccgacccctgttctgaaagagcctagtgtgtgttgatacccaaaaagagacatgtgctctcacattaagaatccagacaactttcaacatagacacacgtggagtgtaaaagttt

SEQ ID NO: 528378 - DNA, 117 bp, Homo sapiens
tccgactatacgtacacagcagctcgcccctgagttatcaatttaacatttctctagtattcatatcccttttcttaccatatacctcagtgtatccttcctgtgttacgtctaggt

SEQ ID NO: 528379 - DNA, 373 bp, Homo sapiens
aggatgaagtttttttgcctgttactgctggtatatcctaaaaactctgggctattttttgggcttttcctttgctgcctaagggaaagaatatcccatctatcaggtcaagacttgtacatttgccccccccacttagacctaacatgtttgcatttatgttcaacccgtccatattgtatgaaatacccccttgtttttgctataaaaaaaaggcataatgttaagaatatcttttatatttatattgagtaattgccgggcccctacttagctggttcattttgatcccaaattcagggttttttcatttagctttttgatgacggactgaataaacagggtcccaatatggccctattttgccccttta

SEQ ID NO: 528380 - DNA, 315 bp, Homo sapiens
  misc_feature (53)..(53): n is a, c, g, or t
  misc_feature (156)..(156): n is a, c, g, or t
cgtaaaccagcgtcggcggatccactaactctctgtcctgcagttgaacacanagaggctgtcaggtgcttgaaatgcagctggtctgaacagagacatactggtgtgaaatacacactggattttaaaaaccagttaaaactctccttaggaatngtgtatactaattacatggtgaaatggtaatattttgatatattggggtaaatgagctatcgtattaacataattgactttttacttttttaatgtgaccactcaaaagttttaacattttaaatgtagttctcattatatcgcggtgtataccggggt

SEQ ID NO: 528381 - DNA, 160 bp, Homo sapiens
ggcatcccggctcgttttgcggctcttggggcggctccatcgcgtggcgcttggagggggcacatttgggggttttccctgttttcccgttgtccatgtcacaacgagccggctcttcgggtcctaacacgtgcgctcgtgctccacctccccacgcgcc

SEQ ID NO: 528382 - DNA, 123 bp, Homo sapiens
gggcggtttaattagccatggattgggcctggggtcggccctaaggtaattcctggccttaaaaataaacaggtaggtagccatattctttcacataaattggtgcttaaccatttaaaatta

SEQ ID NO: 528383 - DNA, 300 bp, Homo sapiens
  misc_feature (72)..(72): n is a, c, g, or t
caaaattagagtctgctggatggtgtttgcctgaacccgtattcttccattcatgccgaatactatgtccangggatagagttttgccacttcctgtatgagtgcacaatctggagctaatagcctgcacatggggtctgtttcttttaggtgcaccttcaaatgacaagtaagacaaggaagctgggtcactgcgtccaacatcaagtttgaatatatgtccagatttagctgtcacgagggcagtgacgatggtctccttttacgggaacatagcgcttgtgctgagagtccgcccag

SEQ ID NO: 528384 - DNA, 395 bp, Homo sapiens
  misc_feature (9)..(9): n is a, c, g, or t
  misc_feature (127)..(127): n is a, c, g, or t
  misc_feature (140)..(140): n is a, c, g, or t
  misc_feature (326)..(326): n is a, c, g, or t
gtaaatttnccttaatgttattttatgccccttttggggcagggtttgcctaattatttgatgtcccatataaataggaaccttactaaaaatatattgaatcttccttagaaatgggcattcaccncttggcgtggtgntcacgcttgtaatcccagcactttgggaggctgaagcaggaggatcacctgaggttgggagttcaagaccagcctgaccaacatggagaaaccccatctctactaaaaatacaaaattagccaggcgtggtgcgggcgcctgtaatcccagctgcttgggaggctgaggcaggagaatcgcttgancctgggaggcagaggttgcagtgagctgagattgcgccattgcactccagcttgggcagcaagagcgaa

SEQ ID NO: 528385 - DNA, 237 bp, Homo sapiens
agtgatcgggacacacacacacgacacacccacacacacacactctctctctctctctctctctctctctctctctccttatcataggagtgttagctggaatatgccttagagatcatctaatatctattagaaaagtgaatttcttgagagagagtgatgtgttcgagatcccctatcggggaggcgtgaacagagcctgaagaacaggctcgtgacccaaggtgtgtgccttgt

SEQ ID NO: 528386 - DNA, 1259 bp, Homo sapiens
ctagtatggggataaggggtgtaggtgtgccttgtggtaagaagtgggctgagggcattggaatcttaggagcgaaacgcgtataaatcacctgcgcccgcacaataaggggagtggctcatatgctgtaatccaacgaggcaaatagagtcagagcccgtcacagcacacgtatacctactgcagcaacaccgacactgctggctgacgcaatcgcgacgacgaccccgccgcacacccggaaactcccaaagacccagcggcgaacaacaacatgtcatagtatagacgaccaggcgtaaccactggaaaccgagcagagcgagacatcagccacaaaaaacccaaacgtgacgcagcaggacaggagcaccaccaggcagaatcacccgccggaagggacaccaccccgcaccacacgacgtgaccccgcccgaccatcccgcacccgccgcccacaggggagagccccagacgcggtagcaacgagacgagcaaaaccggcaagaacacaccccggacacaacagcagacacaaaaacacacacaagacacaccagcccgaaacgccagcgcacacacacggacgaccactcagccacaccacacaccccagcacaaaccgccaccacagccacgcaaccaccccaccccaccgacacacaaaccaggagccacacggcgcaccaccagacaaaaccgcaccccgagcggctggacgtgacaaagaccgcgccggcccgagacgcacacctccgcgcgcagcacgccccacagcgcggaccactcagccccctgctgccctgccacccacaccgccgacgcccccgcacgcacaccagtggcgcgacgaagggaccggcacggtcaagctcggggcgacgtctggtgggacaggaatatcgcccagtactgcccgccccgaccgcggtcctgttgggtgtggactctgcgtcgcggcttccggcgtggtagtcggggctgccagggaggcccgcggacgttggcccacgcgtgcagggacatctcgcccgcggcgccggcggtgcatgcaggggccacagaccgcagctcggccacgcgccggcgggcggggcggtctagacatgactggctcgttcgcgatggtcgggggacaaggtcggacgcaccgaagccgcgcccggagcccgtggcggagatcggatggggaccaagccgccaacgactggggagcgcgcgcgcacagcggccgagccgtgggcgggcgcgagagcata

SEQ ID NO: 528387 - DNA, 258 bp, Homo sapiens
cgagagacagatcgaatcgagctcggtccgaacgggtgatgcggttgtgtgaagtttttcaaatcttctaacaaaagaattaaaagaaaataaaccccagatttctgaagtattttaaatatgattttggcatgatggtaaatataggtttttcccttgatttttttttttctttttttttggagacgggcccttcattacactcaggccatagggcgggggtgcaatctgggctcgcggcacccgcattcacccgtt

SEQ ID NO: 528388 - DNA, 403 bp, Homo sapiens
  misc_feature (204)..(204): n is a, c, g, or t
  misc_feature (212)..(212): n is a, c, g, or t
  misc_feature (216)..(216): n is a, c, g, or t
aaaataaagtagaaaatatcagcaaagaacttcattatttgttttgccataatcttatgtctaacggatatgcattaatttttgctatcctaagtctagaagttacagagttccttctctgactgcttaccttttccttgaccctaaatctctgagaaggaaattctactgattcagtcttattaggagtttattttcaatggncacttagnggtnaaaagccaaagtactcacatcacccacagcctctctgccctcatctccttacagtcatcctctggctcactgtactaagtaatggtgactgctgcttttaaagatgacaggcttaatccacctcaaatactctgtaccaactggttccttctaactgggaacactcttctggtcaaaatggactcac

SEQ ID NO: 528389 - DNA, 102 bp, Homo sapiens
cacccaggcgcacttcttcacaagatccaattggatcacaccctattaccctatgcttataaaactctacccaactaccagctccagaagtgcgcctgggtg

SEQ ID NO: 528390 - DNA, 613 bp, Homo sapiens
  misc_feature (529)..(529): n is a, c, g, or t
ttttttttgaagaaaaaagataaccgtatttattaaaatgaaacaaattatgtgtatgactgcaagagttctggcatgatgcatcttggactcaacaaatcttgttggggaatcccatgtggttggagaacagcaggatagttatttactctggtgagtctgtcaccaggcagttgtagtaccatgaggttttacatgcaccatttaaacaatgtactaggccgggcactgtggctcacgcctgtcatcccagcacttgggaggctgaagtgagtggatcacttgaggttgggagtttgagaccagccaggtcaacatgatgaaaccccatcttgggccgggtgcagtggctcacacctgtaatcccagcactttgggaggccaaggcgggtggatcacgaggtcaagagatcaagaccattctggccaacatggcaaaaccccgtctctactaaaaatacaaaaattagtcgggcgtgctggtgcatgcctgtaatcctagctgcttgggtgctgagttaggagaatngcttgaatccgggaggtggaggttgcagtgagccaagatcgtgtcactgcactccagccggggcaacagagcaagactctgctc

SEQ ID NO: 528391 - DNA, 860 bp, Homo sapiens
ttttttggttgaccgggtttgcggctcacgaaacaccaggcacatttttgggtccccccgaacacccccccaagggctaagaatttgggggcgccccctcgtctggatacccctaggcctacaccttgggggtatcttcccgaggaaccccgggttccttcgggaccccccatgggaatatttgggtcctctgggcccggcccccttccagcggcccagaggtttttgtgtgctggacccgggggcaacttggtgtgccagacattgagtctgaactggttcccgggtcctgacccagtactgtcccatttgcctgagcgcccgtcggcacaaccggcaccccgggggcccgaggcgccaaagggagagctctccagatccggggtccaaaacccggggtggacccactgtcccccatccaatctgccccaaagagggatctctctgcacatgccacatacacggggaagactggaagaatgggaccagagatttgccagccagcctgcccccagaacccagccccttgtgtctttcgtccccttggcaccaggcccaggttcatcaaaggcttggacccagggcttctggggatgtgtgagggggaaaagcgccaactggtgatcccactccgagctagggtatggagaacgcgggagctccccccaagattcccggcggtgcaaacctggtgttcgaggtggagactgctccaaatagagcgacgaactgagctgtaacccgactggggaggggccacgggggagaggccccccatcagggacccgactgttcccaaaaaaaaaccaaaaaccaaaaccaaccaaaaaacactttaaagcccaaaaaaaaaaaataac

SEQ ID NO: 528392 - DNA, 454 bp, Homo sapiens
atttttcagccaaacaaatgctgagagaatttgccactactaagccagcactaccagaaatgctaaaaggagttccaaaccttgaaacaagaccttgaaatacatcaaaatagaacctctttaaagcataaatctcacagggcctatataacacgatgaaaaaaattattaaggcaacaactagcatgatgaatagaacagtacctcacatctcaatactaatgttgaatgtaaatggcctaaatgctccacttaaaagacacagaagggcagaatgaataaaaatccaccactaagtgtgtgctgtctttgagagactcacttaaatgtataaggactcacataaatttaaggtaaagaggtgggaaaagatattccacgcaaatggaaaccaaaagtgagcaggagtatctattcttatatcagacaaaacacacttcaaagcaacaacagt

SEQ ID NO: 528393 - DNA, 515 bp, Homo sapiens
caggaccagtctcaaaaacacaaaaataaaaataaaggtttccttactattaagtgtcatttactgtattaatgtcaatacagtaacaacactcaaattatcagaaactgtaaaaatttccagtttttactggaaataaaaactgggccgggcgcagtggctcatttctataatcccagcaattttggtggccgaggcaggtgtatcacttgagctcaggagctcgagaccagcctgggaagcatggtgaaaccctgtctctaccagagatacaagaaattagctgggcatggcagctcaagcctgtggtctcagctactcgggaggcggaggtggagggatcacttgagcccaggacgcggagattgcaatgggcctagatcccgccactgcactccaggctgggtgacagagtgaaaccctgtctctaaaaaataataataataattaaaggtaccaaaaataaataattgatggtaatgctgacccaaattaaatttaaccttcagattact

SEQ ID NO: 528394 - DNA, 567 bp, Homo sapiens
gctgcctgcctactactacaggaaaaaaaaaatctaaaaatctttccactatccacagtttttaggtttcttctcagtttctggtgaactttcccaaatactggcacaggatgggacagaaaaccccatccacgcgaggcctggagggcttctcagctggggtcatatcttcctggcaagcctaactggctgggacagtctcttcttagaatcgggaggtgaagttcctgaggcggtgggccccagctaaggttcccagcagtgtcctatcgaaacctggcggtctgaggacacccggcagttcctggcgggaccacatgtcagacaggagaagccgggcagcttctgcggcctggggtgaggcacggcttcggcacaggtggatgatgtggtggagcatgcggctggagaagtacggctgggccagtgggggctgcgaggccatcaggttcctcacagggtagcaggccgaggacaagatgtctccggagtggctggtattgccaggggggctgttgaggagcctggtcacctcggggaacacctggttccccatcactctgtgca

SEQ ID NO: 528395 - DNA, 879 bp, Homo sapiens
cgctgggtggggggaggaggaaggagggacgagaaagaacagaggcaggagggacaaaaaggcggcggtgtcggccggtgcggcaagcgaggcaaaccgggcaaagggcactccccacagagcgacttacgagctcgggtgtcccccccccgcgacggcccctaaatcggcggaaacgtgtcgcaccacagcacaggcacctggtcgaagaggaggttcgctttggcgccgcgggcgaccaaagagccatggggccaccggcgcgagccccggggtcagcggttgctccgccccgggcctcccaaagcggggtaaccctgtgtgtccccccccaccccgacaaagttggttttccgattaaatacaaatgggggattcccccctttatcagcgtatcttgaactgcttgccctccggtgtcccccgccgcttccggtgtcgccccagaagctggattactcaggcgtgtactccacgcgcacccccgcccgcctttaacatttaataaaggaaattaatcgtcgtccttctctcttacaacaaactgaaactccaagacttaaatttttcatccgattatcatgggaatctgaggttcgtggacctctgacaagggtcattagaggtatataaccggggcgttttctttccaccaaggtaagggtatcgctccccccgcatcatctgtctgatctttcccgcgtatacccacttcgtacaatagcaattttccctctagaggcccaacaagttccaccaaaaattttacattttgcaaatgttgattcatcaaccgtgtgtacaaacagacgtttcttgtcaaacccgataaaaaaaggaattttttaaagaaaaaaaaattatcaagttcttacatta

SEQ ID NO: 528396 - DNA, 319 bp, Homo sapiens
caggccccgtaacaatgccgagggctaggtgagaactaggcaagctctgggatcctgagccaagccgcattggggctgaggtttgttcgtcgagcccagtttccctttgcagtatgcagctcctagaagcgcgttgtgtgccgtttcggagctaggccctaggtgggtccctccctagctggctatgggtgggatcctagggccagtgcacacagggcttcttcaggccaaatcagccttctgcgcgaaggagaagacgcttggagttggtttccagctgcggagaccacgaggcaagcagcagattgttcggggcctg

SEQ ID NO: 528397 - DNA, 207 bp, Homo sapiens
ccagtggggcatgcagctggtacaccgtgaggcagagcttgttgaggtagatgtagacgttgaccagcaggtcaccagtggggcatccgggtgctacagccaaccacagagcaagagaatgtgcagtatgctggcctggactatgaagcaatcctgctgcagactggcaggcctccagaataagacccaagtgcccatggtggtcat

SEQ ID NO: 528398 - DNA, 85 bp, Homo sapiens
cccccttaaggggaaattgggtttttttttaaaggcccccttttaaaggggtggattttcccaaaaaccttttttttttccccca

SEQ ID NO: 528399 - DNA, 374 bp, Homo sapiens
ctatcgatcagctagggtataagtaacctgatctcacgattgtactcagtcccggcacacgttccctattcgctgcgtgatcgatccaacgcttgatcaacttctgcttcaccatgatgcgtaagagccgacatcgaagcgatccaaaagcgaccttcttacttagaatagcctttcggaagcaagtaatccctgtggtaacactgctgacacctcctgcttaaaacccaagaggtcagaaggatcgtgaggccccgctttcacggtctgtattcgtactgaaaatcaagatcaagcgagcttatgcccttctgctccacgggaggtttctgtcctccctgagctcgccttaggacacctgcgtaaccgtttgc

SEQ ID NO: 528400 - DNA, 401 bp, Homo sapiens
tgaattttctacagaagtcaaggcagtcaaactgcggcgagatagaattgtggtggtttggactccatgattaaggtgtccacattcacacacaatccccatcagttgcacgtcttcgaaactgtataacccaaaggcctctgtgtcttgtcccaatagtaacaactccctcctggctttccgggcacgcacacgggccatgtgcagcttgtggactggcagcagagaagccacggacatcctgcacacgaggtgtctgagctgtgatcaactgagacaagatgatgatcgaaaggacgcttatagatatgtactctggataatcagactgagagtccagcacatttctgctcttcatcgtggtcccatctggttccggcccggcatgctttttgcgtgaa

SEQ ID NO: 528401 - DNA, 330 bp, Homo sapiens
aatgatatcggagctataaccgaacaggaccaaaaattggttcggggttgtctttgtactagtatacacacatgagtttagaatacaagtaataagtaacagtcttttgcactgtgggaaaggtcgtgcatgagaaatgccttacggatagttgttgggattttattatgctgttgacggtttggtttgtgtggttttgtttgctgttgattttttctctcttgctaccagcatggctatgccagacaaaccccccagtcccgggagctaggaagtgtttaggacgggtctggaatacacaccttggtagtacgccggctccagggctga

SEQ ID NO: 528402 - DNA, 190 bp, Homo sapiens
cccccccccccccccggggggggaccccccgcccccgttttttaaaggggggccttcccccctgggcccccggggggcgccccggtttttgggggggggggccccccccccccccgttttaaaaggggggattttaaaatggggggggtttaaatgccccccgggggggggaaaaccccctcctttttta

SEQ ID NO: 528403 - DNA, 286 bp, Homo sapiens
gaggatccctgagcacgaatgtcatgatcgtatcttatctcaatggatgtgctgatgcggctgcgacgcagcgcgccagtgagatcgccgagttgttgcgcataactggctggcgttacgcacactgtaatgcccgttcgcttaccttcgaatggcgcccatgatgggtaagaaatcccaggtgctgatacctgcgataattcgattgatggccaggtacgagcctgtaggagtttgggagtcatcagatagctatcgcgttgaggtttacctgcggagcaacagc

SEQ ID NO: 528404 - DNA, 511 bp, Homo sapiens
tatgcatgaccagatggacaagagggggtgataccgggggtccagtgtgcaaggactcagcagtagtgaagtggtagtccatgacaccgtgatcacagatcttatgtgagctgattccatccaccacggtctgagatcctgatgatcagatcgacatcattgtaggcgatggtgatgaccacatctgggacattgtcgggagtgtctaggtgactctccatagtggctctcatggcattcattgagcagctccggcaggatgtaagtccagtggcaatagggatgaaggggaaccgggcagccacatggccattgatgcggacacggggcgcaattgacatacttgtgctcacacagtgcgtctggcaaaagtccaaccacttctcaatcaatctactttggtgagagacgagtacagatgatgccgacaaagtcaggcttgtcctcatgcagcgccaggtgatgcgtggccaacaatgcggattccaagcctcgaagtcagcgccttgat

SEQ ID NO: 528405 - DNA, 131 bp, Homo sapiens
ggacccacggcggcagcggggcatagagcagacttcgtcgggaaaaaaataaacaaaaaaataaaggcatgccaggtacaggggtgtgcaccggtagtcccagctactcaggaggctgaagtgaaaggatc

SEQ ID NO: 528406 - DNA, 285 bp, Homo sapiens
tttttttttttccaggggccttttgggcggggcaagggctgggccccgggtttttaatccgggggacgggggccccttccaaggggggggtagggggggcccaaagggccccaaaattttggggggcctttcccttttccccccctttgggggttgccttgggggaaattttgttcccccctttgcctccccccttaaaacttgggggggggaaggttttttaagccttttcccgggtgggggcccccccttaattttcgtttttccccctttttttttgtccca

SEQ ID NO: 528407 - DNA, 142 bp, Homo sapiens
cctcggctatcatcggcaccaggcaggggggttatttctgttaatgttagtacgggtggggaagtcgaggttgacctgtttagggtgaccaagaattattccagtgctatatgcgcgcttgtcatggtaggtcgcgatgagt

SEQ ID NO: 528408 - DNA, 678 bp, Homo sapiens
  misc_feature (656)..(656): n is a, c, g, or t
cgaaggccacgaaggagacgaggaggaggagcgcaagaagcggctcggccccggcggcctggaccccgtcgaggtctacgagtccctccctgaggaactccagaagtgcttcgatgtgaaggacgtcgcaagatgcctgcaggacgccatcagcaagatggaccccacgcgacgcaaagctaccacatgcagcgcttgcactgactcaggcctcgagggtccacaagtctaaggccagcgagggccaaggagggagaggaggcaggtcctggggaccacattactggaagctgttccacaagacggacgatgagaaggaccgtcaggtcgtgacctgccccagctaccaccgccaccagcttccaggcacggatgagcccctaggtcagaaaacagactagatgccatctcgcccgctcctgacttccttacctgcgctgctcggcccagccaggggggcccgcccagccctacctggcctctccaactgtctcacactcctccagcgcccaattcaagtctcagcttagagtaaggggcttcactgcagcagccccccattaagcacttgtgcacaaaggacccgggggtacggggaagggcagaggtacaggctggttacaaggtagaagggagggtccccagccaaggggccngcatctcgtcactgggctctgt

SEQ ID NO: 528409 - DNA, 494 bp, Homo sapiens
gtgatgcatgcttcttaccggcgtatgtcaatctaggtggcagatgtaacacgaagtagaactatacccactacgtacacgtgccaagatgtcgtaccttgatacctagcgggacctgcaggatcgtcaacagttgctagcatacaggagtacggtaaatcaaggatcagaaaaggaggagacgattgatgctacttctcagacagactacgacaaatacgataaaaaaataaaagtggcatagactaccttgaagcctgactcatttcctcctcaccatgcctgtgaaagccgcgcgagctcttctatggggcgagctgcggcctcacatcgcttgggcccattccccatgggcagtgcccgctactcttgtcacagatcccttcagactgctcttctgtccaaggcccatcatctgcggctcgagctctacacgctatgcgtcatgcgaatgcttctctccacctggtgctcatctgccggtggccgtgatc

SEQ ID NO: 528410 - DNA, 124 bp, Homo sapiens
gcgtccctttcaggtaagatctccatagtatatatgcattttccatgtcaagttatgacggagttaggaatcacaaatacaataaacaatcaaaataaactgttttggagggcacgaaatatat

SEQ ID NO: 528411 - DNA, 482 bp, Homo sapiens
ctgcttccactggccccacccatccacccatcttgcctccccattctctctgtccatgggtggtgacaagctttgccttgacctgagcccatgtacctaggtttgcaccttctctggagtgaaagaggagatgagttattttaatcttgaagatcccaggtcagaacatcagttttctagtccaagcgctgcctcactgtcttcatttataaaatgagagaggggatgcactgttccccaaatctgagacccagggtgtacacgattggagccaagtctcacagctggggaggagtggctccggcacttgagttcagtttctctggctccaaatctgtagggagtgggggtctcccttagataagtaggttaagatccttttgtgattcataagcgtgatgattgggttttcatgctcatgtgtgagatatgcctctctcaagccttgttacaacatcacattacctgtctgatgttacaaa

SEQ ID NO: 528412 - DNA, 840 bp, Homo sapiens
  misc_feature (177)..(177): n is a, c, g, or t
  misc_feature (567)..(567): n is a, c, g, or t
  misc_feature (598)..(598): n is a, c, g, or t
  misc_feature (681)..(681): n is a, c, g, or t
  misc_feature (688)..(689): n is a, c, g, or t
  misc_feature (695)..(696): n is a, c, g, or t
  misc_feature (746)..(747): n is a, c, g, or t
  misc_feature (749)..(749): n is a, c, g, or t
  misc_feature (759)..(759): n is a, c, g, or t
  misc_feature (765)..(766): n is a, c, g, or t
  misc_feature (770)..(771): n is a, c, g, or t
  misc_feature (778)..(778): n is a, c, g, or t
  misc_feature (782)..(782): n is a, c, g, or t
  misc_feature (785)..(785): n is a, c, g, or t
  misc_feature (790)..(790): n is a, c, g, or t
  misc_feature (792)..(792): n is a, c, g, or t
  misc_feature (803)..(803): n is a, c, g, or t
  misc_feature (805)..(805): n is a, c, g, or t
ggttgttgaccatatgtatgtcttcttttgagaagttttttgtcatgaaatctatttcgtcccatgtaacgattcctggtgaaacaacaaaagaaaagagcatgcatgagcaccactgcttctacctgatgaatagcaaaaaggatttaaaaaaaggcctcttccactccattgggnctacctttgaaaacagtgtgaagttgggggctgacatttctttgttagcacacaggagtacaatatctccagaaagccttggccacacaagtaggaaggaaatttgccattctatgcaagtccttaaaagttaaaagtacttggttatgacttgtttatacgtgggacatttgcctttttgtgcctggatcttgcaactcaaataggctatatttcacaatagccctgttaattttacaaagatagtttccttatacttacttgaagtgataaattgcttcatcatgaacacataaccttttgttgtgacttcttggcataaacagtttcaatatatctaatatatactgtcgcaaagagtagtttttctacaatgttgtaaattcacantcttaaaaaatattttaagtcattttaattntgtgttgtttcccaacattattgtgactatcaattattttaccaaatatttatttcataaatccttaataagaattctattantaagttnntatgtnntgagtgtatcaagagttataattacatttcatcactaagaaaataattanntngatagaagtngtatannttcnncataatnctantanttgcntngagttcaagtntngaatgtttttcacattttataattcctggcttaaa

SEQ ID NO: 528413 - DNA, 1273 bp, Homo sapiens
  misc_feature (683)..(683): n is a, c, g, or t
atgtgtgtgttaatcccgcagaatggtttcttgtgggggacgcagcacaaagtggggctacacacgacgagagcccacgagatgctcctgttcttctccctttccgcggagaactcctttgtgctctctatgattgggccctagtggaccaccgaccctgatgtggtctcaaagacccaatttacgaggggcaacacctggtgaatacccaacccccacgctttttgggaggaacatctgtgcttcgcccttacataatgcaccggggggattttttgggccccttttgtgtgttacacccccaagggatgggcccttctcttagggattcacgggaaccacatgtttctggcccccatataagggtgcccacagcctgtcttgcgcccgggtgctgtggtgccccttttgcgcacccattgttgaagttcaccctgttggccaggccccgggagcaccgtgggttctttggggcctccgtagaaaggctcctcccctttgtttccccaggcttttatggtattctaccccccgtgaaaaagtctgtcccacagggcgcaccccacgtgtgagaactctcctgaggtgaatgctgcacggctggagtcacagagctggaagcacacaaaggtggggaagccaccgcggaaagccacacgcttgctgagaacacatgcgctcanacattcgttccccccgtttttccctttgggcctgtgtcacatccacagcacaggtgtttctgccacaaatggcacagcaatcttacccacccccctgagaagtggccttgaatatcaccacagaggggaaatcttctgcactttctcgctttccctcggagagggtggtccgccaaattgttggccacgttgttctcgttctgcacagagttggcataaccccacacttgttggcacttacgtagccccacttctatcactcacacgggtacacaacgaggtcctggccttgttctgtggaagacggagttacacccttcccacacttgctgaaaaaggtcaaggcctttcttggctgaatccactctgcctttgtggctgctgcccctgtggctgctgccacccaccacgctgctcctgctgctgctgcagccccacgctaaaggttgaagccccacggaagaggtcggaaggaagtcggaccgaaggatatgggaatttggtttttttgactaatccacccaaaagccaacccacttagcccagttttatttgccaaaacacaggaaataaaggcttactttctttta

SEQ ID NO: 528414 - DNA, 726 bp, Homo sapiens
  misc_feature (537)..(537): n is a, c, g, or t
  misc_feature (540)..(540): n is a, c, g, or t
  misc_feature (565)..(565): n is a, c, g, or t
  misc_feature (631)..(631): n is a, c, g, or t
  misc_feature (641)..(641): n is a, c, g, or t
  misc_feature (663)..(663): n is a, c, g, or t
  misc_feature (693)..(693): n is a, c, g, or t
  misc_feature (700)..(700): n is a, c, g, or t
caagtcttgagttaagaaggaaagatgaaaaaaagaaaaaagcaccaatacccagatttaaaaaaaaaaaaaaacgatcatagtcttaggagttcatttaaaccataggaacttttcactttatcttcagtgtttagcttgtaccagtcaggtgattaagttagaaacttacaagttgtgttataggcttatatgtgttgtagtgtgcgtggtttatgacctttaattaaaggtgtaattatgtttttaccagcaggggtttttttaacttgtgactatttgtattaaaaacaaattcttgatattccagaagcacattgaagtttgcaacttttccacccgtgcccattttttgtaaaactgcagtcatcttggacccttttaaaacacaaatttttaaactcaaccaagcctggtgataagtggaatggcttactggtttatactggtggtatgttttggattacagccagataatgctttcttttccagtcgtctttgagaattaaaggaaaaaaaatcttcagatgcaagggnttnggtgtagcatcttgtctatcatgtntgtaaatactggagaagctttgaccaatttgacttagagatggaatgtaacttgcttacaaaaatngctattaaantcctgcttaaggtgtctaattntctgtgagcacactaaaagcgacaaataantgtgaantaccatggtcactacacaaaccacaa

SEQ ID NO: 528415 - DNA, 1306 bp, Homo sapiens
  misc_feature (483)..(483): n is a, c, g, or t
  misc_feature (618)..(618): n is a, c, g, or t
  misc_feature (1306)..(1306): n is a, c, g, or t
ggccctgtgcgcgcgcacacgtcgtcggagccctcgggtgacatgcaaatgagctggctccaggtgtcgccaagagcctaagcggcccccaactgctcagaatgagacatcccctagacgccagagcccgattgaccattcggcctttgcctcgagggtacgggaatagaaaccatcatggaacattaatcgtcacgtccctggttcccccgtcgcggcacgtgctacgaggccgggtcgatgccctgtgggggatgccaccccgtcacatcgaacagtccggaacgacctcaacggcactgtcactccatccctcggtcataggctggaggccgagtgccacgctgcctaaaggtcatcgggacaccggagcgcgccacgacatgattgcaagtgttgcatgcgtgtcgtcgaccaagcgccgctaagtaagagcgaccgctagctagcgcttggggaagcttggagcctccatcgccatgnagtccggagtaggattccaagggtgctcgtttgacactcctcactcaaccgcgattcgttctaggacacgggatatccacgacagggtcgtagggggaacccgtcgaacgcgggcattccgtgtgttctcccccngagggaaccacgtggcgcccacctcactgttgccttgcccccagggtgtggtgtcccctgagctaggtgttacccgttgtcagcgcacggtattcgcattcattccacgggaagcagcgtgaggaaaggccctgacagcaaactatcgacgaattacatttccgggcaaacagatgccaaggcacaggaccgtggaaatacgacccggagaaacgccaagcgtttgacacaacgcgggtttttgacggggaacaagacgggacacccccttttccaacacgggcgggacggttcccccaatagcgctccaaacggcgtatgatccgttgagccgttaggcggaaccgtgcggtcgaaaccgaagttccccaaagttgggaccccaggggatgccgggttgcgtaagagggcgcccccattttccgccagaggctattaagacgcccagtggtcagttacgatgggcgggcaccagccacaagagagcctcgcaatttctcttccacgggcagtgaactttggcgacaggtggagcataggaaagccgtgtaggaggcaagggcgaaggcaccgtagcggcctaatactccatggcgatggttagcagaaccgttacagggaggtcggaggaggaagagcggaggccacaccatgagttaacatcccagacggtgttgggagcgacccn

SEQ ID NO: 528416 - DNA, 310 bp, Homo sapiens
cccccgtgcgcacagcttctccaagtgctggattacagagcattgaccaatctgcgtccctacccacaatatttttaggcatggaccaagtcttgtattcgtttgagccacacacaccattcagacacagagtgcgggtcctttcacgtctcttctcatgtcccgatccctgtcagctgtcattcacctgtgtggtacgagccatcggctgtggcaactctgcgtaagatggctagtcatttcacgatctctgatcatgtccactacaatcaagactgtcgagaagcacttgagcttggggtcagtcatt

SEQ ID NO: 528417 - DNA, 159 bp, Homo sapiens
gacagaccagaagagtgagtcatatgtagtacacaagagtaagcattgtagaggatgagaggtgtttattataataatgttagtagtattcggctatgaagaatagggcgaaggggcctgcgagagtatatcgatgttgaagcctgagactagattcgg

SEQ ID NO: 528418 - DNA, 222 bp, Homo sapiens
aagtccctcaacccatctcgggacagcagagataggctcaggtagccagcagttcctgtgtctgttgacagagtaggcaaagactaggggaagggcacggcctctagagactgccgccatttgaggcaacgccacagccaattgttcctgtgcccaaagaaggaagttgggcctcccttctcctcacataggccagataatcagtctgaggcaggggtgagg

SEQ ID NO: 528419 - DNA, 111 bp, Homo sapiens
  misc_feature (29)..(29): n is a, c, g, or t
  misc_feature (67)..(67): n is a, c, g, or t
tatagaagaatatagttattttaattgtnatattaactgtagggtgaggaaaggggggggggtcccnttgtggtgaactatgttatagcttgttactcatagtttcttttt

SEQ ID NO: 528420 - DNA, 808 bp, Homo sapiens
  misc_feature (267)..(267): n is a, c, g, or t
caaccgtcatctactctaccatctttgcaggcacactcatcacagcgctaagctcgcactgattttttacctgagtaggcctagaagataaacatgctagctttgattccagttctaaccaaaaaaataaaccctcgttccacagaagctgccatcaagtacttcctctacgcaagcaacccgctagtcctataatcgcttctcaataggcttatcctctctcaagacaatatactctgccggacgaatagaaccagtaaccaatanctaccagatcaatactcatacattacataatccataatggcatatagcgaataaacactcaggaatagcccccgtttcacttctgacgtcccagaggttacccaaggcacccctctgacatccggcctgcgttcttctcagcatgacaaaaagctaggcccccatctcaatcatataccaaatctctccctcacgtaagacgtaagccttctcctcactctctcaatcttatccatcataggcaggcagtttgaggtggattaaaccaaagcccagctacgcaaaatcttgagcatactcctcaattacccacataggatgaataatagcagttctaccgtacaatcctaacataaccattcttaatttaagtatttatattatcctaagctactaccgcattcctactagtcaagttaaagctccagcaccactgacctactactatctcgcacctgaaacaagctaacatgactaacacccttaattccatccaccctcctctcctaggagggcttgccccgctaagcggctttttgcc

SEQ ID NO: 528421 - DNA, 715 bp, Homo sapiens
taggtgtcccctcagaattaattttctggattgtcacaacgtattcaagtagtgtccttgaacacagccacccagcccttagggtggtccctggcgtgtcctgtgggcgggcagacttcctgagggtgcagttgcggggaaacagagaactgcttcgagcctggccacctttccctccgtgtgccggctgcttctaggagatgctgtgggacggtgcccggcttcgcgggtgactaccatgccctaaggagcagagcctccaggatgcccccgggctagcgctggacgctaagacgcccagaacctaatcacagtcagcagtttccctccactgacagtgatctgcatggtccattcctggcggcctgggggcctcgtctacagttcaacctggctggcttccccgattcctccccaggggagatcagtgtcgtgtgtaacctgggacaagtcactggggtcctctctaccagggagtgcctggagcaatttcaacccccagctcagctgcagccctatccggggtcagctctccacccagagacccggagcttgctcggagattgccggtctgccccagctcggggacaagtgaactccagaagtatgcagacttggcagatgccgcatgctggatcctgggcatgagggctgggctgacactcgtccattcggtgcatactgccttgaattttcactatccatcattaaacaa

SEQ ID NO: 528422 - DNA, 109 bp, Homo sapiens
taaccgagacaagaagagaaaatccaaataagctcaatgagaaatgaaacaggagatattgccactgacaccagtggaaataccaaagatcctcccaggctactatgaa

SEQ ID NO: 528423 - DNA, 216 bp, Homo sapiens
ctgctatccttgggtagcttgctgcatgattggacgtgggagagttacgatgtcgccacagtttactgagagaagggctaacacggcctgaaccgatgcgtgtttgtgggctagaatacacaccacatagcgattggacttaatgtggctgaggcaccccgattatagcgcatcgttactgcctgactgggctaacctgtaccttcatcaaaggtg

SEQ ID NO: 528424 - DNA, 436 bp, Homo sapiens
tgtcactgacaaggagcccgaggtatcattcccctggagaatctgagcatcgagagttggacgacccccggaacacgaactgctttgaactttacatacccaacaacaaggggcagctcatcaaagctgcaaaactgaggcggacggccgagccggtggagggaaaccacatggtgtaccggatctcggaccccacgcaggaggagaaggacgagtggatcaagtccatccaggcggctgtgagtgtggaccccttctatgagatgctggcaggaagaaagaagcggatttcagtccaagaagaggcaggagcagccctgagcccctgaccccaactccattatttattacggagctgacccgcctgggtggccggaccccatgggccttggggctgtggatcctggttccctgtttggaaaattcatcacctcta

SEQ ID NO: 528425 - DNA, 772 bp, Homo sapiens
cgggcggcccgagagctccgggggccgttgcaggccggccaagcgcccgccatgcgcgctgcccgcgccgcgccgctgctccgagcgtgctgctcctgctggggccgtggctggaggctgcgggcgttgcggagtctccgctgcccgccgtggtccttgccatcctggccctgcaatgccgaacattcgctggcccactacctgggcgctctggagcggctggactacccccggtgccaggatggccctctggtgtgccacggaccacaagtgtggatcgatgaccacagagatgctgcaggatctggctggcggtcgtgtgtggctcatgactatgctgctgtggtctgtgcggcctgagggcgagccccgtgtactaccctagatgacgagggtccctaagtcactggaccaatggaagaggccaccaggtaatctgactggagcgtgaagcaggaagccctcaccgtttgccaggacctgtgagggccgactatatcctggtgttgcggacacatgacaaccattctgaccaacgaatcagactctgcggcattctcattgggtgcacggggctatccagtggttggccccaatgcttggactcccagacctactacttccaaacttctggtcgtggcgatcagccccccaggggctactaccgctcgcactaggcgatgtaactttccccaccaagaatccgccagcgaccgcgaggctgcttccgctgatccccactgtgtccactcctagctttccttgccatccc

SEQ ID NO: 528426 - DNA, 887 bp, Homo sapiens
taatcatttggataaggagtcccacgtttttatttgcactgggcccagcacattaggtagccagtcctgactagcagatagtagcattaattctatttgaagtcaaagttgttgaaagtgtataagtggcctggctcggtggctcatgcctgtaatcccagcactttgggaggctgagatgggtggaacacctgaggtcaggagttcgagactagcctggctaacatggtgaaaccccgtatctactaaaatacaaaaaattagcctggcgtggtgatgggtgcctgtaatcccagctactcggaaggctgaggcaggagaatcgcttgaaccccgggaggtggaggttgcagtgagccgagatcgcgccattgcactccagcctgggcaacaagagtgaaacactgtctcaaaaaacaaaaaaagtgcataagccagttgttttattatttgagtttaaacaaatgggtgcctctgttaatgtttaggctaagataatttctcagacctagttttattatggataatttaatgttttcctgattttccctgggtaaaaagacatagggcctgattacttccaacagagggacgaaaggagagtcttcgccagattgcaatggatgaaagcttccggttcagatctgtgccttgcttgcaacaagttgttgatcactccaggctatacgtcaggaatctttcagtcatcccaattggtctcctaattttactggctgttcagggaactcgtgggaacttcttggtaattgcagacattcaaatgatcccctgtgaatttaacgggcagtctccggctataaacatcacctggtggttttgcaccacaagtttacactcatttggtccgcgtttgtcacaatcgatga

SEQ ID NO: 528427 - DNA, 146 bp, Homo sapiens
cgtcgacgtttgggtccccagcactgttaggcatgttggtgtgagcctgtaacttagagcctgtttcaaaatacaacatagggaaggaagctggggatgtgtgtgtgtgtgtgtgtgtgtgtgtgtgtgtgtggatgtgtagtgag

SEQ ID NO: 528428 - DNA, 465 bp, Homo sapiens
ttcggccataatggccgggaagctatggataattaaaccgtggcaattgagctaaactacttgactaaaatggtaatcaggctttatgaggatcctccaaacaccaccagttcccttaaggagcattaaagcaggcagcaacccagttccagggggaccttcaagggcagttgttcctaaaacctaatttcgtaaaaggattttacctagcaaaccagaaccgcatgaccccaaaaaaaccactggaaaaaggaatggaaatcttaccaaaagctggaccttttaatcctaataaaattagaaggtcctaaggtttctccttaggcattaatgcgtccacttaaaaaggttttaaaatttagggtttccttggttaatgtcaaggtaaggaactgtggccatgacctggaatggttaaaaccacggttggttagcattctgtgagcaggaaaccttatagggata

SEQ ID NO: 528429 - DNA, 447 bp, Homo sapiens
aggattcacactgcacagagtgagaccccctatctcaagaaaaaaaaaccaatttgtttcataattatgtaaattaggcctgggcatggtggcttatgcctgtaatcccaacactttgggaggccgaggcgggcagatcacttgaggtcaggagttcgagaccagcctgagcaatgtggtgaaaccccatctctaccaaaaatagaaaaaattagccatgcacgcctgtggtcccagctacttgggaggctgaggcaggaggatcacttgatcctgagaggcagaggttgcagtgagttgtgatggtgccactgcactccagcctgggtaatacagtgagactccatctcaagaaaaagcaaaaaaaaaattatgtaaaatacttacatggttccaagtcagatctaacaaaaaaagtatattgaaggaagtttagtttatatccca

SEQ ID NO: 528430 - DNA, 431 bp, Homo sapiens
tcccaaactgtcgacaggttgacgggaggctgaggctgggcctgggaggggccaccaaagatgcagtgatctgtggcctggagtaggttgctagagaagcattagctgtgcctggttgaggtcaacttgagaaagttcaggtcctgtagaaaaggctgggaggtaggacctgggtctaaagaggccattgtagtgatggagctgttcctgtgtaggctgtggtgaggcagtagcctcatctgcggaggctgccttgacgtagtggtatgggccttgataggccattgacagtcatgagcttggtctgtagaggctgactggagaaagttctgggcctggagaggctgccgggaggtaggagcataatgtagaatcagtgggcgtgttaagcttgttttcctgcaactggatgttcccacgtttcgctgtca

SEQ ID NO: 528431 - DNA, 443 bp, Homo sapiens
cacgagggtcgccgccgcgctggtccagacgcggatgcagggcacggggggacacagctccgcgccccctgccgacgaggccgtgaaggctctcgacaagcggctcgccgccggcatcgaggaggtgaccgccgagatcggcatcctcagcggcatcgtgcgtgagctggcctcggtggtggccgcccaggacggcgacatcgaccggctgaaggttcagacgcaagcgcaggctcagcttcaggcccaagccgccgccaagccggccgcgccatcgcgtccggcttcacggccgaatccaccggaagcggtaccgccctctcccgccgcgcaggaggccgcgccgatgcggctcgtgccgcgcacgacgcctcccgccccccgcctgtccgatccgttcgagacggtcgcggacgagactccgctgattcgagccttcgacg

SEQ ID NO: 528432 - DNA, 380 bp, Homo sapiens
ctccctgtgtaaactgccaaaaagccttgggatttgtaagctgttcttacccctttccttgtttcattttgataaatgttttctcataacttggtttgtctcttcttgccttcaggccgtcaaactccaaatggtcatgcaaccagagcctcggttgatggcttagtctgctgggaacccttagataggcctgtgagggagatctgactgatgtttcctcaaaacagcaccctctgtcagtaggaagcagttaagatgggtctttgtccttatccttaccctgattctaatggtagatagatgtacttctttacaggggggaatgagacagccatgtataaagggggtccccaggaacctctgactagcctaagcactgg

SEQ ID NO: 528433 - DNA, 356 bp, Homo sapiens
  misc_feature (123)..(123): n is a, c, g, or t
caagacgatccatggtaaacaaggtatgtcatatcctcacagatgggaattctgtatcttggtctgaaagtggagttagttttttggccaaccaatttgggcggttacagaaccaaacactgnctccacagttgctgcaagcatcatctcacttcttcattgtagctcttattctgtgttcacatttcccgtgggtgtatctgctcaggtggaagttaagctcatgtgtctgccctgtcgaggcaagggattctggggcatgtgacatttcctgtattctcacttgggaaatgtcgaagtcataatgtgagcagttatcccagacgtacgatgactgtggcacatatatcagtcgc

SEQ ID NO: 528434 - DNA, 288 bp, Homo sapiens
  misc_feature (7)..(7): n is a, c, g, or t
  misc_feature (173)..(173): n is a, c, g, or t
  misc_feature (175)..(175): n is a, c, g, or t
ccccccnacaactctaaatgtaaaaacctgcacttttcctgggggtgggcagtggggtcgggggttggggggggccggggcgatagcttcaccctggactaagtgtttggggcaacctgctcggctgtatgttttttgcacgctcacccggttaagggggggtttgtccctgntnccgcctccagtcctaagggaggggcttgcccccccttttacattccaatttttaaatctttgaaatatggggttagaaattaatttaatgataaaacccctttgaaaggtcca

SEQ ID NO: 528435 - DNA, 237 bp, Homo sapiens
  misc_feature (14)..(14): n is a, c, g, or t
  misc_feature (109)..(109): n is a, c, g, or t
tttatatatatatngttttattttgcagtctcgctctgtcacccaggctggagtgaaatggtgtggtctcggctcactgcaacctccgacccccgggctcgagcaattntcccacctcagcctcccaaatagccgggaccacaggagaatgccaccatgcccggctaatttttgcaccctcagcagagacggggtcccaccacgatggccaggtccgtcccgaacttcttgacctag

SEQ ID NO: 528436 - DNA, 312 bp, Homo sapiens
cccaccccccccccccccccctggtttccccccctggcccggggggtcaagtgggtttttctggggcctggcccgcttttaggattttttttcatcccccctctgggcccccgccttttagggaaggaggggtgggggctagtgggagaccccacccaaaacttagggttagggccgggtggggggaggctgggggcctttttgggatggtttgggtttggttttttttaaccggggcatattggggtccggtccagctgggaagaaaaaaatatatccatggtttcccattaaaaaccggggctccctgga

SEQ ID NO: 528437 - DNA, 134 bp, Homo sapiens
gtgctgtgcctgtcctgctgcccagggctcagaaggaaagcggttcggctccctgcccccagccacttcccgcactgtgcccgcatctgatgcccatgctcacgcggtggctaattctggcgtctcatcagacg

SEQ ID NO: 528438 - DNA, 434 bp, Homo sapiens
acatacgggtctcctgagcctcatgctcaaaatcgcagttcatgcataacactatgtacatgctcactgaatattattctgaaaaataacatcgtatttggtcagcccaatttcatacctcctatctttgtccataccccaaataagaaggttagaagagaaggccaaagtcatctgccattctttcaaatctttgcccaactccctgctgcctgccataaaactcaaaatttattcaataatgcattcaaaatgcttctgaaattagagtagagcaatcaagtataatttttcctacaaagaaggctcaaatttaaatgtgctcaagaaacaaaagtctagttgtcccaaggctttttagctcccttcatatcagtaatgccagtaggacaaatcctaataatctaaaatagaattatgtagtgcttacacac

SEQ ID NO: 528439 - DNA, 145 bp, Homo sapiens
cataccccatcaacgacaatatactatcatcaacgctattatacttctcaacgctttatgcttctcaacgctttatactatctcaacgactttatacttctcatacgctttatactatctcaccgactttatactatctcaaccg

SEQ ID NO: 528440 - DNA, 1075 bp, Homo sapiens
aacctattgtttttgtttttgtgttcttgtttttttgatttttgtttattgtttctttttttgtgtattgttgcttgtttgtggacaaaaaaaaaaaaaaaacaagaaagagaaagaaaagaccgggtgagaaagcacatgaccaccattgtttattttttggtgggctttatttctcttctcacgttttttcccgttttgttgtgagcaccccctttttttgcttgggggcccccccccgtgtggtatacagattagcccggcggtttctagtcgcgcgttttcgttgtatgcgcagcacgcggcgtgtggagttcttatacggggggccgcaacccctcttcgcccccgggtttctggggatgattatcccccgcgctcaatttcgcggggcagataagctccgggtctcattactcacatgggggggactccccctccgcgtcctcgtcatgtgcgggagactgttctttccggggtgcctcatgttcctgggggaaccccccccaccattgttcccaggtgcgggttcttcgccagggtcgccgcccactgtttagatgttgcgcccccaagcccgttgattgagcatcattgtgctctcgcccccccaagtgtttttttcgcaacaacggtccccctcttataaaaccgggcgtgctaagagcatctccaccccccgacactgatgtatcttccgccccctccctaatttgcctacaggtatttggttgttgttctggtgtggggagaaaatttttgtgtgaacttcccctcctctctgcggccccaccttcgctaatccccccgccgctagatatttcaggagtcctttgtgacattgccccacttgcaccgacgaagcaaatcttgtgggtgggaaaacatttcttctgggaggacccttgtacgttcgttcaacgccttcgggaatatcgagtgattatgagtccagaagcgacgtaattcttgttctcagtttccccgcaacacgggtatatctctttcacccggtttctgttatttctggtttctccacccttgtgcgaacctcccccaacaatagaacaagaaa

SEQ ID NO: 528441 - DNA, 281 bp, Homo sapiens
taaaaatagaaacttgattttccaaaaggtcctcctgtagataacaagacatgcatctgctctccaggcccgggactggcagcggggacctcaggcaggcaggctagggcgagggcctctgaggcaagatcagaggttgggctgagacagtcagctgcacaaaactggccatgtcacgagcaccacagcgaaacttcatccatgctctggcaggacaggaaagcagccggccccttgggagtatacgaatatttgccatatactctttgcttgttccgctg

SEQ ID NO: 528442 - DNA, 165 bp, Homo sapiens
  misc_feature (102)..(102): n is a, c, g, or t
gacaggtggaaatcaaccgcccgcggggttgcggggcacaaagaggcagctggcggctccgctgacccattaccgcctccctggacgaagtttgggctcggnagccgggtgatgcatcctatagaaggcgcagaacagcacgtgttctccccggtgcccggggct

SEQ ID NO: 528443 - DNA, 280 bp, Homo sapiens
cacgggggagcaaaattgggtcatcatctctgcccgctctgcttgatgcccccatgttcgtcatgggtgtgaccagtgagacagtatgacaaccagcctcaatgatcactcagcaactgcctcctgaaaccacccaaccttgcttagacacccctgtgccaacggtcactccactgaccaaccttgtggtactcagtggacacgtgacctcactgacccaccagtcccactgccaatcaccttgccaccccccgacacgaccttggtggactaggacccc

SEQ ID NO: 528444 - DNA, 305 bp, Homo sapiens
gatacgtgtggacatcagtggtgaggggtccacagtaaaagtatttctctaagctagcgtaccatgcacatgtgaataattctatcccgggtgggtttaccggaccgggatcgagaacaggtatcgagataaagctacttgtatgggctgcagcgcaccaaagaaaattccatcattgtgctacagtcaaaaagatgagggactgtgctctgccaatgtgactcggtattattgaatccaagatacagaacgtgtgatgttttcacctatactggccgtcggttgacagacaataactttgttag

SEQ ID NO: 528445 - DNA, 704 bp, Homo sapiens
tgggcatggtggctcatgcctgtaatcccagcactttgggaggctgaggcgggaggatcacttgagcctagaagttggagactaacctggcgagaccctgtctcaaaaaaaaaaaaaaaattcaattttagcttacgcaggaatttggacattttaacggagcggaattcttcttcttaccttcttacaaaactcaacactttaacactttttgttcaccttctcagaaatttatttatagaagtggtggattttcacttgggtctagttttttctcctttatattagtgtggataatttatattgtggttactctcttcttattttactgtggacttaccagaagaattattacaaaagattactgtggtgcaaacaagaattgtggttacggtggtctcaaaagaaagcttatacaaaactatacaatttataaaagaaaattagcacaagtcttgtgagaaaaatatagaacagacatatagttacaacattattgtgtggttatatgtggcttaaagaaaacctgtggtttttataattattctacaggccttttggaggtgtttaaattggggaatagacataataggggtggtctttatagttctcaaggcattgtgttaagggaaaatatccttcttttatattctctctatacaattattagaattacatgtgttcagtggcaatattattgactg

SEQ ID NO: 528446 - DNA, 185 bp, Homo sapiens
gttgaaggttagatctagagcatcccctttataacccaccaccaataacttactactcatgccaggtctctcccattactcaatctatcctataattagacaccaagttattaggttacaacttccctcatgatgtaatcatggaagatagaaacttacttgtacatgtactcgatttgatggat

SEQ ID NO: 528447 - DNA, 120 bp, Homo sapiens
  misc_feature (120)..(120): n is a, c, g, or t
gggaagatgagcacggagggtggtggccgtcgctgccaggcacaagtgtgccgccgcatgtccttcaggcgcggagcaaccggttttgacaaggcactcagtaatgctgaattgaaaagn

SEQ ID NO: 528448 - DNA, 162 bp, Homo sapiens
attttgaaaagaaacctacaaaaattgtatttccatatttcatagtcagccaaaaatattggtcaactcatgctctctgcaaggttctgcaaaaattgcggagtggtatagacaaggcaccattgcaatatataatactttttgggtattggcccaaaaatt

SEQ ID NO: 528449 - DNA, 168 bp, Homo sapiens
atgttgcacgtggcatttcatcaggcgtcagtcagcaagtcagcaggttcaaggcagggtgcatgtgtggctcatgcatggtggggcatgcatgcaggctcattgtttttttgtgcaattcttcgcatcaatggccccatttgggcccaaaagccggttcagcggggt

SEQ ID NO: 528450 - DNA, 364 bp, Homo sapiens
gtgcgagccaaacgatcagctaatttttggtattttgatacagacggggtttcaccatgttgcccaaactgatcttgaactcctgagctcaggagatccatccacctcagcctcccaatgtactaggattccaggtgtgagccaccgcactgggcctaggatcactttattggcagtgataatctgattttttttttttctttttttttttttttttttttttttttttttttttttttttttttttttttttttttttttttttttttttttttttttttttttttttttttttttttttttttcctttttctattcccgggggggaaaaaaaatattgttgagggggggggggggacgacaa

SEQ ID NO: 528451 - DNA, 140 bp, Homo sapiens
tcgcgctagaggtcccagttctggtcgcccatgagtggacccctccccccaacttttcatgtttcttaaaggcatttgggttttttaaaatctgtacagcaagagcaacttttgctgtcaaataaaaatgagaaatgcag

SEQ ID NO: 528452 - DNA, 108 bp, Homo sapiens
cgcgcgacatggactacagatatagctgcagccctgagcgcttcatcacttataccacgggcagaataagtctccatgtaggttgtattatgtgtgctccacattttt

SEQ ID NO: 528453 - DNA, 323 bp, Homo sapiens
  misc_feature (3)..(3): n is a, c, g, or t
ggnggggttttcccttcacccccccccaaaatcttttccctttttttcccgggggggtctttttaaaaaaaaaccccccccggaaggttgggggctttggggctgtggctaattttaccccctttttttttttttttttcccccccttattcccccccccgggccccggaaaccccctttttccttaggccgttttttgggttttctttaaagcccccctttttttttcccccctttttttcctgctttccccaaaatttttttttccctcccccttgggccccctttttttttttccccttaaagcttttgggggggtttta

SEQ ID NO: 528454 - DNA, 1056 bp, Homo sapiens
gcgctacccgcttctccccctgcttgttttctgcggactggcggtgcggggggtggtaggggggcctgtcgcgtgcggtgggggcgcgcgggtgggacaggggcgtggggcgccttggggaggtcgcccgcccgtagtcctgtctttcggtgctcccccagtggttttggcgctgccttgtggggtggggtggacacgggtatctattgtggtggcctttgtggtcttaccacagggcctggggggggactccttgggcgcgctcggctcttgggggtaccaccgccttggttgacggggaatgtccaggccaaacgtacccctggtggaaggggtaaccaggatgtatcagccccgggacaaggggaaggaagggatgggggcgcccaaggcaccctggatgagttcggcctacctgtttgcggggtttctttgtaacctgggtgttcccctcagaggagttccctcaaacacacccctgggccccacgagaccacgagggcctcgccgaaggggaaggaggcctcggccttctgtgccagaccgcgtgcagcacgtggtgaaagttctgttgggtgttttagagcttttcttcacagaggtgggaaatgagctcctctttgccttcctgggccctccgggggccttttcgaggtcagccttccccaagccctctacctcacggtcctcgttctgccctcgaggaaccctccccccgggtgatgttctgccaaagtctgtgctgtccgtgccccacggctgggaagaggctaatctggggaagggggaaaagaaggccgaggcacgaatacaccccccgaagttatgggtttgcgaactccgccctccctgggagcctggagttgggtcagatgcctgtccttggaggggaacaaggttgactgcttaggaaggcgccgatcgcacacacagggctgccacggcctggcccctctttgggaaaggttgagagtctgagacgggcagccctgtcccttcctccagatccgctctggttttttacaccggtttgtttaataaagcctgtaaccgcca

SEQ ID NO: 528455 - DNA, 928 bp, Homo sapiens
gggagcgattcggtggcacgtggagccacgggtgagagtagggggctgaaggcaggcagcagcggccaggccgcctctgtagaccgttgggtctcgggataccccgtttcttcctgtaggtgtgggacgtgcggtgcgggcggagatggacactcccccgcctctccggaattgcggagtcgggaaaccccgatgatctccctgtgtcaccagaccagacgcaggttcgcaggatgcgtttcccccgagggctttcttgaaagcccaagggcccttcaaatgttccgttgctaccaggggtgcccgaaagaaaggccggtgacaccgagcggttgaaatggccttgaagccagtgtttgtggcaggcacttcaacggcggagaatcttggacattgggttggaaacccggctcgatttgtgaccaccttggggtcccgggtaccggggaccactcggggtgggacttcttgaggcgcgcccaagggcacctttcaggacacaacgggaccccagcacacaggctggttcggatccaagaaatgaccgactccccaaggctgaggcagattgagttctcatattcagacaaaagccccaaagggccgcaagttgcttgacaggttcttacaccccgggcctcacatccagcttccaaaagtcccatacggaagcgaacccactgtgactaattctcggcgcgaacagtgcgccaaattctgactcttgcagatggcagaatgtatttcgacaagacgctggaaactaaacggggcttgacagtggcagaggtctgaacaacgctacagcccacttgcgagcacttcgcgcacatcgggaacggaacggtggcacacggcggtcctcagacgacgcgaagagaacgcctatgatgatggataagaatatcgaaggttcttgaaaaggctt

SEQ ID NO: 528456 - DNA, 245 bp, Homo sapiens
tacaaaagcggaccctaatggtgcaaccgctattacaggttcgattgttcaacgattaaagtcctacgtgatctgagttcagaccggagcaatccaggtcggtttctatctattataaatacctcccagctcgaaaggacaagagacatgagaccaacctcacaaacgcgactcagagataattaatgattcaatcttaacctaattaactcataatagatccagccctagaacagggcacatta

SEQ ID NO: 528457 - DNA, 144 bp, Homo sapiens
aaggctgatgctggagtggccagtagaggtggtggagcagagcagccatcttattaagatggggctagtatcaggctagggtttatttaaacagcacacaacatgtttatggttaagaaacattattttgcttatcagatgtaa

SEQ ID NO: 528458 - DNA, 121 bp, Homo sapiens
ctcacgtaacccgcgtaactcaccctaacccgcggaaggcggaggtggagcccgagagggaaccagcggggaaactgaggctcggggtggagcgcaggattgtggtacgcgcccagactgc

SEQ ID NO: 528459 - DNA, 911 bp, Homo sapiens
gagatttgaatcgcgggacccgtgggcagacggtggcaggcggcgtgcatggtgtgccccgacagtcgccccactgacatggcagcccatttctcaagtgaccacgcggcatctctacagttcaacgaagctggcccttcttcggagggcttgtgcactgaatcccggagacggattggccgaggactggctgtcatccacttgccccacatgagaacgagccagacttgtgaccatgatgtatctgtctgcgttcaaggcgcgtggaaggctgggagccagatgacgaccccatagaggaacataaaaaagcattcgtccggatctgcgctttcactttctgtcaagaagcagtatgaagaattaacccttggtgcaatcgtttgaaactggacagagaaagagccaagaacaaaattgcaaaggaaaccaacaaataaggaagaaagaatttgcaggacactgcgaacgaaagtgcgccgtgccatcggagcagcttggctggccatggattgcagggctctgggccggagcctgcctgggtcccagcagtggctgcaaccagttcacaggggtttattccctggtgccaccagaaattccctggtgggcccccttagcaatgtccttaggcaaaggagatccagcattttcaaatctaggatgtatcaaatgtgctcttggtggtggtatctgcaaagttggacaacagcaggttgcttcctgcctgttgcagagggcaatgactagatgcgtaaacaagcaggactgactactcactcgtcacaccactcaacaaagcgaggcacccagaagggacacaacagaaataccagggacctacccacggtggcaaacggaaggcgacgcaagaaaggagagggaccgagaggcaacacgcgaaagaatgg

SEQ ID NO: 528460 - DNA, 215 bp, Homo sapiens
ttcacgagtacgtcacttttggttacatatactgtagtctattaagtatgcaatagcatttcataaaaaaaagcacataccctaacttagaaatactttatcgctaaaaaaatgctcataacaatctaagccttcagggagtcttttttttttttttttaaaaaaaatgggggtctggctctgccacccaggtgggttttgcgggggcttgatca

SEQ ID NO: 528461 - DNA, 205 bp, Homo sapiens
gcgccccgatcagtaagatctaccctggcccttttcttcccgaggaggctgaggggtctcactggtactgccacctatctccatttccaggtgttttctgtttcgtacttttccgttttcacttcatcatttttctgttgcagaccacatctcttctttcctggggcagcccctctcatcttcccctctgcatactgatcggggt

SEQ ID NO: 528462 - DNA, 118 bp, Homo sapiens
  misc_feature (7)..(7): n is a, c, g, or t
  misc_feature (28)..(28): n is a, c, g, or t
  misc_feature (34)..(34): n is a, c, g, or t
  misc_feature (70)..(70): n is a, c, g, or t
  misc_feature (96)..(96): n is a, c, g, or t
aaatgtnattttttttctggggattatnaaattnatgtccctttgaccagtcgtagctggaagcgtatgnaaatatgtttccattgtgattgaaanagcaagctgagatgggctgatc

SEQ ID NO: 528463 - DNA, 426 bp, Homo sapiens
aatcccgaacttgatggaaacctgcttctcctactccggttattgtggactcccacacagccaacaacagaagaaaagagtttactcgaactagcaagtagatttggataatttcggaacttagaagatattgacacaacagatatcaatctggatgaagatatataggatgatcgactgtaatgctctccatctacctgactaaacagatcatcattatctataggtattgattgctaccctgaccacagcgcttaggactatgagaaacttcttagatttccatatgtaaatgctgtggaccactgggagcacaatgcccacatcatcttaagaagagtatatgtgcagcatttaaatcactgtgtataccttgtaagctaaaacagacatgggctttgatttttttcatactattagaccata

SEQ ID NO: 528464 - DNA, 394 bp, Homo sapiens
  misc_feature (169)..(169): n is a, c, g, or t
  misc_feature (234)..(234): n is a, c, g, or t
tgtgtctgtcatcaagactattctgtgtgaacttagttagaaggtgatgaaagtggtgccatgtgtcaggatgctctagggctcacttctgtgactgtgcacatggattccatgaggaccactgtgagctcaactttgatgatgtggctgaccggacacattgcaggcntgccttcctccttcaactactgggagcctcaggctatgcttgtatctgtcaggctagattaaaanacaggaaccaggctagaaagatggctctctctataagtactcttactcaggtaagagcactgactgctctcccaaaggtcctgagttcaaatcccagcaaccacatgatggcttcacaaccatccctaatgaaatctggtcaaaaacgcccgcgaattta

SEQ ID NO: 528465 - DNA, 159 bp, Homo sapiens
agatggcgggtgaaaaagttgagaagcagatacttaagagaagagacccgaagccaagaagggttgatgcttggtggcaaggtgaaaaagggtaacctcaaagcttaaaagcccagagggggagccccattgcagcggcaccctgttcctgttcagagg

SEQ ID NO: 528466 - DNA, 294 bp, Homo sapiens
  misc_feature (160)..(160): n is a, c, g, or t
  misc_feature (227)..(227): n is a, c, g, or t
gtcgacgtgagagttacagctcttaaagatggcaccgacccaggccgggcgcagtggctcaggctgcagtcccagcactttgggaggcggaggaggtgaatcacgaggtcaggaaatcgagaccatcctggctaacatggtgaaaccccgtctccactanagatacaaaaattggccagcatggtggctggcactgtagtccagctacttgggaggctgagcagganagtggatgaacccgcgagcagagcttcagtgggcgagatcgtgcaatgcatccacctgggaacagag

SEQ ID NO: 528467 - DNA, 154 bp, Homo sapiens
atgggaatgacgttagactccattgtgatggaccccaagaaggacgtcctcatcgagttctacgcgccatggtgcgggcactgcaaagcagctagatgcccgtgtacaacagccctggccaagcaagtacaacgggccaacaaggggccctggt

SEQ ID NO: 528468 - DNA, 264 bp, Homo sapiens
gtccgacggattgcggacgtgaagatggttgatccccggggaataacccacttgcgcttgcgcatttgccgcgtcgtagacgccaccgaggcgaacataggatgcggacaggcgtattgtgctgtttggtgtatcgggcgcggcggcactgacgccgctggacaggtgcaggctgcgcgacaggctgagatcaatattgccgtcaaagatgagaagatcgcgcgtgtagagcgaaagcgatccaaagccgcccttctggctctg

SEQ ID NO: 528469 - DNA, 149 bp, Homo sapiens
ccccttttttttttcccaaacctttggaattcccatgtttttttttctcccccgaggattattttggaaaggttttttatcccctcccccctttttccattttttctttaaatttcctcccaaaaattttccctttttttcccctttta

SEQ ID NO: 528470 - DNA, 154 bp, Homo sapiens
cccatcctccccaaaatagccttgtgatttcggaagtatggactaaaatcacactcctccttaccttaccgcttggactctggtggctcccaactcgccgtcagaccccacctgccccggtggtggaaagcgcctggacagaccatgaccacag

SEQ ID NO: 528471 - DNA, 118 bp, Homo sapiens
tagaagctttcgtcagttgcgccggatgcaaggaactggaactggtgcatcgcctgaccgtgacacctccggcctgttgatgatcgccaagaagcgcagatgttgcgccacttgcaca

SEQ ID NO: 528472 - DNA, 299 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttcaggcccagctcctgtcttgtgttggcctatacaggcctggcatcatcctttcaacagcctctataggcccggcctctag

SEQ ID NO: 528473 - DNA, 415 bp, Homo sapiens
  misc_feature (349)..(349): n is a, c, g, or t
  misc_feature (351)..(351): n is a, c, g, or t
  misc_feature (353)..(354): n is a, c, g, or t
  misc_feature (365)..(366): n is a, c, g, or t
  misc_feature (370)..(370): n is a, c, g, or t
tcactgcagccctgaactcttgggctaaggatcctcctacctgagcctcctgagtagctaggactcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaagacgcccactgattctacattatggctcctacctcccggcagcctctccaggcccanancnntctccagtcannctcnacagaccatgctcatgaggcggatatgctcatacgcgatgcatat

SEQ ID NO: 528474 - DNA, 207 bp, Homo sapiens
tatccgtcgccctggccaccaccgcccgggccgagaaccaggactcacgcctgcaggtgtacaacgtcccggcccacgaactgcgggcccgggtcctggacgtcgagcagatcgcccactcctacctgcgcggccaccaccccaccgggctggacgggcggcaccgacagcccgtcgatgacacccgcatcgacaccgccatcgcca

SEQ ID NO: 528475 - DNA, 1477 bp, Homo sapiens
  misc_feature (104)..(104): n is a, c, g, or t
  misc_feature (107)..(107): n is a, c, g, or t
  misc_feature (139)..(139): n is a, c, g, or t
  misc_feature (423)..(423): n is a, c, g, or t
  misc_feature (459)..(459): n is a, c, g, or t
ccaaggtaactatttaggaacgtgcacgtgtaggccaggatgattacttgagagtatagagcggacgacttgacgacagataagcgttatgaattggttacaangantatcgcgtcatgttactgagactcttgcactntaggtgagatcccctaaaagacccatgtggtacgcaagcccctgatcagcgtaggtctcatgtacgataccctgtgacaccgtgaggataccctcgttcatgagctacgggcgtgcttactgcgatagcaatcactgtccgcgactagcatcattgcgtccatcctcgcgcatggaccatcatcacactcactcagtgttacacactccctctcacatttggttgcactatcgcccattgagtcgcatggctacttaactctttattaacacaaagctgtcccnagtcattgctcttcatggacacagagcgaagaccgntagggagagatcgtggcttcaggttgttgtagcatcctctcaaattacaccggcagacattactgggacctctcagttaggatagcacacggcacactattcctcaggtcgcagagaaccccccattgatagtgcatttctccttgcgtagcaaagtcgaatgtctccagtggaagtgcggtccccaggggggttgttacaattccattcagtttaatgtaatgttctggaccctgagacaaacaacgtcccaagattgtacctgagacggcccaccttcgaacaagttcccggcacttccattatacttcccatactactccgaaaggggaaccttccagagaacgtaacgttagcttctcgccgagttgaaattgaggggcttggcttggggacgtggaaccttttccctaaggcaaaacgtcgccttccgcgttagatcacctttcggctactttatagcgcacacacgaaagtaatttaagacccttagcgttgggtgcagggaaaactcctatccttgggggcttatggttaaaccctaacgttatagttcccgtggagatctgaccttattccacggttcctttccctttatactgtggagccagtgtgtaccctctcgagaggcggagtaaacttaaaaattgcgacggcgagttggccgtgagattaagcgtgccgcccggttcatcagggagttgaattttaaggcccaacgagagcaagcaagatgggggcgcgttcaaacaatctattcccgagtctagaatgtgttaatacccaccagttttgagaaaccctttgtcagatgtccacacgcggcatgaaaagagaaccccgtccatgtgtgtgcacatagaaccctaaaattcccccgcgatttttttacatcggtagttgcggtctgaaaagcctcgaaggatttatctaccggggggcggtgtcccccctcttttcaaaacaaagacaaccacgccaatattatggaagccaagagagaggcgtcaccccacat

SEQ ID NO: 528476 - DNA, 112 bp, Homo sapiens
agtgactctggcttctatctctgtgcctggagtgtgctccgggacactcttagtcgggtcggtggctacaccttcctaactatggctacaccttcggttcggggaccaggtt

SEQ ID NO: 528477 - DNA, 550 bp, Homo sapiens
  misc_feature (12)..(12): n is a, c, g, or t
  misc_feature (14)..(14): n is a, c, g, or t
  misc_feature (406)..(406): n is a, c, g, or t
tctagaggatcntncaccacagcctctggggaaagaaggggtgcatgaactccccttagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtngcgtgcacctgtaatcctagctacccggaaggctgaggcaggagaatggcgtgaacccggtgggaagagtttgcagtgagccaagatcgcaccactgcactccagcctgggcgacagagcaagactcggtctcaaaaaaaaaaa

SEQ ID NO: 528478 - DNA, 170 bp, Homo sapiens
ctgcgaaaaaaaaaaaaaaaaaacggcaaagcagattttctggaggttttctttgggggggggcaagccaaaagggggggaacccaacccagctggctcaagaatggccgtttggagaaaacgggaggcctctgggggcccttgcctgcccaaatggccctggggggcct

SEQ ID NO: 528479 - DNA, 2427 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1813)..(1814): n is a, c, g, or t
  misc_feature (1831)..(1831): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528480 - DNA, 3119 bp, Homo sapiens
  misc_feature (15)..(16): n is a, c, g, or t
  misc_feature (22)..(22): n is a, c, g, or t
  misc_feature (34)..(34): n is a, c, g, or t
  misc_feature (71)..(71): n is a, c, g, or t
  misc_feature (1813)..(1814): n is a, c, g, or t
  misc_feature (1831)..(1831): n is a, c, g, or t
  misc_feature (2975)..(2975): n is a, c, g, or t
taccccggagctctnnaggccnagaacttttcantcagcctctacagaccaagctcatgactcacaatggnctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgcccatgatcaacgtgttctcttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtngcgtgcacctgtaatcctagctacccggaaggctgaggcaggagaatggcgtgaacccggtgggaagagtttgcagtgagccaagatcgcaccactgcactccagcctgggcgacagagcaagactcggtctcaaaaaaaaaaa

SEQ ID NO: 528481 - DNA, 666 bp, Homo sapiens
ttttttttttgctggaaatgagtgtctttatggctggtacggtacaaatatgaagacgaggagaaaggccagtagggacggaaaactgtcagataacaacattcgcccacggaggaaaaagacccttaaccacacgcggaacaaaccgctacaccgtatccgcagccgtgcgcagtgtaacgtggggtagccacatggacgagggtgatcaggggagagcaacgcccatcaaagagctaaacgtccaaaacacccagaagcgtgtggcttacgagggatagaggagaagggtcggacaaaaccccagcgcgggtggagaagccctcccttcttccgcggtgaaaatgtcggggaagagaagctctccaacaccctgtgggctcagccgaaattctttcacgagtcgcgtgtggcccgattctctctgttgtgaggggccgtgaacactctgtggtgtctcgaggtcgcgaaacaacggagaaaacaaacgaacagtcttgtgatacccgtgtgtagaaatgactccggcccgtgtgtgtgtgctcgaacgcgggaggaactgtgcagccgactttcgacaccagagggttctgtggggttgtgcaccaagatttatcttaagaaaggggacggaaacattcttcttgcaagtgtgcaagccatgcg

SEQ ID NO: 528482 - DNA, 198 bp, Homo sapiens
gaatcagtcctcgtggtggtggtggtgcatgggtgtccaggttgtcactctgtgtgccggtgggtgttggggttggggtccctgtggtgagtggtggtgatgggtgtcgtggttggggtctgtgtgccggtggatgtaggggtaaggggtcaccgtacatgatggtggtgctgggtgtcgatgttgggttctgtgtgc

SEQ ID NO: 528483 - DNA, 624 bp, Homo sapiens
tacctaaagctttaataaataggtacatcatttctcaaaagtgttcactctaggatcccattctttaggtttgttcttttccagcaatatcatgaaatctcagagtatctggtgtgagttacgggccgctacagttcgatctgggagtcccacgttatgtcagttgctatggtcatgtttcaccatccttctgcacggttcctttactccttatcttactctcgtaataggatatatgtatctgactgtccacttgtaatgaagttcaggttcatgagcagcgtggttgaagcagtagaacagatgttgagcactagtttttagtagtttcatgtcaagtgtgagttgtgatagatagagctcagaatgtaggtagagtcaccacagatatacagcattagtgcgtgtatcactgcttcataaggcatctgtgcagcagaatgagctatcttgtatgcttcttctgagcggtaggggtagtctctagaagtgtcagctatagtctttacgaagttggtcatgcccgcacccacatcgatccacttgttcagggtcgcaggctagccaggagaaaagaccatgcctgttctagtacgggttaagggtgggtaatgcgcatttcat

SEQ ID NO: 528484 - DNA, 2114 bp, Homo sapiens
  misc_feature (179)..(179): n is a, c, g, or t
  misc_feature (184)..(184): n is a, c, g, or t
  misc_feature (232)..(232): n is a, c, g, or t
  misc_feature (274)..(274): n is a, c, g, or t
  misc_feature (280)..(280): n is a, c, g, or t
  misc_feature (289)..(289): n is a, c, g, or t
  misc_feature (335)..(335): n is a, c, g, or t
  misc_feature (354)..(354): n is a, c, g, or t
aaaaaaaaaaaaattttttttttaaatgggctgggcatggtggcttgtgcctgtagtctcagccacttgggaggcttaagtagtaggatcgcttgagcctgggaggttgaggctgccgtgagctgtgattgtgccactgtgcttcagcttgagtgacagagtgagaccctcttgactcnaaacnaaaaacatggtttctcctctctctcctgtcttcttactctctatcccntttgatgtagtgatttttaaatgcttttgtaagttaattctnaacacnaaagagacnttgtaatgaggcacaccactaaagtgagcatgcccaattaaaaccngtgtaatatagataagaanatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatg

SEQ ID NO: 528485 - DNA, 2617 bp, Homo sapiens
  misc_feature (232)..(233): n is a, c, g, or t
  misc_feature (301)..(301): n is a, c, g, or t
  misc_feature (318)..(318): n is a, c, g, or t
  misc_feature (2003)..(2004): n is a, c, g, or t
  misc_feature (2021)..(2021): n is a, c, g, or t
aaaattctgccccgattagaggatccctgtggagatgggtctcattactgtcacccagtggagtacagtggcacaacctctgctcactgcagcctccacctgccaggctcaagcaatgctcctgcctcagcctcccgagtagctgggattacaggaagtgagctcacaatgactcaagctgccacatagtgttgattgtgaaatgccagttgaagctatgtcctgcgagttnngggtgctacagttgaccactgcagcagtaaagatgactctgaagaatggcgtgggatggatcctttcnaatgcacttgagcagcngtctccaaccacagggccacagagctggagctggatctaccatgaaagacttctgaatccaggaagagagactgactgggcaacatgttatctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528486 - DNA, 898 bp, Homo sapiens
  misc_feature (8)..(8): n is a, c, g, or t
  misc_feature (399)..(400): n is a, c, g, or t
  misc_feature (430)..(431): n is a, c, g, or t
  misc_feature (433)..(433): n is a, c, g, or t
  misc_feature (435)..(435): n is a, c, g, or t
  misc_feature (461)..(461): n is a, c, g, or t
  misc_feature (463)..(463): n is a, c, g, or t
  misc_feature (508)..(509): n is a, c, g, or t
  misc_feature (529)..(529): n is a, c, g, or t
  misc_feature (531)..(531): n is a, c, g, or t
  misc_feature (547)..(547): n is a, c, g, or t
  misc_feature (549)..(549): n is a, c, g, or t
  misc_feature (554)..(554): n is a, c, g, or t
  misc_feature (615)..(615): n is a, c, g, or t
  misc_feature (623)..(623): n is a, c, g, or t
  misc_feature (741)..(741): n is a, c, g, or t
  misc_feature (786)..(786): n is a, c, g, or t
  misc_feature (805)..(805): n is a, c, g, or t
  misc_feature (809)..(809): n is a, c, g, or t
  misc_feature (896)..(896): n is a, c, g, or t
tagccaanttcaagtccagcatctaccggatcctgatcgcaacagacgtggcctcccggggcctggacatcctacggtacaggtgtcatcaaccacaacacccccggctccccaagatctacatccaccgagtcggccggacggcccgtgcagggcggcagggtcaggccatcacgctggtgacacagtacgacatccacctggtgcacgccatcgaggagcagagcaagaagaagcgtggaggagttctccgtggaagaggcgcgaggtgctacagatcctcacacaggtcaacgtggtgcgaagagagtgtgagatcaaactggaggcggcccactttgacgaaaagaaggagatcaacaaacggaagcagctgatcctggaggggaaggaccctgnncctggaggccaagcgcaaggctgagctggnncnangatcaacgagaagaaccggcgcttcnanggagaaggtggtggagacgctgaagcgacagaaggctggcagggnntggccacaaggggcgtccancncaggacaccgtcgtgngncccanctcaggcccagtcccctcccagggcctggtcttgagccccacacggccatctgcccagtcncttgactngtccatggagctgagggtcggaggaaccttccttgggggcagcagcccttcccgggggcctacccagtgccccacagcaaaacccgtgggcgctcgtgttgtgcgggccctgctcctntgccccgaaaccactggctggtcccttccctgagccctggccaanattcaggctgcaggggaanaaanaacatgaccgggaggttgtgaccccaacccaaggtccccccccaggggtgccgcatacaggaggtgcttaataaacgggtcttttgnca

SEQ ID NO: 528487 - DNA, 867 bp, Homo sapiens
  misc_feature (328)..(328): n is a, c, g, or t
  misc_feature (466)..(466): n is a, c, g, or t
  misc_feature (773)..(773): n is a, c, g, or t
ggcaagcgtcaccgatgcaccgcttctgctgccccctcacgggtcccagctcgctcgtgagttggatggacgcaaacctggtgttccctgacggtgctggtgccaccatcaaaatggccatggggtggcgatgtgcggacctacctgcgctggtaggtaagagaactaccgcacgtcttggctgagagggcaagggtggatcagcgcgagtgggggaagtcacggcagattccgatgtgcgcatgagaggcagctcgtgtaacatccacgtgtctcttctgcctgcgggcagtgccgagttctctcgtgctggtttcaggggaggaantgtaacgctgtgcaggtgtacgcacgtgcagtgacagcctggtgacggcggtgagtcactggcaggcaccaatgagcgcgtggtacccggccaacgcaacaccctggtctcgtggtgctgccgcgctgcgcagaacantgtagacccggggcgcagtgtaggccctccacagagaagttgtccgaagacgtgaagaatcatgctggtccgtgggccacgccctagcgacgaagtgggacataatcgagaggactctatctggtgcgcgtccgtggagtcgactgatctcaactgccgatggctgttagtcaggccgtgactcgcaattccgtggtgcgcttcgagctgtttctcacccttgtgcccaacccataatggtgcgcactcagacctcagccccggggtagatcagtttgacctgaggtcgcgagattgcgcgtcctgncggtgccaacacgggcaccgagtgcttctgaggagggggactaatggactataagtgggctcttggcacccgttgccttgcatggagaatccta

SEQ ID NO: 528488 - DNA, 319 bp, Homo sapiens
ccctattggtttgtaaaatggggcctggggggttttgttttatcccttaaattttgttcccaagggttttttgggggtggggattctggttttattagctttgtgtgtgtcctcttcccccaaacccccttttggtggggacatccccttggcagttgccgcctcttggccccgggtaacaataagggggctcctctcattttttcttttggacgttggccctacaatcaaatgtaagttttatttatttgtactggtggaaatttttaatctgcttttacaaaaataaattttcatggttggagcttttgcccctgga

SEQ ID NO: 528489 - DNA, 2681 bp, Homo sapiens
  misc_feature (179)..(179): n is a, c, g, or t
  misc_feature (184)..(184): n is a, c, g, or t
  misc_feature (232)..(232): n is a, c, g, or t
  misc_feature (274)..(274): n is a, c, g, or t
  misc_feature (280)..(280): n is a, c, g, or t
  misc_feature (289)..(289): n is a, c, g, or t
  misc_feature (335)..(335): n is a, c, g, or t
  misc_feature (354)..(354): n is a, c, g, or t
aaaaaaaaaaaaattttttttttaaatgggctgggcatggtggcttgtgcctgtagtctcagccacttgggaggcttaagtagtaggatcgcttgagcctgggaggttgaggctgccgtgagctgtgattgtgccactgtgcttcagcttgagtgacagagtgagaccctcttgactcnaaacnaaaaacatggtttctcctctctctcctgtcttcttactctctatcccntttgatgtagtgatttttaaatgcttttgtaagttaattctnaacacnaaagagacnttgtaatgaggcacaccactaaagtgagcatgcccaattaaaaccngtgtaatatagataagaanatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacaaaaaaaaaaaaaaaaaaaaaaaaaaaaaaaaaaaaaaaaaaaaaaaaaaaaaaaaaaaaaaaaaaaaaaaaaaagagggggggggccggacaaaaataataatcccccgggggagggacacaaaattacgcgcgacccacgtttttttgtagagacaaagagcgaccaacaaacagagaggggataattaataacaacagacaagcgaggcaggcggccgaaaaaacaacaaggctagatcagaagaaacaactgaagctaatgtggcactttgggagagaacgacccccacatgcgtcgggacacagtcatagcgcgacaccacaccaaaccaagaaataaccggcagggggagataacaaaaaagagagggggggatgaggtggtggcaccccaccgcaccacgtgggggggggcagaaaaaagttgcctcgcgggtcatctctttcatcaactacgaccggctgctcacacaaacaccacagagatgacaagatcagccaaacaaggagcaaccgaaaaacacaagcgatgacagagcacgaggaaaagaaacgagactcacacacaggagacaagcaaccgacagacacagccaacaaaagaaccaccaacagcgactaagcagcacaacgcaacgacaaacagcaagagaatcgacacaaagcaacaca

SEQ ID NO: 528490 - DNA, 2314 bp, Homo sapiens
  misc_feature (1700)..(1701): n is a, c, g, or t
  misc_feature (1718)..(1718): n is a, c, g, or t
tcaacaattttgagaaccactgggctaagaccaaaatgacaacaacctgtaagacttttaagaaagatgtagaagcaggagacctgagcaatccatgcctggcttgctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528491 - DNA, 133 bp, Homo sapiens
acttagggtatagagaatagagtacatcatactctacagtacacgcctagtagggaatgttgtcccattagagtgcattccctccacgtactccttcccctttgctttctaacatgtatgatgcatatactct

SEQ ID NO: 528492 - DNA, 2619 bp, Homo sapiens
  misc_feature (179)..(179): n is a, c, g, or t
  misc_feature (184)..(184): n is a, c, g, or t
  misc_feature (232)..(232): n is a, c, g, or t
  misc_feature (274)..(274): n is a, c, g, or t
  misc_feature (280)..(280): n is a, c, g, or t
  misc_feature (289)..(289): n is a, c, g, or t
  misc_feature (335)..(335): n is a, c, g, or t
  misc_feature (354)..(354): n is a, c, g, or t
aaaaaaaaaaaaattttttttttaaatgggctgggcatggtggcttgtgcctgtagtctcagccacttgggaggcttaagtagtaggatcgcttgagcctgggaggttgaggctgccgtgagctgtgattgtgccactgtgcttcagcttgagtgacagagtgagaccctcttgactcnaaacnaaaaacatggtttctcctctctctcctgtcttcttactctctatcccntttgatgtagtgatttttaaatgcttttgtaagttaattctnaacacnaaagagacnttgtaatgaggcacaccactaaagtgagcatgcccaattaaaaccngtgtaatatagataagaanatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacaaaaaagagacgagaatacaagataactaaacctaaacagacggacaaaataagcatcagacctgaatagaaacaaataccctgtggaaaggccaaggcgggggcccaggaagagggacaaacctgcggcgcagaccgagcgtgtcgccactggatctcagacctcgcctggacggagacgctggacttcgagcagaggtggacgtggagcccatgaggtggaagacttcgaggcacgtgggagccgttctccaagtctgcgattccaaaacgcgggtgcggtgcagggtaaggaccgaactcctccagaagtccgcaacggtgacttgaaccacagtcgtgaggagatggcgggcccccgagagctttcttccctcggaaggaggttctctggaccccgtgaccttgcgtcaaagttcgcgcgagggcgaacaaaaaaggcaacaaaagcacaaccacaacaggccctgcgtcacaaaagggccttggcccttggccatagctgaaggaggcaaccaaatgccgactgaaaaagggagataccgaaaacaagtaacattacagggaacaacatccgatagtaggaagagccaagacaaaaagtacactaccg

SEQ ID NO: 528493 - DNA, 2939 bp, Homo sapiens
  misc_feature (2325)..(2326): n is a, c, g, or t
  misc_feature (2343)..(2343): n is a, c, g, or t
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528494 - DNA, 253 bp, Homo sapiens
  misc_feature (225)..(225): n is a, c, g, or t
cgccctcatgcgtgggcataagagctccagcctgggtacacacaacatgtttgaattttaatccctggccaggcatgctagctcacgccttgtatcccagcacttggggaggccgaggtgggttgatcacgaggtcaggagttcgagaccagcctggccaacacggtgaaaccccatctctactaaaaataaaaaattagccaggcatggtggtgggcgcctatnatcccagctcttattgcccaggctggag

SEQ ID NO: 528495 - DNA, 2118 bp, Homo sapiens
  misc_feature (179)..(179): n is a, c, g, or t
  misc_feature (184)..(184): n is a, c, g, or t
  misc_feature (232)..(232): n is a, c, g, or t
  misc_feature (274)..(274): n is a, c, g, or t
  misc_feature (280)..(280): n is a, c, g, or t
  misc_feature (289)..(289): n is a, c, g, or t
  misc_feature (335)..(335): n is a, c, g, or t
  misc_feature (354)..(354): n is a, c, g, or t
  misc_feature (787)..(787): n is a, c, g, or t
  misc_feature (789)..(789): n is a, c, g, or t
  misc_feature (798)..(798): n is a, c, g, or t
  misc_feature (802)..(802): n is a, c, g, or t
  misc_feature (811)..(811): n is a, c, g, or t
  misc_feature (831)..(831): n is a, c, g, or t
  misc_feature (834)..(835): n is a, c, g, or t
  misc_feature (850)..(852): n is a, c, g, or t
  misc_feature (855)..(856): n is a, c, g, or t
  misc_feature (858)..(858): n is a, c, g, or t
  misc_feature (864)..(864): n is a, c, g, or t
  misc_feature (868)..(868): n is a, c, g, or t
  misc_feature (876)..(876): n is a, c, g, or t
  misc_feature (886)..(886): n is a, c, g, or t
  misc_feature (890)..(890): n is a, c, g, or t
  misc_feature (896)..(896): n is a, c, g, or t
  misc_feature (898)..(898): n is a, c, g, or t
  misc_feature (910)..(910): n is a, c, g, or t
  misc_feature (915)..(915): n is a, c, g, or t
  misc_feature (918)..(919): n is a, c, g, or t
  misc_feature (926)..(926): n is a, c, g, or t
  misc_feature (928)..(928): n is a, c, g, or t
  misc_feature (938)..(938): n is a, c, g, or t
  misc_feature (941)..(941): n is a, c, g, or t
  misc_feature (949)..(950): n is a, c, g, or t
  misc_feature (957)..(957): n is a, c, g, or t
  misc_feature (963)..(963): n is a, c, g, or t
  misc_feature (967)..(967): n is a, c, g, or t
  misc_feature (972)..(972): n is a, c, g, or t
  misc_feature (975)..(975): n is a, c, g, or t
  misc_feature (978)..(979): n is a, c, g, or t
  misc_feature (984)..(984): n is a, c, g, or t
  misc_feature (986)..(986): n is a, c, g, or t
  misc_feature (1003)..(1003): n is a, c, g, or t
  misc_feature (1016)..(1016): n is a, c, g, or t
  misc_feature (1031)..(1032): n is a, c, g, or t
  misc_feature (1038)..(1038): n is a, c, g, or t
  misc_feature (1040)..(1040): n is a, c, g, or t
  misc_feature (1057)..(1058): n is a, c, g, or t
  misc_feature (1074)..(1074): n is a, c, g, or t
  misc_feature (1078)..(1078): n is a, c, g, or t
  misc_feature (1081)..(1081): n is a, c, g, or t
  misc_feature (1091)..(1091): n is a, c, g, or t
  misc_feature (1094)..(1094): n is a, c, g, or t
  misc_feature (1105)..(1105): n is a, c, g, or t
  misc_feature (1110)..(1110): n is a, c, g, or t
  misc_feature (1117)..(1117): n is a, c, g, or t
  misc_feature (1131)..(1131): n is a, c, g, or t
  misc_feature (1157)..(1157): n is a, c, g, or t
  misc_feature (1163)..(1163): n is a, c, g, or t
  misc_feature (1165)..(1165): n is a, c, g, or t
  misc_feature (1186)..(1186): n is a, c, g, or t
  misc_feature (1199)..(1199): n is a, c, g, or t
aaaaaaaaaaaaattttttttttaaatgggctgggcatggtggcttgtgcctgtagtctcagccacttgggaggcttaagtagtaggatcgcttgagcctgggaggttgaggctgccgtgagctgtgattgtgccactgtgcttcagcttgagtgacagagtgagaccctcttgactcnaaacnaaaaacatggtttctcctctctctcctgtcttcttactctctatcccntttgatgtagtgatttttaaatgcttttgtaagttaattctnaacacnaaagagacnttgtaatgaggcacaccactaaagtgagcatgcccaattaaaaccngtgtaatatagataagaanatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagaaaaagaggaaaaananaaaggaggngggnaaaaaaaantgcagaaaaaaaaataaatntgnnaaaataaaaaaaggnnnaannangggggnaaanagagtttnaaaaaaagtnaaangaaatngnaaagaaagcaanaaatnacnnaaaaaanantaaaaaaaantanaaaaaaannaaaaaanaaaaanaagnataanagnaanncaaangnaacaggtgcatggagangtgcaaaaggggntgaaggaaaaaaaannaaaaanangaattcactctaaggtnncaaaggaggtagtaanaganaanaaaatgtttnaanattttaaatanagaanactagtnaagagtaagtacanaggaagggagaaaaaaaggagaaatnagtttnantgtttgatagaaagattaggnaccaaagaaaaanacctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttgtttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatg

SEQ ID NO: 528496 - DNA, 486 bp, Homo sapiens
  misc_feature (448)..(448): n is a, c, g, or t
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccctctcattctccttggctacagcacccaattaaagccttcttccctggtgatactcattgactccatgattggcatgctgngtagtgagcagcaggacatagaccccaatggcaggtcg

SEQ ID NO: 528497 - DNA, 2962 bp, Homo sapiens
  misc_feature (2348)..(2349): n is a, c, g, or t
  misc_feature (2366)..(2366): n is a, c, g, or t
gctggactgtagtggcatgatcatgcctcactgcagccttgacctcccaggctcaaacttccgcattccgaatagctgggactacaagtgtgcaccaccacccccagctaacttttttcttcttttggatggagacagggtctcactgtgttgtccagaccggtctctagctcctggccttaagcaatcctcctgcattagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528498 - DNA, 167 bp, Homo sapiens
agtctcatgagatttgagggttttataagcattgggcatttccccgggtggcactcattccatccggccgggttttcctttgccttttgccataattgtaagtttcctgaggctttcccaacaaaggggaactgtgagtcaattaaacctctttcctttataaatta

SEQ ID NO: 528499 - DNA, 1834 bp, Homo sapiens
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528500 - DNA, 3049 bp, Homo sapiens
  misc_feature (2)..(2): n is a, c, g, or t
  misc_feature (2435)..(2436): n is a, c, g, or t
  misc_feature (2453)..(2453): n is a, c, g, or t
tnacgtcaacccagtcaacaaaaaagtagcagctaacatcaactgaccttttataccaggtgcctattgaggtcatagtttaatttcttataactgtttcttatttcacttaccaactctgtcttcagttactcccagatttttactgtgtttgtacagatgaccttttgtttagattgaattgtctccccagaagtaagattactgtgagacatggtgaatggacattctcattacccttgatgtaaattgacagggttttgggtgtctcccagcctataatcttagcttctcaaattgctggaatttcaggcatgagccaccatgcctggcctgggctagtcctatattctctagagttctctttactttgtgctagccaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcattagattctcataggagaacgcaccctgttgtgaaccgtgcatgtgagggatctaggttgcgctgtccttatgagagtctaatacctattgatctgtcactttctcccatcacgctcaggtgggaccatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttgacctttccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagnngaagctcctgcctttcngcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaatttatttggagtgagtttctgcgccaagcccgaattttttattttattttccttattatttggtgttaaacaggtttaatgacggtcatggcaactttttggcacaatgaaaaatatcgccca

SEQ ID NO: 528501 - DNA, 801 bp, Homo sapiens
agcggggggcgggaagagggaagcgccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgatgctgagcggggagagcctgagcctgacgggcgacgcctgcgcggccgagctggagcccgctctgggacccgcggccgccgccttcaacgtgctcccaaacggcggcgtgcgcgggcgactctgctgcccgggagcccaagccacggcctggggcccccggagccgccggcgccgctcggggccccgcgggttgaggccgggcggcgtcgccgcccggtgcgccgggtgcggggtgggtgaaagccaagaggcgggccggcttggggcattcagcgcattccacggggtcggccgcgagaacccggatgccgatcctcaatctcccaagatcttcccggggctggctgccgacccgagccgggcgctgcggcttggccgaagcccattcctggtgggtgaacgggaccggacttggccagggcaacccaggaccaggccgtgcaggcgcttgaaacgcaccggcaagcgtcctgtgctggaaggtacaagttcatacccaggaagttaacacccctattttcaagaaagacatcataagatattccgaatctgccggtgggaaaggtgccagaccccaagtcaacaagacttaatgtgcagagaagacacatggagtccgacaaaaaaacag

SEQ ID NO: 528502 - DNA, 2091 bp, Homo sapiens
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaaaaaaaaacaaaaaaaacacaacaacaaaaccacgaccacagaaagagggggggcccaaaaaaatccgcgagggcgccagtgtgccccccacgctttgtgaccaccggggccccaggggggcgaataaaggagagacggccgcgtaaaagcgtggcgtgcgaaacggcctcggctcgggagacccctctcggggggcatgggccccccacagttagcggcaaaacagcgtgggtaacccgcctctcgaagtcggcttt

SEQ ID NO: 528503 - DNA, 653 bp, Homo sapiens
  misc_feature (1)..(1): n is a, c, g, or t
  misc_feature (16)..(16): n is a, c, g, or t
  misc_feature (36)..(36): n is a, c, g, or t
  misc_feature (44)..(44): n is a, c, g, or t
  misc_feature (84)..(84): n is a, c, g, or t
  misc_feature (634)..(634): n is a, c, g, or t
ncggtcccccaaatgnatcctatcatagtaaatcanctccacgnaagggctacaatcgaaactgcctctcttcaaaattccagntatccagctcttgatgcggccgatgcgactcgacacttttcagcgctatactaagctcaggcactttgaactgaaaccgccctttattatcctgagcaaataaccttcccaccctcaagacatggggtgccttgatctcctttcgagttccgatactgggcacatacccacgattgggaaacagcgccgttacattaaagttcttatcgatcatcgccgtttttagaaacgcatattgatccgccgcaccatccgtcgcattacctgcggtataccccatatacatcgccacaaacatcgactccggcattgtcgaactgtcggccacggcaatgctctcaacctgctccgccaagtccgtagtcttgaacaacggtgactcactccaggcttcaatgacggtttgcggcatactccaactgtcgtcgtacttcttgtagaccatgttcaagcgcaacatcgggttactgtgtactttgataaccggtgaacccggatctggcggtatgggggtaccacctgggagataccttcttcaacgtcatctgancgggtgtatcccgcatcac

SEQ ID NO: 528504 - DNA, 1467 bp, Homo sapiens
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcataatatggctgtctggtgttgcattagtgaagatactccctacaactacatggtaccccag

SEQ ID NO: 528505 - DNA, 1297 bp, Homo sapiens
  misc_feature (1176)..(1176): n is a, c, g, or t
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagtaatgggaactaatgattctgatgtaacacaaaaatagatgttgactgtggggtgaagtgattgnagagggcttgaaaagtctcaaggggcaggaatggatggctgagcggggtttggggggttatgggccttggtggggtttggccgttaaactttggagtgagcggttggattgggaacggggg

SEQ ID NO: 528506 - DNA, 170 bp, Homo sapiens
agcttacttacttacccagtgtgcccaggcatatagagaatgggagaaaatttatgccatctacttatctgacaaaaggctaatatccagaatctacaaagaacaccaacaaatttacaagaaaaaaaaacaaaccccatcaaaaaatgttaagaaatgggttaagtaag

SEQ ID NO: 528507 - DNA, 1483 bp, Homo sapiens
  misc_feature (68)..(68): n is a, c, g, or t
  misc_feature (81)..(81): n is a, c, g, or t
agcgggagctgcactgccggctccgggctgggggatctgtgcctggcatggggacgagttctggcctncttagggtacggngagagcttggactttggtcctgacgtggtggacgacacaccttcgaagagtggacgttacctcagttgtctgttgttagagtttaatcgatcactcctctgttttgttgtgttctttcccagaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528508 - DNA, 131 bp, Homo sapiens
ggttgattgtgactgcctctctcactctggcctccagacacggcaggtgatcccatgtgacatgcggggggcactgtgcggcaggagcgagtgacgggtcgccatggaattctcctcatgagaaaacttct

SEQ ID NO: 528509 - DNA, 634 bp, Homo sapiens
  misc_feature (22)..(22): n is a, c, g, or t
  misc_feature (73)..(73): n is a, c, g, or t
  misc_feature (75)..(75): n is a, c, g, or t
  misc_feature (84)..(84): n is a, c, g, or t
  misc_feature (95)..(95): n is a, c, g, or t
  misc_feature (101)..(101): n is a, c, g, or t
  misc_feature (120)..(120): n is a, c, g, or t
  misc_feature (175)..(175): n is a, c, g, or t
  misc_feature (190)..(190): n is a, c, g, or t
  misc_feature (202)..(202): n is a, c, g, or t
  misc_feature (217)..(217): n is a, c, g, or t
  misc_feature (223)..(223): n is a, c, g, or t
  misc_feature (226)..(226): n is a, c, g, or t
  misc_feature (425)..(425): n is a, c, g, or t
  misc_feature (536)..(536): n is a, c, g, or t
  misc_feature (540)..(540): n is a, c, g, or t
  misc_feature (546)..(546): n is a, c, g, or t
  misc_feature (548)..(548): n is a, c, g, or t
  misc_feature (552)..(552): n is a, c, g, or t
gttcatggttattacacaagtnattacacaagtccagtgtataaacactacctgaacacattgtaagttcttntnatattattnaatattatatnataaangtttttttgcattaattcnataattctcaaacagatattcatcgaaatgaggtaggtctaatgtgtcatttggnaaagcatttaatggngaggaggaaaantacttattgaaaatnttagtnttnatcggactctccaagtttaatgttctaacgcaggcattatttgttagagagtctggctgaacttcacatggatttttcttggtggggctacaataattatggtcctgtctcagatgtgtgttctgggaaacatcattgaattcacttggtactggtggtgggatatgactatctcccattcccaaatacctaaagtcancttccccattttctgacagctctgttgaaacaggtgtaggagacaataattccgctaaaattttttcatgagtttgactactgtacagggaaacaccaggaaaagtggtgnatgnagaatnantggnaatattaattggatatggtagaataatttaacaagtcctctattgattcacaatcatttggagacccatcctggggaacctg

SEQ ID NO: 528510 - DNA, 1897 bp, Homo sapiens
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgtacggatggtttccgcccatgttagcccctccaaatttgcccgtgttggggttacagccctcgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528511 - DNA, 1751 bp, Homo sapiens
accagagttaaggggcatcaggcacaaaaacgtttccaagagcatgatgggccacggatctgactactcactcagtgaagggcgtgtgggtcgtgtgccaaccgtcgttgtaggtgatgtccaacttcaagatgagatcataagacggatcatgcatgttcaccaagtgaagacaaccccacatggcaatgacagtgccaaagcccagccgggcacaggaccaaagccgcgtgagtctccgaccataccgcgcaatcttcacttgaacttgactgcaccatgacagaacacctgagggcgcgtttgacactaatccttgctcctacagacgatactcactcacgcactagacagagcgactacggaccctcaacgggctacaccctaccgagcgaattcccacgcacacgcctccgacaccacccctgctcgccacgacacccgctcccgccgccccacccgcagacaccaagcgcaaccccgacggcacatccagccacgcgctctacccacgcctcgcaccgcctcccactccacacagcgattacattacccttcgatccctcatagctcaccaccactctactcacaatccctagcgctccccaacaaacaccgacttccttccaatcgcacattaccgtccacacactacaacacctccatacctccgccacccacccacccaacccactccaaccccacctcgcacacaaaccccaacacaccccccacacacccctctcccaacacctaccacaacctttacctcaaacgccgcgaatcatcaagacacataccatagccacctcaaccacacaataccccacacaacaccagccacaccacacccacctcccttacataccgcaaacaccttcaactcaccccgacactatacatcccacttccaccaacacacccaacccacaccacacacccacctacccacccctccccacacccccccaccaccgccctcacacacaccacgcactccaaaatccacccccctacacctattccacaaacacatccacatatacactcaccactccctatacatatcacacccaaccaactaacacccatcacaacaccacacccaccccctcacccatcaactaacacacaacagaaaaccataccgctagacatgcgtacacttcacatcaccctcactccatcatcgaacctactttacaccatatcacacactcataacatcagccacttacacccacctacatcactcacatcctaaccaccaccaactaccacatcccccccaatccaacaacccccatcacaacaccaacaccacatcacagctatcttcacaacgaacgtccctaccctacctcacatatcactacgctttctcaactattattataataacaaacaaatagacatctaacaacaccgcactacctccctcgcacaccaactccttacaaatcttacccatacaaactaaccacaaccaccagcgcctacaacgtccaacaccaaccatatcacacagaaaaacctcataccacaccacaacccagcctcacaaacaccaccacaaccaacactcacaccaccacacacgccccaccacctcgccaacctacaaaccatcaccacccaccaaacatccccacctcccacacaccactcccccccacacccccccaccatcccaaccaccccccccacccctcacctcacaccaacacacccaaccactccctcccacaccg

SEQ ID NO: 528512 - DNA, 187 bp, Homo sapiens
tatccattcgagagattgtgtgcccttgcgactgtattggcaattccaatgagttgtttggtgacggctcaggatactgtgtgcactgccaggggaacacaacaggtagagcactgtagaaaagtgtctggattggttatatcgggtgattccatcagggtgagcatccaatattctgccagcctgt

SEQ ID NO: 528513 - DNA, 1670 bp, Homo sapiens
  misc_feature (67)..(68): n is a, c, g, or t
  misc_feature (127)..(127): n is a, c, g, or t
gccttcaaggtaagtttaacttaaccctctttgaaatcctcaagtcctgttttaatgaaaaacacannaaactaactcccttccccctggcaagagttccttgaagaaagaataagatgttaaggtnaggtaatggaagcccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgtacggatggtttccgcccatgttagcccctccaaatttgcccgtgttggggttacagccctcgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528514 - DNA, 427 bp, Homo sapiens
gcggccgcctactactactactaaattcgcggccgcgtcgacattctcatgactactttggtagcatatgaagaagtattgtctacatatgttcaaagagaggatgcgctgttggaggtccaaggattttcccacaaatcacatgaacacaaatctcagtcagacagtgatagcttattgcaccccaggactggtcaaccaggtctaccatctgtattcaggaactaaactgtaacccagaggtaagaccatcgagagaccagtccagtgtaacttccgactggatgttctattaatgagatcaggatgttactggcatctataaaacaaactccgagcagaggaggcatcctcatgtttcagggaagcatctcagaacaaaatggcgtcgacgcggccgcgaatttagtagtagtagtagtcgacc

SEQ ID NO: 528515 - DNA, 194 bp, Homo sapiens
gtagtgagtgtgtacaggcggagttaaatgctttatagcacaagacagaaaaaactgcgctagaagccaacttattcatacatcatcatcgttcttcttgcatctatcatctagcttcatcgttcgctccgtcctcctcaatacctcgttcatactatcctcatctatacctacctactatccttactagtaag

SEQ ID NO: 528516 - DNA, 1026 bp, Homo sapiens
gcctcagaattcacaaaatttccacaaaatctagtccaaaggaggctggcagagtctggaagggtattggtagtgcatgggggcaggagggccctacctgatgggtgcaacccttacccctatagcctccctggaaaatgtttttctgccagggagcttgaaagttattcagaacctcttccccagaaaggagactagattgcctgttgttttgagtgttatgtgagcctcagaaagtatgagtcagttttgcccacccacatctccccacactaacctgggttcccatttccttccaatcccatacccccataagagccatttaggggccactatttgactagggattcaggctgcttgggataaagatgcaaggaccaggactcccatcctcacctacatggactggctagagtcctcactcccagtccaaatgtcctccagaagccatctggctagaggccagacccaaccaggagggagggggctatagctacaggaagcaccccatgccacagctagggtggccctatgcaagttcagcaacaacctagtcccttcccactacacctggctcccatgacatactgagggaccaactgggcccaaagacagatgacccagagactgaaatggcctcaagctgcctcacttcctacaagagcagcctgtggcatcttagccttgggatgatactcatggtgggtcagagagactcagccctgaggttcaagggagctacaggaacagatctgggagccaccagggtcagaccgctacctccgcgcacgacgggccaggaagagagacaagcgcatggggaggggtaaggctgaacacaacggacaaggcccgggccgggcacagggcacatcctggacacccacgacatgaccaagcatgggcaccaagcagacaaggccaaaaaggcccggaccagaacactacaggcaaccccaagacagaacacaccaggcaagacaccaccgaggcacaaaacccgggacctcgagaaccatacagaaa

SEQ ID NO: 528517 - DNA, 1967 bp, Homo sapiens
actttgtgcacatagcctttaatgctttgagattgttttggaatttctggcacattttgagaagaaaactgcctgtgtctctacttggctctctgagaaaaaaaatgagtttacgtactagaggaactatacattgtaggcttggaaacaggctggcacactgaataatggcagtctaccgtaggtgctcagaaatggaagcagagctgtattgtctgctacctgcatgtgtaatgaacttcatagcttgctatggtggcagggagatcatgcggagtgttcagcttcacacggagcctgggaacaaggtccaggggagaagtattttcaatactccctctcacagcagtttattccatcaggttccccaatggcaggtcggctccacgtaggcctactttgcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaattagaaacggggtttcaccatgttggccaggctagacctcaggtaatccacccaccttcgcctccctaagtgctgggattacaggcatgagccactgcacccagccaagatttgagaatctcacaggttaacgggtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528518 - DNA, 188 bp, Homo sapiens
tcttatcttttttcctcactatctggagttgatctcccttttactcccaggccatcactcttgacttccagatatcaggtccctgccttctccctggtgctggaacaggtcagattcctggaggacgagattcatgagtttgggagtaatcaggaatcatccctcagtatctattctgattgttatgg

SEQ ID NO: 528519 - DNA, 1205 bp, Homo sapiens
ggccgtcgtcggagaccgagtggttctatctcccaggattgtctataagggtgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaa

SEQ ID NO: 528520 - DNA, 157 bp, Homo sapiens
agtcttttttttaaaaaaacccaaggggttttggggggccctttgggggtgcctgccaactgtttcccaaaaattttttaggattttttttattttaataattaaaccccagggaatgccttccgggccttagccacttaggccaacccttttgggc

SEQ ID NO: 528521 - DNA, 132 bp, Homo sapiens
gctggatggacttgtatcccagctactcaggaggctgaagcagaaggtcaattgggcctggaatttgaggctgcagtgactgtgattgtgccactgtcctccagcctgggcaaagagtgaaccctgtttcgg

SEQ ID NO: 528522 - DNA, 603 bp, Homo sapiens
ccaaaaaaaaccccttttttataataatttttggtattcttttggttttcataaaaaatttttttctttttttaaaaccaaatgtaaaaatccgggctttttaaaccttcccccaaaacccaaataaaattaaatggtaaaataccttaaaactatttccaaattcccatttttaatccttttttgtatttctctaaatttttttaaattgggtccttatgtatttcttaaaatttcccttaaaaattttaattttttgcccctttcaaattttgaaaaaaaaaaaaaattttttgtattttccccccccccccaaataaattttttggttcttcctccaattagggtctttttttataacctccaaaaccttttttaaaaaaaaattttatttcccctttttttaaaaaaattttaaaattccccaaaaaaccttttttttattgctttttccagttctaaaaaattttttaatgtttgggggcagggctttatttaaccccttttaaaaaaaaaaatttgggacccccggtgtttggtccatccctttggaaatttttaaaaaaaaatattttttaacccggctctctggaggtaattccc

SEQ ID NO: 528523 - DNA, 1149 bp, Homo sapiens
aattatttgttgctctcttgagaaagattgggttgtttcatgtggtagatttatcttgtgttttgttcgttaattggccctgcgcccttgtgttttagagattgcgctggcgtgttgtgggggcggctcgcggacgttgtgtggataagaagtgattggtgtgtttggggggggggcgggggcgacacagacgcccccgctcgctgttgtgcgccccctttgtgtttttttctcacctcgagagttagaacacccgcgtcgcgtcgctctctcttcttggttgcgcacacacagagagatatgtctttcttttagtcatgtgtgtgtgtgtgtgtctctctcatctctctctgtgagagagtcacctctctgtgtggtgtgtatgtgagataaagagaagaaactctttataagagcgccacacaccccgcgctctctcctctcgtgtgtctctctctctcacacacagcagtgtgtattatagagcccccccgcgcgcgcgcgtttttcttcgttctcgctcgaggtgtggggatgatcatctctcgctctcccacacacaccccctactctctctctgtgtctgcgctctgcgcgcgcgcgagagagagaagagagagagagacacatctctgttctcccactctctctctcgagacacacctctccgcccacactctctctctctctctctctctctctcctcccacaccccccccctctctgttgtcacagctctctctctctctctctctctctactcttatatatatttgtgtgaaatagtatatgtgtgtgagatataatatattttacacccctctctttatctctctctctttttcgacacacacggtgtgtgtttaaagaagaaacacccgcccaccgccccccgcgccactactatatatttttgtgggtgtgtgtgtgtggggagacacacacagcagcagagagaggagaggacgacacacaggagagagaaatatattttttaacacacacataacccccctttttggaacacacagtgtgtgtatataatctctctctgtgttctgtttttgtgagaaaaaagagagagaaaaaacacacacacgtgtcctcttttgggaccacacacacaaaaatttttctcctttttttata

SEQ ID NO: 528524 - DNA, 642 bp, Homo sapiens
  misc_feature (190)..(190): n is a, c, g, or t
  misc_feature (208)..(208): n is a, c, g, or t
ttagtctagctttcttgtatacatcagccttcacatccatgaacgtgagtcaagtagcaattggtcacattgatagtgagccagatcccttttcagagctcctattcatgcgtccgtatcatatcatccatcactttcatcttcgctcagtcatctgctctcagatctgtaaggcatgagagcctgaagnagaagttggatactgagnaacggcctgtgcatattttatatccttcgtgtcgtgtggtgatatgtatagggtacacatggattttctctgaaaaagctctgcttaatgtcaggtgtctggcacgcaggtaacatctgcctaagtatcaccaataccgaagatctgagagcctctcagttctgatcctctgtataacccttagtcgccgtatctgcttgcacagtccatatataaatttagtcagctaattgcaagcttcatctgtatagcgaatccgcctgtctccgatgtaaataccgtaagcagtaggatcatccacgtgctcatgcatcagtcagcccaattcgtagatattcgtggtcactctggggatacccatctcagtgcattcagctgccacggttgatagtccaaagcttggcttcagtacagcgcctatatccttgtatgcg

SEQ ID NO: 528525 - DNA, 144 bp, Homo sapiens
  misc_feature (8)..(8): n is a, c, g, or t
  misc_feature (92)..(92): n is a, c, g, or t
  misc_feature (124)..(124): n is a, c, g, or t
ggagaagnactaatgtgcaacagcagtggacatctactcctttggcatgtgtcactggagatggcagtcctggagattagggaatggagagnctcatatgtgccacaggaagccatcagcagtncatccagcttctagaagacc

SEQ ID NO: 528526 - DNA, 209 bp, Homo sapiens
aactgacgcgaaggaagctctcagctagggaaagagttaaattttagattacagaacatggattcagggagtgtctggaacaaattggctgacccttactggtaacctgctattcttctggtgttatccttcaggattgttccactaaaatttatttttcaaaaaatttacttcacattattctatgtaagtgatgacgcgtcagtttg

SEQ ID NO: 528527 - DNA, 1027 bp, Homo sapiens
  misc_feature (31)..(31): n is a, c, g, or t
  misc_feature (76)..(76): n is a, c, g, or t
  misc_feature (125)..(125): n is a, c, g, or t
  misc_feature (371)..(371): n is a, c, g, or t
  misc_feature (401)..(402): n is a, c, g, or t
  misc_feature (404)..(404): n is a, c, g, or t
  misc_feature (422)..(422): n is a, c, g, or t
  misc_feature (424)..(424): n is a, c, g, or t
  misc_feature (435)..(435): n is a, c, g, or t
  misc_feature (454)..(454): n is a, c, g, or t
  misc_feature (460)..(460): n is a, c, g, or t
  misc_feature (501)..(501): n is a, c, g, or t
  misc_feature (545)..(545): n is a, c, g, or t
  misc_feature (548)..(548): n is a, c, g, or t
  misc_feature (556)..(556): n is a, c, g, or t
  misc_feature (562)..(562): n is a, c, g, or t
  misc_feature (565)..(565): n is a, c, g, or t
  misc_feature (567)..(567): n is a, c, g, or t
  misc_feature (572)..(572): n is a, c, g, or t
  misc_feature (624)..(624): n is a, c, g, or t
  misc_feature (791)..(791): n is a, c, g, or t
  misc_feature (795)..(795): n is a, c, g, or t
tttcccgccacacttcttctgggcactactnccttctgtcgcttcagctgctgcttccaggtcttctgctgctgtngcgccaccaccatctgtacccacaggggagttaggatcaggcctccagntgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgctctacctacgtttgtttttcctaccacctggtctttggttctnttcattgtttccaatcccctttcctgcttnntngccatgggtgttctgttnanttcttttgcangtctgtgctgtcttttttntgttgngctttttttttgggggttactgatggcgctggcatcctgancccctgcccgcccctggtgggcacctcggcgggggtggtcctcntgntgctttcntgggtnctntntcttngcgtgttctcctacgtgaaggtggcagccagctccctgctgcatggcggggngccggccggcattgctggcagccggcgtggccatccaggtgggctctctgctcggcgttgttgttatgttccccccgaccagcatctatcactgtgttccacagcagaaaggactgtgcagaccccttgtgactccttgagcctgggcaggtggggaccccgctccncctnacacctgtctttcccgtcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaa

SEQ ID NO: 528528 - DNA, 181 bp, Homo sapiens
  misc_feature (39)..(39): n is a, c, g, or t
  misc_feature (82)..(82): n is a, c, g, or t
  misc_feature (119)..(119): n is a, c, g, or t
  misc_feature (128)..(128): n is a, c, g, or t
aagtggtgtgatgtaaatactggaaacaaaaacagcagntgcattgattttgaaaacaaacccccctggtatctgaacatgntttcctcaggaacaaccagaggtatcacaaacactgntactcatcnactggctcagactgtactacttttttttttttttttcctgaaaaagaaaccag

SEQ ID NO: 528529 - DNA, 243 bp, Homo sapiens
aaaaaaaagaaaacttttaaaaaactcccctttaaaaccaaacctctttgtgttttggaccaaggaattttccaaatttgattgggattttgttttgaagtttaggatatttttccccccataaagccccccgttttatgcccctctaattttgaagtttggggattgggggggggcctgggtttttttttttttaaagggggggtgaccaaatggaaataaacccggggctgtggcccttta

SEQ ID NO: 528530 - DNA, 232 bp, Homo sapiens
aagaaaatggacagaagagatataaaacccttactaactctagaatgttaaaaaagtgaggggggggggtgtcaaacaatagctctttatgatcatgctcttaaagatgttaaataccagcggataattgaattttgaagctgctacttagcacttacttgcattatatgcttcagatactgtaaaccaaagaataacaacgtgcaccattgtggaaatcacgtgagagaat

SEQ ID NO: 528531 - DNA, 326 bp, Homo sapiens
tatcattatcgaggttgatatacatgggtgtgcttatcaaagtagatattccgccaagatagattcaggacgctcacatccttgcgccagtaggtcacctcgtcacccaattctttgatggctttcacctgctcattcaggtcatgtgttctcacaatgaatgtcacacgaatgggtgtcattctcgtcagctaggccagctttgtgcatttccagtcgtgactgatacacctcttgcgtcaaatgtaatgcacactccattgcattcagcccgctctcccagtcatcacagtctggttcctcgatatcctgaaggaagatctggc

SEQ ID NO: 528532 - DNA, 134 bp, Homo sapiens
atcagcgagtaaagtctctgtgagaccttgcgtgcagtgtccacgagacggtggaggcctagaagaggcagccggatgctgacggggaagacgccgagcgattcagggttcccatggaaggcacaagtgtagta

SEQ ID NO: 528533 - DNA, 374 bp, Homo sapiens
tccccaggggccacaacaaaataggggcttttggattataaaacggaaaagtatgtgatgaccaggaactggtgggggggcgccctgcaaaggctgctgcagtttgggatcgtcgtttatgtggtaggggaaaaaacgtgttttttttggtgaccaacttccttgtgacgccagcccaagatcagggcaaatgcccaaaaatacagggtcttgttatgttgcccaggctggagtgaaaaggctattcacaggtatgatcaagctccctgcagccttgagcctcctaggctcaagccatcctcccaactcagccttttgagtaactgagactacaggggtgtacccccattcccagctaataaagtttattttta

SEQ ID NO: 528534 - DNA, 492 bp, Homo sapiens
  misc_feature (9)..(9): n is a, c, g, or t
  misc_feature (12)..(12): n is a, c, g, or t
  misc_feature (26)..(26): n is a, c, g, or t
catcgactnccnattgccattgacgntcatgagctggatgtactgcttagcgccaggcattatgcaacctgacgaaactgctgtcgtcgcgcgcagtgataccacctgatacgtggttgctcgcatcaaccccagcggtgaacagatggatgacagctactttggccaacgctccctgcattgtgaagtaagctgagccgaacatgacgccgcagtgtgcccagcttatgatatctatgaggacttcaggaacgcgcattgcgtacgccagtatcatggaaccggctgccgaccagttcatcatcatagcctatgccatactgtagtccagtgatgcagccaggatagaatgagcagttgcattcttgcacaaaccaatgttgctgctgagagataatcagttgggctgcaagcgataccccaacgcagaggtccaacacgtagtgagctgatcacagcatgtgtgtatgcacaactatgtaggtgcatcgt

SEQ ID NO: 528535 - DNA, 162 bp, Homo sapiens
cccggggctcggggtgggagggccggggtcgccggaggagccgccctgaccccggggcctcgtgccagcaagcagggcagcggccctgcttaggctgcagcagcccaagccgacatcggtcccgaccctggggttcaactgctagcagcagcgccaaccggc

SEQ ID NO: 528536 - DNA, 416 bp, Homo sapiens
cagctcgggtaggcccccagtgatgccagcccataggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccaccacctggcatgccctcctggggccaagagtgggcctgcaacccacccacttgcctgcccacccaactcctgggcgctccccactctgcccaggccttgagtgtccacattaaatgggtctcccacaaaaaaaaaaa

SEQ ID NO: 528537 - DNA, 1225 bp, Homo sapiens
  misc_feature (351)..(351): n is a, c, g, or t
  misc_feature (1225)..(1225): n is a, c, g, or t
gggagctgtagtatgctgcatcaatccagtatcagctcccctccgtaactgcagcgtctatgtatccttgcaaggctgtgctgtgtggagcaggcctccgagacagacagccacgtcagtcatgttgactcagtgcacgtcatggctgataacttcaacccatccatgcagctggctgatatccccgagacgagcaatgacaacaattggctttattacgtacggcgaattggagtcacgagctgatatatagtgcggctgggcatttacccgttagccgtcagaacacctttcatgcctttgccaatattgcacgcacgattaacctaagtacactttactttgactcgnttccattgctcttacaggctcaattgccagctgcgtgtgactttcctagtgcaaacagaggtgcctttttcgtactacaaacaattaaatgtaagcagcatcgggctttggtccaacttattctcaagtacatccaaaaacttccggtcaccatggggaacgcctcatagcacaaagtctaaccaaatgatcactataccctcgaaacctgtacttccctccctccataattgaattcttgaccgaccgcctttcttgagtccaaacgagaaacaatggacgtgcatacaaaattaattaggcctatcttcttcaacaggcaacaaaaggaacttgtataacctcaagattggccagcaataggggccaagacatctcccatatgaatgaagccaaaagttacagccggtttgtcgtgtcaaccaagtcacagggtgacacatacccgaattcgagatacagacggaaaatcattattgggggcggacatcacctaggaatcttgttaagccccattgcaggagggaatccatgacatctgaggaccgtttatcacgcgtattcgctagacggaagggaccttcgatacatattggaggcttgtgatagcacacctttgaatagccaaagccagccaaatggcctagccgattggttcacagctactgttggcaaactctttatagcacatttgaagtcacatttctttaaaacggccagtgaaaattgtggggatcacaagcggattgtggtcgccacagggcaaattggatctgatagccaagtagggtttcatcagaagggcaaaccacatggggcataatttgatacgtcaaagaagaccgcatatataggcctaatatggcaagaacgn

SEQ ID NO: 528538 - DNA, 725 bp, Homo sapiens
aaaagaacacacaacactgagtctgcggttacgttcagcttgatcccatctcggcgcgagaacttgtagggctacaggtgttagccagtgcaccgagcgaaatagctcaagtttccaaaaacaaatctgaatcctcttgtattcatagcgtcgctggtctggcatcagagagtactatacacggttcccacacctagttcggcccagctcaatgtcagtacttcagactcgcaccaaagtttgttttcacgcactacagttcacaagtcttacgataatctgtgtacttgtcagattagtacatccatacaacagtttcaggtggttaaggttctcgggctccctcacctcaatgctgttctaaacctggtagattgtagccaatcaaacagtctgctgatttaggatcaccttcaacacttaggtatcctaggtcatagcccctaatctgcaagcaatgtgcagtcctgtaaacaatccattccctcaggattcctcaagcctcattccgcccctgatgaaagatgttctgtttgttccacgcaactatggaagctgtttcaatcatcgcaagtgccgctgaaagcgagtgataggctggttagagggttaaacattctcttcaatgggttgtaggtgtttaactcaatgtagtaaatattccaagatgattttgttccagttcttttgtgaatgtccaatctaccaattgattctcatttgtg

SEQ ID NO: 528539 - DNA, 105 bp, Homo sapiens
cgctacctgtcagttattcacggtgcataccatttctggaacgcgacttacgatcatagcctgttttcgtgctaagattttttaagctcacccagagctagttct

SEQ ID NO: 528540 - DNA, 456 bp, Homo sapiens
tggggtgtgacatgatgacgtcacgcaggaagcgcatggtgtcaggtaaatctcttcgcttccaagggaacctggtgacggactgtgccatggataaatggtgcagatccagctgagatactatgcttttcccacgctctttgcaacccacagatcaggagattccctcaggtgcctatgctaccagggccctgggcttcaagcacaaaatttggtggctgtttgggcagacaccgagatagctgcagtttcttttcataccccagtggcgcctggaacaccagcgagacagaactgttgactccccctagaaagggggctgaagccagggagccaagtggtgtagctcagtggatcccaccccagcttcgtgggggtagaggcgtctgctgatactgaggcttggttaggcagttttccgctgtcagtgtaaacaaagctgccaggaagttcgaa

SEQ ID NO: 528541 - DNA, 1143 bp, Homo sapiens
  misc_feature (1130)..(1130): n is a, c, g, or t
catattactctgatttctcgtcgttgcttttctcctccttcgggctctttcgttgatttgctctgtgctgtttgttctactctttttgtgcttcgctttttgtttgtttttcttctcttcttgtttttatgttctgtttttctttcctctccggtttcatccttttgtcgctcccgccatttctcccgatgtcctcccgttttgctcctcttgtctttgttcgtttacatcttcttctctgggctctttgtcttatgtgttgtgatttcctcttgtttaggtgcttccttttgttcttctggcttctagccttcgtggtttgtgtttctatgtctttcttgtctcgcctgtaatcgtgctcctgtattccggctgccttcccaagcttctgcttttattcagaacttttctgcgccactgcagactagctctggtctgatgttattacctgggtactttatccagctaactgagtcacaatgatcaggattggatttggtaagaatagagatttcttttattttataccacttcccatgactgaccattactaagctcaccactagtagttcctgattacaggtgcaacctgtatgactatgcccttcctactttggggtagccacgcttttgatgtgtcagtagccgcagagtgattccaccacctgaggatgtcactcatcaaactcttcctttggtgtgtgaattatctagtggaaaagagccaagctgtaattagacctccactgtgtacttgagctcggatagaacatgttgaattctgcaatatgtttcttcggttaaacattgcactagttcttacctcatttctgtaaatcaagttttgtgaactctgtgtgttgtattgtgacaaattcataaagataatcattgatatgtttgaatttgtgaatatttctaacttggtagactttaattgaagaagtaaaattaatgttatttttatatgatgcacggggaattttaaagtcaaatgcttttgtagataaatttacaaaaatacagtgtggtttattatatacttagtttaacccactggttgttattctgtaaacaggattagtataaatggtacattttgaatgagcttgtcttattattaaccagantggaaaattccaa

SEQ ID NO: 528542 - DNA, 185 bp, Homo sapiens
ataactatgcaacatgtctccaaatgtaccattagacctcctatctgcctattcaagatctctggcagtggaggaagtctctttacgacaatagtctaaacaattagttacaaaatttaccgacttatctcattcctgtaacagtcgatatctggctgtcctcactacatgccatggggatcctc

SEQ ID NO: 528543 - DNA, 850 bp, Homo sapiens
  misc_feature (13)..(13): n is a, c, g, or t
  misc_feature (56)..(56): n is a, c, g, or t
  misc_feature (65)..(65): n is a, c, g, or t
  misc_feature (82)..(82): n is a, c, g, or t
  misc_feature (117)..(117): n is a, c, g, or t
  misc_feature (160)..(160): n is a, c, g, or t
  misc_feature (175)..(175): n is a, c, g, or t
  misc_feature (177)..(177): n is a, c, g, or t
  misc_feature (183)..(183): n is a, c, g, or t
  misc_feature (187)..(187): n is a, c, g, or t
  misc_feature (195)..(195): n is a, c, g, or t
  misc_feature (199)..(200): n is a, c, g, or t
  misc_feature (237)..(237): n is a, c, g, or t
  misc_feature (243)..(243): n is a, c, g, or t
  misc_feature (283)..(283): n is a, c, g, or t
  misc_feature (306)..(307): n is a, c, g, or t
  misc_feature (309)..(309): n is a, c, g, or t
  misc_feature (316)..(317): n is a, c, g, or t
  misc_feature (329)..(329): n is a, c, g, or t
  misc_feature (333)..(333): n is a, c, g, or t
  misc_feature (364)..(364): n is a, c, g, or t
  misc_feature (369)..(369): n is a, c, g, or t
  misc_feature (372)..(372): n is a, c, g, or t
  misc_feature (397)..(397): n is a, c, g, or t
  misc_feature (431)..(432): n is a, c, g, or t
  misc_feature (451)..(451): n is a, c, g, or t
  misc_feature (505)..(505): n is a, c, g, or t
  misc_feature (510)..(510): n is a, c, g, or t
  misc_feature (523)..(523): n is a, c, g, or t
  misc_feature (532)..(532): n is a, c, g, or t
  misc_feature (587)..(587): n is a, c, g, or t
  misc_feature (601)..(601): n is a, c, g, or t
gccgcgtccggcngattcctcctccttggtcgccgcgtccttggctggcgtgaggncaaagcaanatgaggagcgggaaggnctcctgcaccctggagaccgtgtgggaagacaagnacaagtatgaggaggccgagcggcgcttctacgaacacgaggncacacaggcggacgncntccgcnccangcagctgncagnncgaggggccagccatgaatgggcccggccaggacgancctgangacgctgatgaggcggaagcccctgacggcggcagcaggngtgatcccaggaagagccaggannangcagganngcccctgcaganaaangaggaagcgctcccccaagagcgggctcggncccgnggnacctggccctcctgggcctctcggnacgaacgtgtgtggctggacaagtcacttttcgnnccaggcagagagctcctancgccagaagctggcagatgtggctgcccaggcagcctggcctcctgccttggcnccttngggtctctgcacncatggaaancaggtggctgccaccacgtgactgggggatctgggtcaacaagtcctccttcgancaggctgagcgggncttcgtggagtggtctcaggccctgttgctggcccccgagggcagccgcaggcaggggactcccaacacaggccaggcaggtggccgtccccgaactggcccaccagacccaacccaccaggtcaatgggacagccccgactgggcaggctgcaggcactgggtacaggagaggtgtggctggaagaagccccggtatgatgcagccgaagaggggaattctaacgaggacctgtttcgacgggcatca

SEQ ID NO: 528544 - DNA, 584 bp, Homo sapiens
gttgcttctgtataaatcttggtcataactttgggtttttttctctgatttaattagtgttgactagttccagaattaccaatcttatgcgatgctcttaagtcagttatcccgtctacggtaatattcaagagtctagtagcctggtggtactcaaatgagttgcgcggtcggcgcaaacagtagcaagagttagatgagatcgattagaatctgaaaagccgggtcaggtaagaaagcgaagtaaacccattcgatacataggtggaaataaagaatagtgatacgggtattcacattatgtgtgggaggatgaattttggtgtcagaaagatagagaagaaatacacaaatgtgtgagataagtctatgtcatcaagtagtgaaagttcagatggtgtactgtggagcatagagggtaattgtgctgagtgggacagaatttgctagataatgagagaaacttgggaggtaaatgggaatgagtggcttaatattaaatatggtacatggtatgtgattagagtaggtagatgagacaagagaaagaggagagaagagggacagaacaaggaaacaagaac

SEQ ID NO: 528545 - DNA, 1291 bp, Homo sapiens
tccaaacgaggacaatggttattaagtttttattccataatcataaatttaactctgcaatctccagctaggcattgggagggacacaaggaaaactgtggaacccaaggggaactgcagccgagagccacaaagattctaggatacgtgcgagcaaaattgggtgtggaggggtgctctccgtgagctacagaaggaatgactcttggtggttacagataaataccacaagttcaaactttattctcgagtttgctccacagttcagcaatggggtgactctctctgtgcgggctcatggcccatctcctcgtggacccaaaagggcctccagtggccttccacaatatttcagtgcctctcttcacatgtttgtgccaaaacaccacatgtgctttgcacactccaaacacatgtcaagttcttggggaaagtgtgcaagatgtgaaacaacgtgtgggaacccattttgtggtgttggggtctccagacatttgtgccatgggaccaaggagtgccaggacccgatagtgcttaaagagaagtagaaggttctacatttttcaaatttcttccccatataaagtggcccttttgcccacccaggtggcccatatagtggggcgtgtgtgcagagttccaaccacccgtggatcaactttaaacccgcgtggaaaataattttcttggtaaaaacgacgggtgaaccccttttagtaacccaaaattccctttatcttcctccagggtggctttcagagaaccccagaaaaacatttttcctgccgagctacttattggggaggacccctttgttgtcttttgccacacaacgaggggctccacaacagtggaagaaccgcgggccccaaaagtggggtcttcgcccagatagaaaacgcgacaaatttgtcgaaaacagacccactcggtggtgggtgattgaccccttggtctaacattagtttacacaggggtttaccccctcagggagcggggtgcgccaacaagttagagagccgacaatttttcatttatgagcgtatgccaaagcggaaagccaaaagttgcttccaaaacaaccccgtgtggcaaacgggtaaaggtctgaactcaacagcgacaataggggcccaaaatcggtgacgccctgtataccccgaaggggggttgattttaaacctccgtgctaaaaggtgggaacttgtgtgtgccaagcaaagtgacccccctatatgtggtaccctcaaaaacatgtgtaacacgtttgcccagtataaaatcaccccag

SEQ ID NO: 528546 - DNA, 444 bp, Homo sapiens
caacgattggtcctcagactacggctgataattccaggacgtgggaacggacccaggtacaatacgcgtcctggagtacgatacccagcaaatggcagcagactctacagaatagggaactgactgtgaaaagacaaatagaaagcaagagcaaaaacaatatcaatgaataagaccccacaaaaatccccatttaaaggtcagcagcatgctgggcacggctggcttacacctattatcccagccagcactttggtaggccgaggcaggcggatcacctgcggtctggagttcgagaccaggctggcctcatatggttaaaccctgtctctattactaatactatattgagccgggtgtggtggtgcatgcctgttatcccagctgatcaggaggctgaggcatgagaattgctggcacctgggcggtgtgcaggctgcattg

SEQ ID NO: 528547 - DNA, 221 bp, Homo sapiens
attagtccgacctatatcagcggaggggggggggttttcggataacataggagacgatcttgtcggctttcaagacatggagtgtgtgccttgtggagaccctcctcctccttaggggttggggctgtatagtcttacctactcaggaggctaaagcaagaggattccttgagtccaggagttcaaggccagcatggacaacatagcaagaacttgtttct

SEQ ID NO: 528548 - DNA, 1166 bp, Homo sapiens
actactatactgttcctatacatattataaggtagaaaaaagtttagtaaatccttataaagaggatgcagtttagacggttaatatgtcagcttacccagacatattctatcaaggaaaacctagtggtagcaataaatcttatggaacggactacttatactcatgtacctttaacacacatctaagcacatttcatactccatcccatgtagagtttaaattcgcagatgcaatttaggtacatcggcatcaaattcacacatagcaatacatccgtcaggtattacagatggtgggattgatgaactttggtcactttctccatccaaaactactttattacggacactagtcacagttatggcttctcagtccatgcaaaagctcagatacataggggtctacataattctcactgagagccttgatataagcctatcttagtatatgcattctaacttgactgtctcaccacatgacgtatctgctgtatcaggcagtacagacagaccacaggtacacacactgaaatcagactgggggatcgagcgacacgttttcaacacaacacagttcataaacaaacgacactctttggattctggcatgcaccaaggacaatgctaggaaacaaatcgagagatacactatggacactatgacacaaaaccagaacccctcatgacaatcacagtaatcccatgcaaagaacaacaccaaggcacataaaaaacaacatagcaatggcgactacggcaaacggaagagacaccatacaagcaaccagaagaagacaaatacaggactcagtgtccacactcctatacgtagtgtgaacgataacaactaatggaacacaaaagacataagaggaagcagtacgaaactagggaaaaggagaaccaacacaagaaccagcaacgacacagagacagcaaataaccaaacaacaagcaaccagggatatgacacgacaacgaaaaggccaacgagaaacagagagagaagagcagcagaccacaaacaaaacaaaacacaagacagatcaccaaagaacaaaaccaaaaaacgaaagaacagaacaagacacgagagaccgaaacgacaggacccagacccacacaacaaaaccaacggcagccaacgaaaacacaagagaacaa

SEQ ID NO: 528549 - DNA, 667 bp, Homo sapiens
  misc_feature (644)..(644): n is a, c, g, or t
gtcaggctcttcaactgcaggctggatgacattcctgggcaataggtccaaccaagggctggcgtctacagtgcgaagggcttcacacgaacaaggagctggccaggagtcccacactcaaaggcagagatgatgggcacaggaaacaagtctgggagatatccacatctcctgagggggcagaacagaaaacgtgcatcctgaagatcaaaggctctatcacacctcctgtggtccagtggcttccacttggcgtggatgatggggaggtgacatcatgtgggagggtgtcctgggaacaggtagaggtggcggcacagagtgctgcagtattcagacatctccttgcacccggtggaattctgtgccaggagcataaccttcccgatccttgataagtgcgttcaccttaaccagcatgtcggccacgtgcatatcacaagcccgctcagaaaacacttgagcaagagcctcgatgtaccaggaacctcgtttggtgttccgcatggcggcagtccctttgaggcaggcatagccgcatatcatgtctgagcgcgtgggcagtctcatcttcggcaacttttctttaccggcatcactctcctcgcacccaggggatcctgcgtggttctttccatcttgtnggtcaccccacgatcagtctcat

SEQ ID NO: 528550 - DNA, 249 bp, Homo sapiens
agcaggtcctaggtccagcagattctacagtactggagggggcgccgatactgcgagggctgttacactgacacgcctggagaagatgtaacacgcgtgcggggagcccatcgagctgtaccgcaatgcatgagggccacgggcaatggctcgtatcgaccgcgaactgcattcacgctgtgatggatctgcgcccgcccccgtgcgagggcacctcgcgtacagtcgctgggacgcaggaccaaacgc

SEQ ID NO: 528551 - DNA, 141 bp, Homo sapiens
cggaccataactattcagcataactattacagcatacactattacagcataaactatttccacaatagtggcatttcaggttactcttcataactatgggggaggttatcattatatctaactataacctcccccatagtt

SEQ ID NO: 528552 - DNA, 1444 bp, Homo sapiens
  misc_feature (129)..(129): n is a, c, g, or t
  misc_feature (233)..(233): n is a, c, g, or t
  misc_feature (244)..(244): n is a, c, g, or t
  misc_feature (270)..(270): n is a, c, g, or t
  misc_feature (275)..(275): n is a, c, g, or t
  misc_feature (335)..(335): n is a, c, g, or t
agcaatacctgcaactgatgaattcttcccgggcgagacctgccagtccgcatcggcactggcctcatagcagttatgttgacactgtcgaataaatcccatgtccgtggtgcaaggctgtgtgtggtngtttcgatctagagtccctacctagctccgtcactggcgaggtagtggcctcagagagtagtccttcagctcaacttgcaccattccaaacaaggcgcgtcttntcatgtgcaantctgtgctcgaaatattcacctacgnaccanccataaaccatctacttagacctgagaattatctaagacttactcttgtcaagcacgacntcagcggcgcatgccaaaatgaataaccgtgttggactcctttcgcacgtttccttttctcattatcggctaatacagggaagtctggatgagtaaggtgactggggtatttgcccgaggatggtcaattccttaaaggtttcctttccctttctgagacggagaaccacaccgtaaggctaggcgacgagtacaacttttggccttgtgggatcccggccttggcgccttggaacattatggcccccaaggaattcctggtggcaaggccttaccttgagacaaccgctttataacaacacccaaggcgaaggacaatagttttcgcttcctaacacttaattgccggctacagaaaaatggcttgtggttgtctccaacaaaccaaccaattatttttccaatttggttcttgccaatgacaaggggcggggttccaaccaccaaggacggagaaaatcccccaccattaagtattgtccggagggcccaacgggccaataaataaaattttgtccaaatattataacccttgggagaaacgcacccaaagaaattgggcgccccaactcttttattggacgctttccctaggttggtcatgtccagccgtgttgatagtcacggacatgttgggacttctcctcccccataattttaataaaatttgtgggtcgtgggccacaactatattctcctaaacaagggacacacaacaggtttgaggcccttcacaagaggccaaatcagaacagcggcgcattgtgcgcggcccccatattggtcgccaacaacgggtctggcggcacacaatttacgggggtctgtagggacgagggacattttccctcagaaagagtatttttggggcccccccgaggcctgggaaacgacaacaaacacctcccccgatatatagtcctgtaataaccacccttttaggagcgcatgtgtgtaacacagaacactatttgctgcccgtttgaactaccactgccaggacgcaacactctctcggggtggctggcgtcctctttctacaaaaattttctgcctccccctccaacgaggcgaggagaacaagtctcctcatcatacacagcgtggcc

SEQ ID NO: 528553 - DNA, 305 bp, Homo sapiens
acagacgcgtcttccacaggaaaaaggccacgacaacggccgcaaccggcacggcaacaagggctacggcatggcgccctttcaagaaagtcacgatgctcatcatcggtgcagatcgctggaggtcaacgagcacccctcgatcgcctgacgatggtgcgtgtaccactggcgaaatgcggtgacatccatgccgtcaaggtcatttcgttccgaacttggcgcatcatcatactggaatccagccagccgaagaatggtgcgttccacggaattaacgccgtcgaaggcctcgatcttgtggg

SEQ ID NO: 528554 - DNA, 290 bp, Homo sapiens
gcagctgttttttcctagctgccaagactgttcaggaagatcgagagaattccagtactaaaggtatttccaaggagacagtttctgtggatgttcctcatctgaaattttgagaattgagagaattattcttggataagttgaattgggatcttcacacagccacaccattgggttttcttcatatttttcatgtccatttcagtgttcaactaaggcctctagtttactttttcagttttgtcccaaattgagcccatctcaacattttggcagtgcttaccacgcaa

SEQ ID NO: 528555 - DNA, 190 bp, Homo sapiens
  misc_feature (9)..(9): n is a, c, g, or t
  misc_feature (58)..(58): n is a, c, g, or t
  misc_feature (92)..(92): n is a, c, g, or t
  misc_feature (106)..(106): n is a, c, g, or t
  misc_feature (172)..(172): n is a, c, g, or t
ttgcccatngggaccagaaccctgggagagacttggatgaggagtggttgggctgtgncctgggacctagcacggacatggtctgtcctgancagcactcctcggncaggcatggctggtgacctgaagaaccccagatgtgagggcaccaccaagaaatttgtggccctanccttgtgagggagagaac

SEQ ID NO: 528556 - DNA, 1181 bp, Homo sapiens
  misc_feature (844)..(844): n is a, c, g, or t
  misc_feature (1013)..(1013): n is a, c, g, or t
ccttttctctctaggattttcgttaccaagaccgaagtttgtgtttccgaagaaaggatttttcacgagagtgtccaaagttacccagttctgtgtttttttagaggacccaataaggggtgggggaaccagctatattggcccacattaaggccttattaataggaggacaccacttgtcagcccgccgttgtttgtcgtttatgtgtataaagcgaacaccacagaccgggggggaaagggggtggcttatacaaagggattaaaataaccgcggtttagatttgaagtgccaccccctgttggaggatgtggccgcatttgtggagatctcgagaaataagaaataggtgttgaaaatctgcctcaaaaagggcgaaaaaatcacccgctaaaagtggcctctgagaaggaatgagagggacccccaaagagccccacaaaaacccacgctgtagaaagatattggagtgcacttcacttcttcccctcttgccgcgagaactttgtctctctggccccctcgcgttgtttgttgttgttttttctcgttttaatgtgcacacacccacactgtataaaaagctctcgggttgggagaactttaactctctcttgtctctttaaagaagtaaagtttgtagaaactttcgagttgtttttcacatagcttcacattgtagacttttcacacataaatgcactcgttgttatataagtgtagtgtcgcctctcacttcacctctggagaagtggagactcttctcgaggagaatttatatgcccacgagagtttcacacacactggagatccacttttgccccacgctgaagaatggctctntatatgtgagattgtaaaggaatatatggtataaaatggtttaatatggtttatactcttgagaaagtataaaataatatactaatggttctctggttttgagggagatatattggagataccccaaaactctcttcctcttagggcgtaactgagttcttgagtttcntgagtcactcacgagaaatttcacccacgagaacccaacttgctttcccactaaatccccactttctaataatgagagaaattcactggaggaagtgtaactggcacctggaagagtttagtgttttttgtatgcttgaaaataaagtatgtactgttttgaatgtga

SEQ ID NO: 528557 - DNA, 953 bp, Homo sapiens
tttccggcgggtcatactatatgcgcgccgcggccgcattctggtgttccgccggtgtccccggtgcgtctccccaccggttgtgccccgccctggatttctcgtgactgggtccattaaaaggtttgaagagtctttggaccccgcggggccggcaacgcccccggggcctggttcccgccgtgttttcgtccctcgtcctccattgcccgttgcccgttgtgggtgccacgggtcccctgcaagacaattctctggtgttgaggaaagttttccccctctgtgtgtcaaagcctggaggtgccgcctcttttctgatggtctcggcggccgcgcccctctggtaagggggttcccggccaaacgcccaccatgcgcgggaggcctttcccgagcaggaccaaccctcggggccccttaccgggttcgggcgaatacaaaacaacaaaccgatcagcgcggcgggcgcaccacacaaaagccaggggaccacacagaaggtgccctggcgactagcagcaggcattccccacagtggcgtcaccgaagagcctcgcatgagggccagaaggatcatcatgccgcctgtgacggcgccccgccccctgctttaatcgagcgtggtggaaaagaccgcgtcttccaggcaacgttgggttccttgcacagaaggcgccccttgaacagtacacatgtctagaagcatctggtgtaaagcagcatacgcacaggccatggttggagacctcctcctccagaaagaatagcatggatatcttttcgggcacaccactgagcgttttcttttttagggtgagccgcagtcttaagattgaatcaaccgatgatcacgaaaaccgcagaattattcagtgggccacacacgcttgcacccgcgcaaacatttcccaaaactttgagacccccttcaaaaagaatacgcaaaaaaaaca

SEQ ID NO: 528558 - DNA, 475 bp, Homo sapiens
  misc_feature (22)..(22): n is a, c, g, or t
  misc_feature (443)..(443): n is a, c, g, or t
tccagtggtgctggggatgggngaattttatagcttttttacattaacccaactatctaccaggtgagatgtgtgatttttgtaaagaacccccccacctcccatatagtaccacaagttaaagattaacaattatttccaggtatttcctaacccagagcaaacccctaaacatttgtcaataataacttaataagaaacaactctaaaaaaagagtttaagttaaaaccccatagaccagactatctacataagaacagttaatccattaaacccttttatgcaccaaattaccctcatgatttattgacagtggcctaaaattttacgcaaaacatgggttttttttaaataaattacttatctttcctccctctcctctcttgttgggcaccctattttttttttttctttatcccctcacaatatagtaatattaagnaaaattttaacatatctccccaaaccccttct

SEQ ID NO: 528559 - DNA, 845 bp, Homo sapiens
  misc_feature (3)..(3): n is a, c, g, or t
  misc_feature (130)..(130): n is a, c, g, or t
  misc_feature (219)..(219): n is a, c, g, or t
  misc_feature (382)..(382): n is a, c, g, or t
  misc_feature (391)..(391): n is a, c, g, or t
  misc_feature (394)..(394): n is a, c, g, or t
  misc_feature (401)..(401): n is a, c, g, or t
  misc_feature (452)..(452): n is a, c, g, or t
  misc_feature (529)..(529): n is a, c, g, or t
  misc_feature (534)..(534): n is a, c, g, or t
  misc_feature (540)..(540): n is a, c, g, or t
  misc_feature (582)..(582): n is a, c, g, or t
  misc_feature (595)..(595): n is a, c, g, or t
  misc_feature (777)..(777): n is a, c, g, or t
  misc_feature (825)..(825): n is a, c, g, or t
ganacggctccattcggcctagacatctctcatcctacacttcacatttatcctttgagtgagccgtattaacctctagtcatagtctggtatgtctgtgctttgatgtaattacatggtgtagattaanaactacctctattggtttttttactatgcattgcccataatatactgtgataacacattaccattcaaataaccttataactaaattgnagggttcttgagagtagaaagtatgtatttctttgtacttccttgcattacagttgcaggcacatggtaactgacacagactgtctggcttgatcttagaagtcgagcctgtcaagagttatttgaatgatactgtgttatcacagtatatgtggcctaaatnatcataatngtnatttgtnaaggacttattcccagttgtcagacatactaactactttttaatgtaaagnagatatccctatctgtatcaatgagcaaaatcaggatttatggagaataaataaaacatagccaactagtagcaganctggnattganagtaggcctgtctagcccaggataacaatgattgtgcgacanacgttcaaataanacgctgatatggaattctaatttccatttctttttctcaatctcttctttaagtctttctgatattctctctcattgttatgctttatatccctggtttgatatttctcttcctttgtgagttataggtaagtgacgctcagtctccataaagaatataagagagatgtctgaatataagtnaagggttcttcttggtaggtgttgttgttgtgattgttgtattctggnagaaaagcctcagctaattc

SEQ ID NO: 528560 - DNA, 956 bp, Homo sapiens
agccacttatacttgggagcctaggaagtcacaggggaaaaagcaacatggtagcctctccatctcaggctattactagccccattcttcagggcctataactaactacaagcctctttgacacaagcgaaactaataccgacatgatccagggcgctccagcagagaaacagggatagtggtagaacccttgcagttccatggctgaactaggtgatatactgggcatgagaagcatactaggcccgtcaaagaatctagaagctaggacttattgtctctagtccaagatggagtggactgaggctggacttaacctctcttatggactatgtgtggagatgccccccatagaacatatgctgagaataactaaagcccctagtggactgatggaggtgggcccattgggaggtgagttagggtgatgagggtggaagcttgcactgggacgcccagaggagctggcctcagtcctctttgctatcgatgtccttgcctgatgtattatggcttctgtaggaataaatttgattgctcattatcatttttgtgtggagacaccggggtttcgttgtttgggtcgggatttcacccggggaaaatgggagcgggctgccaacgccacatgggggaatactctaattcgaaaggggcatgagctcggtgaagaattaccccgggccgtaggcgggtccaggaccgggccagaatgttgccccgggacagtgccagtgtaggccgaaacgaaacacggaggaggctcaccagaatacaggcgacgagcggggcagctggaccgagggaacaacaacggaagacactccgagacaggcgaacaaacatgtaaacaagggaacacggagatggcaacgacgggagacgagaaacaacgacaaaaacctcgaaaacagacccaacacaacagcaaggagaaatagacacgaagacaggcg

SEQ ID NO: 528561 - DNA, 157 bp, Homo sapiens
cagcatttagcccaagattgagattcttatgaatacactgtattattacctgcaatactcatgaaacacgtgaacatctgaaagacagttaaatgaagactgctttatcaacatgccaactccctaccaagacattagatagatttcatgactctga

SEQ ID NO: 528562 - DNA, 1093 bp, Homo sapiens
gggtttgaaggcgtgagcgcgtgtgtgtgtgtatgtgtgtgtgtgtgtccttctgaaaacatagagctattgagtacagcatatatggtcatctcctctaaatttacatttccccatgttgatttttacaaggtctgattttcctgctgctgttaaccaagatgctttccatctttaacgtattatgtttccccattatccagaccccggcgtgatctgcatcctgagatttggagctgccactctttcttgtggttgatcacacaggaactcaaacccgtcattacctcattcttgaccatgaaacacgtcagtctgtgggaatagagggacgagcacggccaggggcgtacaacagacaaagaaaccaatgaatctaacactgtggccatgcttctgcaaaatcgagcgtgaagacatacaagtatcaggcattgccccaggaccatacactcgcgtgtgtactgaaacatggggcccttacttttgcgagatttatagaaataacctactaacaggtacccctacgagaatagcataacgttacaaccaagggtgtctgaactagaagcagcatatacccttggagtgtaagtgatcatactgaggcataaaacggattatacttcatccacgaagacacaatgtatagaccgagatattatgtcataaggcaaatcaggaccacaaagtgcgaatccatctcgaaaatttgccatagtacaacacatgtaggatctatcgcgataatagtactctcctgtatatcgaacccccctgcgaactcaaatcgccaatcgattcacctaattgctcaacaaaggcgttgcagtatccaccaagggaattctgctaacaccccccaaacgaattggaccggacccgaaagtgagaggtgacacagaagaccagagaatcaatgattgaacaacttcatgtcaccaggcacaaatggcacaacgaccactgccaccaaagaagaaaccttactcaagctaaaatgtctaggcaaaacgggagaaggacaggcagagagacggtcaaacacgcctagaccacgcgtatcagcgcagaccaaagacatacacaacac

SEQ ID NO: 528563 - DNA, 250 bp, Homo sapiens
  misc_feature (90)..(90): n is a, c, g, or t
  misc_feature (93)..(93): n is a, c, g, or t
ctcccttgtgccccagcccaagcccaattttttttttatccgaaagatcactgcctttgcccctcccctccggtggcccccatccccttnttncgtctcctccctggtaaacaggggaaaaacgggctgggggtagcctggatgtgggccaagtccccctgtcccccttgggggcaaaagcccctttaaaaaaaacccgcccagcctgcccccttttttgtcctggaaaatttttgggggtgggacccca

SEQ ID NO: 528564 - DNA, 84 bp, Homo sapiens
atctcttatttgggggatcaggttgtcactggccacttgcacagtgctagtgaggaggctgggcatcccttctgtcgtcttctc

SEQ ID NO: 528565 - DNA, 288 bp, Homo sapiens
gaggtgcgggtcgcctccagaggtgcgtggtcgtggcgcgagggatcctgaggctgctccagcagtccgccgccgccgtctcctgggcggcttgggttagccggcgagatcctgtcgcttcaaaccctacgagtccatactttaaaacaaaatcaagaaagtaagctttaaggactagagagtcgctccaacaagtgatggatttgaaagccaagctacttctggacagtatctacaggcgacattcagcatgtatctctatacatccataacacttatgatgacatt

SEQ ID NO: 528566 - DNA, 89 bp, Homo sapiens
ggtgtttggtttcgtctttggattctaaggccctccccctttccggcccccttcccaattaaccgcttttttaggggggaaaaaaaaaa

SEQ ID NO: 528567 - DNA, 1448 bp, Homo sapiens
  misc_feature (610)..(610): n is a, c, g, or t
cctcgctggcgcagtacggcgtcggtcgtcgtgactaactcacagaatgttcctgcttgtcttaagtgttgaactccccgtctccgtagtatgtcgctcctctttggtgggatatgcctgccgcatatgtgccagcacagcccgtgtgggttggttggcaccgccgctccgtctatgtaggtgaggtatcctcctccggggggggaccccgggtagtttcgccctgcaggcctcttctccgggcggagctgttcgttttaagccctcctttataggggcccctcacctggggggctatcggcgtgattaatacaccacgaaaggttttgcgacgccaacccccaagggggttaccgaccccttgtatggtcgccccgtttagtgggcccctatatttttaaggggtggagcccccctttattatgggacaccacacggtttttggttacccacacgtaaaataggcacgcgcgctcgggttataccccggggttctcggcggagttttttccccccgcggggagatatttctctgctgccgaagacgctgcaaacgggcgtttctcgcagcttctctgtggctctctcctggggcggaatgggagtatancccgcgtcgtttagtaaatgcttcgcgggtcttggggtttatatttgaaatggggggcggcccacaggccacactgggcccacgaaaaccttatggtgcacaaacgttgcgcgcaacttgcttatatatacactcgcggtacactctgtgtcttctaagattgtcttcgcctctttgggggctcgagagaggagaccacctctgtgtaagtgtgttatactcgggacactcttaagaccttcgctataaaaaagagcgctcgagatttctctgtggttaaaatctcttaaaggggagatatacaatatatagagttcgggttataatctgtataagagagcaagaaaaattgtgcacagatgggtgtgggcgccgtgtagacacatgcacacacgtgtatagaaatattataactctttcttttcacgagagaggagatataatatgagagaggcacctgagattttcacatatgtgataaaaaattcttggtcttttaagctcttgagacttttttggtgggctgtgtttttataaaattgttataaattatactatgtgatacacacatgtcacagttttaatatggagatgttgttataaattaatggacccttccacattggagataggttataaataatcttcacttttataaagcccacatttgaggtgggagaaagaatacacaagcaccaccacgttgtgctccccacacacattatggagaagaagtaagtgggcacattcacgagacacattccggaaatttgttggctagtaagttggaggaagtttcagtgagtgaatttaaaccaagtctatttaactgacgtga

SEQ ID NO: 528568 - DNA, 785 bp, Homo sapiens
gcttgtcccccagcggcctggaatccccttactgcttgggaatgtgacttgctcctggggggctggccctgcaggccaacttccctcatctctggcggcctcttgggctctgaccagcccctccccgggcaggctcacagaagctggcttctgggactgtcctgggccaagtgggcactgcgccagccccactgtgcctgggctgtggcccttcctacagggcgctcacatggccccgcgctcctgctgcgtgctgctggcagtggagcggctgctgcccgctgcctagcgtctgcagaacctgtccgagtctgctcacaccctctgtgcccccgaggctgctgtttgtgccgcccaacgtggacggcgcacagtggagctgcggctggtgacaacttcatccaggcctggggcccctgacttccgcacatgacgggactggtggacctgacactgtctcgcaatgccatcacccgcattggggcccgcgccttgggacccgagagcctgcgttccctccactgacggcaacaggtgtggagtggcaccggagcctccggggccccgtaatctgagacctcatctcgggcacagctggccgatggccgagctatgagattcctaagagctggagaccgactgtctacaaaactcggagtgcctggcggtcgcgctgctgctgaccccctcacctgacatactatgagcatgcccaggccttcgcactcgtcatcccgtgactactcacgctgccgcggtcggccgtcttgtggctaggagccctc

SEQ ID NO: 528569 - DNA, 404 bp, Homo sapiens
ctgtatcacgaggcttactgggacatgctcattgggtcggaatacggtgccgccttgatggtgaatcccttggtattagggccatcgatcaccaaacctctacgtggctgccggtacagtttcggttacgccacctgtccgaacctcgaagatcgcgtcaaggtggtgaaactactcgatccgacgagaattcggtgtacaactgtcagaggagttccagcttcatcctggccagtccaccgacgccttcgtcgtccatcaaccgggagcaaactatttcaatgccacgtgaaacgcacacagcgacccggcgaacggtatttcgccgctgtcttgtggggatttccgacggtactacttcgtcgaacacttagtccccggtgggtcgaggccaatagtaggtg

SEQ ID NO: 528570 - DNA, 141 bp, Homo sapiens
gatgcagtgtgacgttcacttagttccttgcgtcacgaggcacaggggatagatagacctgggaaaggggagacatcaaagactgaatgattctgcaattcttttgtcttgccattttcacgctgggctaatcaacgtccc

SEQ ID NO: 528571 - DNA, 351 bp, Homo sapiens
ggatgggtcacaggatgctactcgtggcacctaaagccacatctgccctccacagagcggcacttgcgccatgcgcagcgaatgtctcgaccttctccgatgtccttcctgaagcagtacagcagcccgtagttcttgatcagtgcgttctggttgtgcgagttcgtgtcaaacttgctgtctgtctgcttgaggatctgcccagatccggcggctgccgtcttccagcctccccatcagcgtttggatgccttcctctaggtcctttaggaggttatagtcatcgctgtccgaggtgtcatacaccaggttgttggcgaacatactcctgaggaaccgcacgggctccag

SEQ ID NO: 528572 - DNA, 557 bp, Homo sapiens
  misc_feature (2)..(2): n is a, c, g, or t
  misc_feature (132)..(132): n is a, c, g, or t
  misc_feature (339)..(339): n is a, c, g, or t
  misc_feature (419)..(419): n is a, c, g, or t
  misc_feature (522)..(522): n is a, c, g, or t
  misc_feature (528)..(528): n is a, c, g, or t
tntttccaggcaccgtggaaacatcactgggcgccggagagggtgccgccagtcgcgtggctaagtcttcggagccaacgccggcggttccaacagaaaactccaaaaaagaaagaagtggaagcgggtgcnttaaatcccccactgcagaaaccaggggctgaaaggcacaaaaatgtgttgcaatggcagaatccaggggcagtaacagtccagaacaagaaagcacagggaggaggggggagtaacgcggctccctgcaggacggcctcggctccacagcacaaacggctgcccacagtcctccaggccactcctgaatcccgaggggaatgattncttcagttacgaagaactaaatggtctcctctccccagtcgtccacgttgctgtccagcccgtcagtttccacccctccncgcaactccaggcgctcgtttttctgctccatatagagctcctgggccattctccggtactcccggaaatcttccatcaaggtgcgcctcctctccaccaatncctttnaggctttggacttaattaaacgatccttc

SEQ ID NO: 528573 - DNA, 169 bp, Homo sapiens
tcagccggtaccgcaaaatactatcgttgtattcacggatactctggcaagtctacattcttcaagccgacccgaagtatgttttgatatttaacaaataaaataaaaattaatctaagccatgttattttcaaaaagcggcagacccgagccttcgagtaagctttga

SEQ ID NO: 528574 - DNA, 1284 bp, Homo sapiens
  misc_feature (529)..(532): n is a, c, g, or t
  misc_feature (536)..(539): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (547)..(549): n is a, c, g, or t
  misc_feature (552)..(552): n is a, c, g, or t
  misc_feature (556)..(558): n is a, c, g, or t
  misc_feature (560)..(564): n is a, c, g, or t
  misc_feature (567)..(569): n is a, c, g, or t
  misc_feature (571)..(573): n is a, c, g, or t
  misc_feature (575)..(578): n is a, c, g, or t
  misc_feature (580)..(582): n is a, c, g, or t
  misc_feature (584)..(586): n is a, c, g, or t
  misc_feature (588)..(589): n is a, c, g, or t
  misc_feature (592)..(592): n is a, c, g, or t
  misc_feature (596)..(597): n is a, c, g, or t
  misc_feature (601)..(609): n is a, c, g, or t
  misc_feature (611)..(613): n is a, c, g, or t
  misc_feature (616)..(616): n is a, c, g, or t
  misc_feature (618)..(623): n is a, c, g, or t
  misc_feature (625)..(628): n is a, c, g, or t
  misc_feature (630)..(632): n is a, c, g, or t
  misc_feature (634)..(634): n is a, c, g, or t
  misc_feature (636)..(639): n is a, c, g, or t
  misc_feature (642)..(642): n is a, c, g, or t
  misc_feature (645)..(645): n is a, c, g, or t
  misc_feature (647)..(651): n is a, c, g, or t
  misc_feature (653)..(654): n is a, c, g, or t
  misc_feature (656)..(666): n is a, c, g, or t
  misc_feature (668)..(673): n is a, c, g, or t
  misc_feature (676)..(676): n is a, c, g, or t
  misc_feature (678)..(685): n is a, c, g, or t
  misc_feature (690)..(693): n is a, c, g, or t
  misc_feature (695)..(699): n is a, c, g, or t
  misc_feature (701)..(701): n is a, c, g, or t
  misc_feature (703)..(711): n is a, c, g, or t
  misc_feature (714)..(714): n is a, c, g, or t
  misc_feature (717)..(719): n is a, c, g, or t
  misc_feature (721)..(721): n is a, c, g, or t
  misc_feature (723)..(723): n is a, c, g, or t
  misc_feature (725)..(730): n is a, c, g, or t
  misc_feature (733)..(733): n is a, c, g, or t
  misc_feature (735)..(736): n is a, c, g, or t
  misc_feature (739)..(743): n is a, c, g, or t
  misc_feature (746)..(754): n is a, c, g, or t
  misc_feature (756)..(759): n is a, c, g, or t
  misc_feature (761)..(761): n is a, c, g, or t
  misc_feature (763)..(766): n is a, c, g, or t
tggttttgtcaaatgttttattgagtgtagacatctggagtactgtaaaacatgcattatctgtagattcaaaaaggagcaagccacattgtcctcactgtcaaatgtgtcaggcttggcatacatgatggagattaatgaagtatcatgagagtaatatggttcctgaaaagcttctacaatttggagtagggtcttaatcacgtgaaaagcaaagctgttcacatttagtgaacctgcatttcatggagggggggggggtacacagtattttaattttaaaacaaataaaaataatttgtttgtcaaagattcccatctccccaactttatttgtcgcattggttttcagaaattttaattttttaaaaatcagatgccttttggaagttgtatgtttatctgagcaataactaaattttatttcttcttcggttgttgaggtgtgttaaatttgaagaagataatatctccatcttcaacaatataatttctgccttgttgtctgtactttccagcagccttgacnnnntttnnnnancntncnnnttnaaannntnnnnnttnnntnnntnnnncnnnannnannccntttnnaaannnnnnnnnannnttncnnnnnncnnnngnnncntnnnnccnttncnnnnngnncnnnnnnnnnnntnnnnnnggncnnnnnnnnaaaannnntnnnnntngnnnnnnnnnaanccnnncntnannnnnnttngnnaannnnnttnnnnnnnnntnnnntncnnnnacttctgtctctcctcagcactcaattcttgcaacttgagttccaaggccccactaaaaggaatgaccaaagcacctgggtcatacttgtccacccactctttaatttttatcaaccatttgtttttctttctaatgtagtctttttcagaaagattaaccaagtagaccattggttttgaagtcaaaaataagtgtttattcaacacttcaatctctttgtcattccaatcatgatagaagcgaacaggtttcttttgatctataacccaggattttactttgcacattatatcatattcaggttttagttttttatctcctcctctcacagccaccttttctagtttatctataatgggcccaatcatttcctcatctttaagctgaagctcttcatgtattatttctatatctcgaataggatctacacttccttcaacgtgcgtgatatcatcatcttcaaaagcacgtgttagatgaaagatgccatcacaggcactaatatgagataaaaaa

SEQ ID NO: 528575 - DNA, 350 bp, Homo sapiens
atcatgcctcgtccagaatggtaaggtcagaaccattttgaagtcctttactcaagaaaagcaatgaaaaatattatcaaaatcaactttttcagatctctgaaaatcacagtcatgcaacaatctgaggataatttattcaaataaaatagctaaatatcaataaaaacagcaagtttgtttttgtttttgtttttttttgagaaggaatctcactttgttgcccaggctggaatgcagtggcgcaacattggctcactgcaactcaggtttcaagcaattctcccgcctcagtctcccaaataggtggaattataggtgcctgccataacacccagctaatttttctg

SEQ ID NO: 528576 - DNA, 332 bp, Homo sapiens
gtctcctgagtatcccccctcgcctggtcttctcccctgttgtgtgtccgactctcccttgcctttctctgcatgggatcacctcatctcctaatacttaccttcatgacatctgccatgcaccccgtttccagacttaagccacagtctcaggcttctggtgggtaaggacttagacttgtcttttttgggtagccactattctacctactgcagagtgatgcggccacttgccctgagctccggggctggctgaagccaccagaacccggtatagaggcctgggacagatcctctcctcagagcctccggagggatccgcagccctaccc

SEQ ID NO: 528577 - DNA, 235 bp, Homo sapiens
  misc_feature (4)..(4): n is a, c, g, or t
  misc_feature (35)..(35): n is a, c, g, or t
  misc_feature (42)..(42): n is a, c, g, or t
  misc_feature (67)..(67): n is a, c, g, or t
  misc_feature (110)..(110): n is a, c, g, or t
  misc_feature (119)..(119): n is a, c, g, or t
  misc_feature (122)..(126): n is a, c, g, or t
  misc_feature (154)..(154): n is a, c, g, or t
  misc_feature (218)..(218): n is a, c, g, or t
cccnggctgaagaagtgaattcgggattacagagnaggtagnggcatgcgccccagcctaaagcacngctggctctgaatgctccaccaccaccccctggagttgctgcnggaacagcnccnnnnnctgagaagaaaaggcagaagatggtgtnctgtggggatgggaggaggacactcttctggcgggaagtggaacggggttaaaagcattaaacntcaaggataagatgcct

SEQ ID NO: 528578 - DNA, 112 bp, Homo sapiens
ttacactcagccagtgctgagacccaaacagttatgacatcgggtagggggtgatgcacgtaacatgacctaagcgtcatcagcaagaacaagctggagggggccgcgcgcc

SEQ ID NO: 528579 - DNA, 254 bp, Homo sapiens
  misc_feature (1)..(1): n is a, c, g, or t
  misc_feature (19)..(19): n is a, c, g, or t
  misc_feature (83)..(83): n is a, c, g, or t
  misc_feature (140)..(140): n is a, c, g, or t
  misc_feature (204)..(204): n is a, c, g, or t
  misc_feature (208)..(208): n is a, c, g, or t
ntgctgcccaatcggcacnatgtcgaagaatgatgatgacagcagctttgagatggaaccaccaacggtggtcttggacagcnacctggaagggatcaagacttaattaccttagcagcactgttttgagatcaccgtgngcttagctgtgagaagttccacctgagagactctgaagacctactgggaggataacctcctcantagntccttgagcagatccaccgaggagttggatttgtccgagccttcgg

SEQ ID NO: 528580 - DNA, 377 bp, Homo sapiens
ccagggacattgtggggagtctccacacttcatgtacaacgcgtgccagttgatagatgatggtccagggctgtcatgtgcacgtaggcactgtcttcgtatccctgctcaggttttaggagcagtaagaacaggtaggcttcttcgcctactgacagcagtgcccgcgaccttcagggttcccgatcatgatgggctccggttcctctgtgtctcggcccgttgcagatgcacgtcgcggcgtatggcgtgttgggttcacagttgccccaaagccttttggaacacttgtctttcctggtcagagccttctgggtacttgtacttgtccgtgacgtccatgcgagcattgctgcccaccgccttggtgctgatgt

SEQ ID NO: 528581 - DNA, 331 bp, Homo sapiens
  misc_feature (304)..(304): n is a, c, g, or t
ggtcagctcggacgacactagctttagctcaagcgcaattcctagctttacccaaaactgggaaattgccgtcatgtatgggccacatggcgcaccagattttttcaccaaacaagatattgatacgttctttgccaatgagtttgaaattcactataactcaagccggacaggtattcgtttaattgggccgaaacctgagtgggcacgtgaagacggtggtgaggcaggcttacatccttccaatattcacgacaatgcttatgccattggcgcaattgattttacgggcgatatgccaatnattttgggtccagatggtccgagcgga

SEQ ID NO: 528582 - DNA, 236 bp, Homo sapiens
actagtgtgttcccagcctgttgtctgagttctttccagctagggtggtgtgtcccgggcgtggcccttcaactcgaaggatgccgtcgtcgactcgtcaggatggacacttcgaagagtgccccgcctaggtcaaagatgagcacgttggtctcccccttgcccgtcttgtccaggccttacgcgatggcggcggccgtgggctcgttgatgatccgcagcacgacagcccaaaa

SEQ ID NO: 528583 - DNA, 313 bp, Homo sapiens
atagtgctacacccgggaaccagttatgactgcgccgtcgtcttacactcacgaaaaagctatatcagacaaacatctcagacgcgtcaggaaatgtacaccggtctgaactattctgcccgccatcatcctaatcctcatcgccctcccatccctacgcatcctttacatcacagacgaggtcaactgactccactcccttacctatcaaatcaataggtcacacaatggtactgaacctacaagtacaccgactacgtgcggactaatcttcaactcctacatacttcccccattattcctagaaccaggc

SEQ ID NO: 528584 - DNA, 140 bp, Homo sapiens
  misc_feature (82)..(82): n is a, c, g, or t
  misc_feature (136)..(136): n is a, c, g, or t
ggaggcagaattgatccaggatcacagaatgtccaggcaatggattacggctatgctttatgcactagcattccctccaggncctaatgcagagcagcactcttttacaacattattgtgtaacgcttcctcatanagat

SEQ ID NO: 528585 - DNA, 409 bp, Homo sapiens
taaaaacacagtgccaaaaaaataaagcaaaatgtgataaaatttcaaggaaaaaaatccaacaaacccactgttttggttggagacttcaatatccctctatcagatataatcagttccagcagacagaaaatcaataaggacataattgaacttataatcaaccagatttaatagacatcaatggactgcttcatacagcaacaaccgagtacacattcttctaaagcttacatagaacattcaccaacacagacacattctaagccacaaaacacacctaaacaaatttaaaagagatcatacaatgtctgctatgagaccataatggaattaaactaaaaatcagtaacataactaaaaaatgtcaaaatacttggacattaaataaaatacttctaaagaacac

SEQ ID NO: 528586 - DNA, 320 bp, Homo sapiens
ggactgatccggctgctgccggagtaccaggagctgactgaacgtcgaagctggccctggcatgtggagatcgccacctaccgcaatgctgtctggagggcgaggagtgcaggctgagatggcgaaggcgttggacaagtcaacgtctctgtcgtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggagg

SEQ ID NO: 528587 - DNA, 472 bp, Homo sapiens
tctacacttgagcaaagagctataatcagcataagttatgactggccgtcctcatacagtggggactgagatcagactcgggtgatgaccctgactagtactagataaagcatatatccagcttgatttgagcagtccattgtcagaactggtggagaaggagggttggaaccaggagccgtaaagattagggtggggcgtcaacatcagacaacaggacaagtgtcacttgcagagcaggtctgaagcagcagcatagaaggacaaggacacttgaaggaaagaagcaagggcagcttcctgtgtgctgagagctttcttcatgccaggatttgctctgttagcattcgcacacttggtctaatataatcccacaggcagagtgcttcaggaaacgccagagttttgtttagaccctggacctaccattaggaagctttgtcacttaaggcccgttgtattgcttctgttc

SEQ ID NO: 528588 - DNA, 327 bp, Homo sapiens
gctcgacttttaatttttttgagactaggtctcggtctgttgcgaagcttgagtgcagtggtgcgatcacagctcaatgcagcctcgacctcctaggctcaagcaatcctcccacctaagcctcctgagtagctgagactacaggcacacacctggctaatttttaaattttttgtagagacctaggtctcactatgttgcccagggtggtctcaattatttggtatggaatcaaacaggtctcccaccttggcctcccaaagtgctgggattacaggtgtgagccactgagcctggcctcactgcacatttttgaacaagtgagtg

SEQ ID NO: 528589 - DNA, 942 bp, Homo sapiens
gatctgaaccgcgcgggcgaaccctccggtgtcccgacctcaggctaagcttgatgcatggctgagcgggagcccacagctggagcaggtggactccagtatgcacgctggagaatcgaggaggagagatgcacgtcgcgtcaacctacaagcaccccgggccacgacagaagcatccggggagatcggcaggagcgggacaaggacgacggaggagcctgcgaagaggtacaacggaggcacctgctgggccgcgtggcgcggtttccgcaagagcccgagggtcccgaacgtctccggtgatgtgacatggcccgtgacccttgggtggtgcatgcctcggtggccccggtgccccactggagacctggtatcatgagcgggcgaccgtggatagcgttcatagaagcagctcgtctatgtgctgaatggagggatggtggagctagcggagtcaggcgtcttcgtgaagcgcgcgcgcgctcttcacagagcagtaatcatgggtcctaggaatgaagcatcacatcgtggtcatacctgttcgacgtgacaaagcgcagtcgacagactcacatcctcacatgcatttacgattgcgtagggcgatggtcttgtggcccctcgaagccgagacgagattgtacgtgaagtgcctcaggatttccctcgggtgtgttgagcagaggcagacactaatggggtaatagcgtagaccacgggtggggatggaaacatcaaattggacccatccactggcgtcctacccaagaaggaaagtagaggaaaagacctgagacaacacccagtccctcgcaggcagatggagcaccataagacaggacacgaagaagggactcggtaacgtgagctgaggcgacgatccatgaagagcagcgtccaagggccacacattgaccaggtgagaatctaccccgccag

SEQ ID NO: 528590 - DNA, 107 bp, Homo sapiens
cagccctggacactctgagcagaggcagacaacacaggcgctttgcaggctgctctgaggtctcagcccatcccccaggaggactgggattttgtatgatcaaatct

SEQ ID NO: 528591 - DNA, 127 bp, Homo sapiens
cgtcaagaagtgtgttattatgttggaattcccccccacaacttacacggagctgattgctgtatgtggacgtttctctatagaatctaagacagatctactcaggaatgtcattcccagcagcggg

SEQ ID NO: 528592 - DNA, 275 bp, Homo sapiens
  misc_feature (16)..(16): n is a, c, g, or t
agagagagagagagcncaagagagtgcacaaatttccttttcctctgcctttttgttctatctaggccctcagccgattggatgttgcctggtcatattggatgagagcagatcttccttattcagtccactgattcaaatgccaacctcttctggaaacaccttcacagacatacccagaaaaaatgctttataagctatctgggtattccttaacccacttaaaatgttgacaactaaaattaaccattaaaatgactttaccatagtgaaaa

SEQ ID NO: 528593 - DNA, 104 bp, Homo sapiens
tcacgaggactccctctccctactgtatcctatggtgcgggggcttgtatgattatgggcgtagattagtagtagttactgggttgaacactgattagtggtgt

SEQ ID NO: 528594 - DNA, 842 bp, Homo sapiens
caaccggggtgcagcatagagcaaagtttcttgttgcgcttcatatgaaattgtttgcccctcccgttcctgtggtaaaaacgcctgggagccgtgctgcccctctagttttttccagagcatttgggtgggaagccgcccacgggcagattaataggggtggtctctgccagcaccaccacatcggtgtgtgagagaggcgttttcttcacgagcaagattcacaccaccacatggagggccgaccccactgccacgggtctcgctatcatattccagacccgaccgacgctgtgccgcgggggggcggcatactccccacaggccccgggtgtcccaaaagaagtcgcctcgccggcgatctgggtccagagggtcgccacataagtagcggtccgcccactggattcgtctccaaatgaatggcgtctaatgggagaattatttctatctctccctgattatcccctgcgcccccccctcctcctcgtgagatccacggtggtagtgagcaaagaccgccgtgtctcactaaccttgttttgggtttccactattcggcccgcatcataccgagttcgtcgagggtctcaaactggtctatggtatcgccagaggcgatgggcacacgcttcccgataagatacagatggatactagttagtgggcgcacctgtcggtgttatcttaatctgtgtcgctatgcaccggacttatgtttgataatgagtcttttatcacaccgcgccatttttgtgctgggaagccgatcagtgccccacggacacgtcgcccatacatagtctggcgaaccccttacaaaaaataaacgccacataaca

SEQ ID NO: 528595 - DNA, 592 bp, Homo sapiens
atcgttgattcgtttctatttgtcaggtgcacaagattaccttctctgttttagccttctgtcttgtcaccaaccattcttacttggtggccatgtacttggaaaaaggccgcatgatctgttctggctccactcagtgtactaaggcaccctgcttcctttgcttgcatcccacagactatttccgctcatcctatttactgcagcaaatctctccttagttgatgagacagtgtatatctcacctttaaaccgtacctgatcctgaatggtctgtcatgtgtctgcctttaaagatccattccatctgttcttcgctcctctatggctctaaataatgagggggctaagttatacggcaaagctcagctgtacaaaatatttcctcagtagctatgcagaaaacaccagacaaacatgccattctataaaaggtgtagtttttcttttagaatgtaagctcctcaagagcagggacaatgttttctgtatgttctattgtgcctagacactgtatgctcactaatactgatatggagtccgcgtctgataaaggtaacaccgggggggcggggggggggggggggggggg

SEQ ID NO: 528596 - DNA, 213 bp, Homo sapiens
gactagaggatccgcatcccggttcctgggtataaatgtcagcatcggctggacgtgtgactcacgcctgtaatcctagcaccttgggaggctgaggcaggcagattgccgagctcaggagttcaagaccagcctgggtacacggtgaaatcccgtctctactaaaatacaaaaaaatagccatgtgtggcggcgtgtacctttagtcccagc

SEQ ID NO: 528597 - DNA, 335 bp, Homo sapiens
ggtgactctacaggatccttaatatgctgtctcagaaaaacaaggaagataaaaaaattcatggtataaaataactaaaaattaaatatagtctttagaaatgattttgtttagtataattaatactggtatgacaactgaatgcaaatgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcat

SEQ ID NO: 528598 - DNA, 154 bp, Homo sapiens
tgatgcctcccatgtgattatggatcataacgattgttccacataggtctgcgagcctgaggcaggagaattacttgaggccaggagttcgagaccagcctgggccacatagtgagaccccatctctactaaaaataaaagataaaaaaattag

SEQ ID NO: 528599 - DNA, 97 bp, Homo sapiens
cagcccttcttcaggactctgggctgggaagccctgttggcccggcgcctgcaaccgccctttgtgcccattctgtccgttcgcaccgacgtcagca

SEQ ID NO: 528600 - DNA, 451 bp, Homo sapiens
  misc_feature (12)..(12): n is a, c, g, or t
  misc_feature (36)..(36): n is a, c, g, or t
  misc_feature (50)..(50): n is a, c, g, or t
  misc_feature (135)..(135): n is a, c, g, or t
tgacatggatcnttaccgtttagcgaaactcgacangaatctacaaaaantaatcaagtgaagctaataaattcagccaaagttgtagtatacaagatcaacacacaaaaaataagtggtatttcatatacactngcaatgaataatatgtaaagttaagaaacaattccagtggggggcagtggctcacacctgtaatcccagcactttgagaggccaaggcaggtggatcacgaggtaaggagatggagaccatcctggctaatacagtgaaacctctctctactaaatatacaaaaaattagccaggagtggtggcacacgcctgtggtcccagctaccagggagacagaggcagaagaattgcatgaacctgggaggtggaggttgcagtgagccgagattttgccactgcgccccagcctgggcaacagagtgagactctatctca

SEQ ID NO: 528601 - DNA, 437 bp, Homo sapiens
tcgaactccacacatcatgctttttcagtggccccatgctactccccagggctgtggattttagaggtgatgaccccggacttccctgggcaggcttggaagagctatacccaagtatgcagtcttccttggctttgcctctcttagggaggctcagagaggtcaagggagtgatccaatgccacacagcgctggggtctgcagtacctggctccctggagggcatgtgccatgatcccttctccctggggtctggtggccccagccaagccctaccaggtctaagaacccaggggaccttcccaggtgtaagactactcatgcctctgagccaccgagagaggctttaaaatctcagctccaaattaaaacctatgagctcctcaaaacaatgaaaaatttccctaataaaaggagaggcacactcaaaaaaaaaa

SEQ ID NO: 528602 - DNA, 278 bp, Homo sapiens
  misc_feature (14)..(14): n is a, c, g, or t
  misc_feature (204)..(204): n is a, c, g, or t
  misc_feature (207)..(207): n is a, c, g, or t
  misc_feature (235)..(235): n is a, c, g, or t
  misc_feature (243)..(243): n is a, c, g, or t
taggggccaggggnggaagtgtttgcccttccccaaatctagtttgatgtgtactaaacccttctgtagcaaggatggtggtaggtcttttgttactgcagttgccctgccccgtggctatttggatgaggagtgtgcacttgggcgtttctgtaaatcttgagataaactgtttggagatttcaccacctctctggtgggggnccnactctgtggaaattgtaaatccgttttntttataanacctggcactgtaaacaataaacatttctgcagcc

SEQ ID NO: 528603 - DNA, 162 bp, Homo sapiens
aacctttccttatgagaatcccttttttgggttaaaaataagggtaataatcccttccctggttaatttatagaaattgggcttttaattgtcagttcagttttttaatttgcgggaggtttttccggggggaaaattttttcatgttacttatactaacaa

SEQ ID NO: 528604 - DNA, 241 bp, Homo sapiens
gctgatccgcttaaggggcgctggtgaagcggctcatcaggtctatcaggaaagctgagaattggagtgagaatccagtgtggaaaatcaggaaagagggctggtatgagcgacagagaagtcattcagagaaagaggttattgaattcattgggagaattgaaatgctgttcttgaattttgtatcttaaagcggatcagcgggttaccgaagcctcgaaattcgttaatcaattggtcc

SEQ ID NO: 528605 - DNA, 238 bp, Homo sapiens
  misc_feature (181)..(181): n is a, c, g, or t
  misc_feature (197)..(197): n is a, c, g, or t
  misc_feature (214)..(214): n is a, c, g, or t
ggaagatcctggtggtgatgaatggtcagagcctccctatgactcacaggtttcagctgtccgaaaccaacaggaccctctttctatttggtgtcacaaacgtatactgcgaggacccttatgaatgttgaaatacgtgaactcaggtgagtgccagcacgcagtgacccatgtcaccctngaattctcctccatgngtccatgacctccccangaattcaccgcttcatacaccaag

SEQ ID NO: 528606 - DNA, 181 bp, Homo sapiens
tgacggtccaagctttaccgctactactaaatgctataccaaaaaaaatctgacatctgaaacatttctggatccttagacaagcattgtgctcagggatacgcaacctgtagtacgttctttatcattgttttaagtagtatatatattggtggtacagattctgaggcggtcaaagctt

SEQ ID NO: 528607 - DNA, 161 bp, Homo sapiens
ccataccatgaccagcacaagctctgccctacaatagcacaacccctgtactatacccagcacaacctctgccccaacaaccagcacaacctctgctcccacaacgagcacacagttctgcccctacaacctagcacaacctcccactccaaagaccagca

SEQ ID NO: 528608 - DNA, 299 bp, Homo sapiens
gggaagcaagaatttttaatggcagtcttgcaagatcaggtgcctggtgaggcaggtacacccggggcagtcacagcaggtagtttatctcctctaatgcaagtccctcccccagttcctcactggtcgagtactatggggttacaatctcccgagtcgcctgagtttcataatcccgttgtacgcgtccctaccgcttacaaggtgtacctgtctctaccgcttagtttgattccaatactgaactgctccattatggctgacctctctcatttgtcgtatgtactcaggacggcgtg

SEQ ID NO: 528609 - DNA, 403 bp, Homo sapiens
gatcactatctattgtcccggctggagtgcagtggcatgatcacaacccactgcagcctctacctcccaggcttaagcaatcctcctgtctcagcctcccaagtagctgagactacaggcatgagccaccatgcctagctattttttcttttctctttctttccttccttccttccttccttccttccttccttccttccttccttccttccttccttctttccttctttccttcttttgtagagaaaaggtcttgctatgttgtgcaggctggtcttgaactcctggattgaagccgtcctcctgccttggcctcctgatgtgctgggattacaggcatgagccactgctcccggcctatttctttccttataggattataggatggtcccgcctatgatat

SEQ ID NO: 528610 - DNA, 534 bp, Homo sapiens
  misc_feature (12)..(12): n is a, c, g, or t
  misc_feature (31)..(31): n is a, c, g, or t
  misc_feature (208)..(208): n is a, c, g, or t
  misc_feature (265)..(265): n is a, c, g, or t
  misc_feature (395)..(395): n is a, c, g, or t
  misc_feature (398)..(398): n is a, c, g, or t
  misc_feature (463)..(463): n is a, c, g, or t
  misc_feature (504)..(504): n is a, c, g, or t
  misc_feature (523)..(523): n is a, c, g, or t
  misc_feature (529)..(529): n is a, c, g, or t
tgttgtaccagnccaggttgtatttaatacntgtataagccctatcctcctaaaataattgggaagaaaagtagatatgcctccccaagtgagcagaaaatcctcctagacagatatacaagaaacctattaatagtggtaacccccccctaagagacttgacagatggctggagatcagggagtagggaaagagatgtaattttcanaatcatcctgtgcttttcaaattattacctatgtgcgggccgggcggggtggctcanacctgtaatccccagcactttgggaggccaaggcgggtggatcacccaggtcaggagattgacaccatccctggctaacatggtgaaaccccgtctctactaaaaaaatacaaaaaattagccgggcganggntgatgcgcctgtagtcccagctactcgggaagctgaggcaggagaatggtgtgaacccgggaggnggagcttgcagtgagccgagaatcgcgccactgcactccancctgggcaacaagaagcantccgtntcaaa

SEQ ID NO: 528611 - DNA, 215 bp, Homo sapiens
aggcccgcattgagagtgcacacgatttgtgcgccactccttagacataggctgcgtccctttaaatattgccatctgacgtgcggtggccgtggatgctcctgtctgccgtcgtgtggggctgtgatggatccttgggtactgtcatggggcggtgtgggagatgggggccgcggagtgtctcgtcctgtccctggcctaaagccccgaggagt

SEQ ID NO: 528612 - DNA, 116 bp, Homo sapiens
gtcctttgtgcttctaactgaggcagtggtagctgtggtggtctgcgagacatggtgtggctcatgatgcaggatgagtgatgacgtgtggcacacatggagacaggacccacaaa

SEQ ID NO: 528613 - DNA, 295 bp, Homo sapiens
  misc_feature (120)..(120): n is a, c, g, or t
catgtagggtgctttgcatgcctctgatcatgtgcccaatgccaggagtgccaagagccaaccgctcaggagggcggctgtatctgcagacgacggggctccagattcatcaaattccanggagatgaagatgcaagaacatagtgatcaggtgcctgtgggaaatatccctcgtagtatcacggatgctggctagaaggagcagaacacaaggcagttgcccacgcgggtagaccacgctcagctgtctctggctagttttcattgccagatcctggcgcactggagttcccga

SEQ ID NO: 528614 - DNA, 258 bp, Homo sapiens
  misc_feature (120)..(120): n is a, c, g, or t
catgtagggtgctttgcatgcctctgatcatgtgcccaatgccaggagtgccaagagccaaccgctcaggagggcggctgtatctgcagacgacggggctccagattcatcaaattccanggagatgaagatgcaagaacatagtgatcaggtgcctgtgggaaatatccctcgtagtatcacgacgctgacgtggtctccaggctgggcaatccttgtgttctctccttctaccagcaccgtgatactacgagggat

SEQ ID NO: 528615 - DNA, 112 bp, Homo sapiens
tgcagctgctgctgctggtcgcctctgacgattccccctgcttgtcctgctctggacgtgttgtactctcgtgtagcacaagagtatttctacatcccacagtgcaaagccg

SEQ ID NO: 528616 - DNA, 392 bp, Homo sapiens
ggaaggtcccccggggaggagttcgatgcagcagactctcggggcggtcggcctggccttagactctttgccaccatcgtggacctcaccatctggacaaagcagccctggcccaggttctgaggcccgtggtatccatggaggcccttcccgcattgtccccaaaggcacagcggctctgagaaggtgccaagactcttgtcttcgccagtaataggccttctggagaaacttctgtaccagctccttcttgcagtgggccggatgtatcccccgagtactaccaagtctggtgcccatgcacaatctcagcttcctgtcaagaagctcccatcggctcggcatgccaacctctcagcttccatccctgtgacctcatcagactcagatca

SEQ ID NO: 528617 - DNA, 1333 bp, Homo sapiens
  misc_feature (506)..(506): n is a, c, g, or t
ggcagcctccagaggacaggacgcagtgacgttcttgcccagtgatgagtcgtgagtgtgtggcagtgcagctgtgtctcctgtgtggccatgcatgcatgtggatgtgcactcacacagacatttgtttgagccattgagtgagccatgagtggtgcaagtgcctgccatgtgctgtgtgggtgacaagcatccatgacgcacgagctgctgcagttccctggacatcctcctgaactcatccccagagaccacaagcatgcactcgcagatgtgacatggactgcacgtgacgttacattgcaccagtgactgctagctgcgcggacacaccgtgtgagactgcaatgtgcccacgatgcaagtggtggatgctgcacaatgatccatgtggggcacacaatgtgatggacgcttggcatgacagcaacacattgacatgactgactaggacgaacggacgccagtgacagtcgacatagaccacgaaccacagtgaacccagntcacacagggagccagagtacagccatgaggccaagaactgaggcagcgatgaacgcccagactcatcttgcacagctcgacaacattgcgagaaaatttcggaacaactcagatgacgatatcccccgaaacctccctgaggactgggcacgacatgctactcgcgagagacgaagcataacaaagccattcatgacagcttctttggcgacgatgaatggagacagtcctgggaccagtgaccatgaccttggaactccccaagcaagcgaaggcggtggacttgcctggaagcgcggggggacagtaggaccaccatggcaggttggcggtcacgaacgtgagagcacgatcatggtgactagccacgatgacacgctggacagcatcggacgtagaacacaaccaccggaccaacatcagacgtgattgagcaggaggccgcatgaagcaacttcacacagcactaatgacccgagcagtggtccagcaatacagcataagcgcccagaagcagtgacatatccatagaaaaaggtaacactaacagcatacaaacagagtacctcgactccatagaacacgaaaatataacaacacaaaacatactaaaagaaaactatacatataaaagcaaatacacacaatgccacaaccaaaataaatacacatcactacacccaaccttacaacaccaaacacaaacaaaatcacaaaactccaccacccaaaaatccacctaatacaactaaaacacactaaaaaaatcaaagcaaatatacaactacaaaaacagatacacttacaaaccactatactaataaga

SEQ ID NO: 528618 - DNA, 401 bp, Homo sapiens
aatccttcgatatccaaagcatgacaaaaaagaataggacactaaatggatataaacacaccaaaataggaattgagcttattggcaacttagtcattaagtcattaactttaagccaactagtatacagtacattggtttaaagagatctagctttaggtgaactagtttcaagcaaactgactagtatcaaatcagtgtatcgctccctccagttccccccaactctagttttgggattgtgatggatgcgatccgggacccctctgagaggtggcaagtgagcttctactaggaaaccaagtgtaccagtgacctgagaagagagtaagaaagagtgcgagaagagacagagagacaagagcgcgagtgtgtgtatgcataaacacacgcacacatgc

SEQ ID NO: 528619 - DNA, 1091 bp, Homo sapiens
gagctgtcggggacggcttgaccgggaccgggtgtgtgctcatgtcggcgctcgctcctaatccctgtagcgcactatgcgtgagtgcatctccgatccacgttgcgccagggctggtcgtccatgatcgcaaaagtgcctgctgggagctctactgcctggcaacacgggatccagccgcgagtgctctacatggccaagtgaccaaggaacaatgggggacggactactgaagtccgtctcaaacaacttactctacacatggaagatcgggaacgctggcaatgcaacgtgccacgaggcgaatgtgtgagtacgtacttggtaactcacagtagacctggatcgaggtttctgcatatggtctgactagccgatcagtgtcgttctcagcctgaagctatggtccatcaacacgtgcacatggaaagatgtcttgcacagaatagaagtaatggccgatgggtgaagtacactccaattggacgactggaagatacatatgagactgggtgctcgggattctgaactttcgacggcagtattggcctgaaccacgatgacacgcggatcgtatcagggactatcctttggcctgaacccacaggtgtagtgtggcgggttgaacctgggtctgggttacagcgaccctgctcactgggagcgtcctgctcaattgagtatggcggaaggaagtccaagctgcaggttgctccatttacaccaggcaacccatgtttcacatgatggagttagagcccctacaagtccagccgtcaccacggagaaacaaccctgggagacactcgtgatgggcgaacatggaaaagcaaggaggccactagacatctgccgctagaaacctcgagatgagcgccaactacgtactagcggaatactagccagaaggtcgccacacggatcccacgatggggagcctgacgcgacggagaagtcgacaaccgggcaacccgagcagactcggcaaggcggcaccaggagaaacacacgacagaatgccacacacgggctagccccaagtaggcccctcaacccgcgggcggcggccaaacagcacaattgggtgcgcg

SEQ ID NO: 528620 - DNA, 687 bp, Homo sapiens
gtcacacaatcgtaattccaaaagccattatggataataaagggtgtaaagccttcagatatttcccccaaaaaaaaaaaaaaaaacaaaaaaaaaaaaagaaaaaaaaaaagagagaagaaaaaagaagacagaaacgaaaagaaaagaaagaaagaagagaaaagaaagaagacagaaacaagcagaacagagagagagagaagacagacaaagcaagagcagaaggagggagggggcgaggggaaggaagcaggagagagaagaaaaaaagaagacaaagacagagagggcgagcggcgcgcggcgccagagacggagagagaacagaacacaaacagacacgaaagcgcgagagtcggctcgcgagcagacgagaaagaaaagcgaagaacaagacaacaacgaagacgaagaggcgcggacagcaagaaagagaagccagcgaggaaggggagtgaaaagaggagtagagacggtacattgtaagtaccacacaaacaaacgaacaaagaagcggcgcgcagagaaacagacagcgagataggaaggggtggccaaaaaaagcaagcgaggccgacaccgagtgatgaaaaactaaacgatacttaagacacgcgaaaggaggagagacggagcaaacataagataacataaaaaaaacaaggccggcgcgagaggggaggg

SEQ ID NO: 528621 - DNA, 386 bp, Homo sapiens
aattacaatatacactaatcatcgtctggttacgcgtcgtttgcagtacattttagaaaaccgaattacagccttaaatagtatgtggacctaatacccagaagcacccccctttgtaagattgtaacaaaaattaattatgaatggagtaaatagttcttatggagtgggggacccaagagccatatcagtgctagcaaaatgggcagaattcataatagcatcaaacgttgccccttgcaagagctttcggtgccctaaatgatgtctaaaaggacaatattgaaaactcccttcagccgccccaaaggacagtgtttacagcaaattaatcagaaaaaaaaaaatccggccctccatggccctcaagcgggaggaagcttagg

SEQ ID NO: 528622 - DNA, 1575 bp, Homo sapiens
gagaagaaaaactttcgcctgagacctatttaggttgatactgcctctccaagacccaatggaaacatctggcatgtgcccctgcagcacagacagacctgtgtcaggctttctctgcatgtcaattcttgccagtcaaatgcatgtggcatgcagcaagcatggcagctcgcatcccacaaccctttgtcagtgcaatcatgtgcacacagcatcatttcatgctctaatctgcagcacaacacttcgcaggcaagcagcacagccagtccagacccaacaatcacctcacatagggtcagggcacagtcactaggcaaacaccatcgcagcagcccatccgtcaattccgactagagctaagataacaagaatttacaaaactcgaccactatcacagagatatgctctagcaaaggacgaacgcacatagtaacactcgacctagatcatacccactatacatatgacatccgagctattcaatagacacgcaaactacaatatcgatagtatgccacaaaggcactacgacactagaccttagccaagcccctcgcgatttatgagattgcatacacaactggaagccaaatctggatatataattctggcccaacggaccaaagcatcactgccaacagcacacaatgatccacccccatgcacagccaaccattcgggcacgaaccctttggaccttcttctaggatagcacctcgaacccaacaacacaattatagattccgcgttaagcagtcaaccacccaaacaagttaaaagcacgaagaagtagggcacaaacatgaacacggactcacatcaacagcaagacttctaacaacaaccctcacaagcagatccatcggggagcttccgacgaacatacctaacccaatttttgacaacctaacaccatatcccagcgaaagacacccattcctacacggactttagggcagcaagggagtccgcagttatccagaagcacaaacaaataaaatataggagccaacaagtaacccttgaaatggtaacacatacacataaattggtaggaggaaagtacatgaacaaatgggtagtcgacataatgcccatcccgattcaataaaacaataggaacgcaaggacacaaatataaggccttagcacacttgcaacaacttactgaaataactgacaacaattgcacaacacaaaacattctatccaacatttcccttaatcacataatcactgtaaaaaaatcacaatacttaccaattaaaccaacacaccatggattcacaacattgttactaccctgcacaaaccaacgcggcaacatacaccatcccacctaacattgtcaacagactcacatttctacacatagaaccataaacagatacccacacacccacaacaacatctgcaacatataaaacttcccacacgtccaacagcacacatagtaagaacacaaacacaatcaccaaaacatccacagcacaaataacataacacatactacacagcgcccacatcttcaaccccaaaaactaccttcgacatacaccttccacaacccaa

SEQ ID NO: 528623 - DNA, 493 bp, Homo sapiens
  misc_feature (208)..(208): n is a, c, g, or t
  misc_feature (377)..(377): n is a, c, g, or t
  misc_feature (411)..(411): n is a, c, g, or t
  misc_feature (419)..(420): n is a, c, g, or t
  misc_feature (430)..(430): n is a, c, g, or t
  misc_feature (449)..(449): n is a, c, g, or t
  misc_feature (457)..(457): n is a, c, g, or t
  misc_feature (462)..(462): n is a, c, g, or t
  misc_feature (482)..(482): n is a, c, g, or t
  misc_feature (490)..(490): n is a, c, g, or t
  misc_feature (493)..(493): n is a, c, g, or t
catcacccttgcaacaaccaccccaaaggaaaagagacgctgaacagtttaggaaagggctcgcgtctaagacatcaagcgacatacagagatgtgcaaaaacttggtgagaattaaaattgacctttggaagagggtaggggcaggatgttttatgacacttgtagaaaagacaggaggaacccgctgcgatggagattgggggganttggaagcaagcagccaacaggacagagttccagaactcatgcagatggggaagaggtgacagcccttccccactggcctcccccgtggaggtggagtagacagacccggaaagcagaaaaggccttcttcttccctgttcctaagccgtggtaccctagcctatgaantgaagctatatcctccaatcccaatttccattcntgtaacannccattcaggnttcctgagcaaatgggacnttccgagnagttnaactagacttggctaagccngctgggcntcn

SEQ ID NO: 528624 - DNA, 344 bp, Homo sapiens
  misc_feature (39)..(39): n is a, c, g, or t
  misc_feature (55)..(55): n is a, c, g, or t
  misc_feature (70)..(70): n is a, c, g, or t
  misc_feature (78)..(78): n is a, c, g, or t
  misc_feature (340)..(340): n is a, c, g, or t
  misc_feature (342)..(342): n is a, c, g, or t
gtggctcctacgtggttgaaccggggccctggagggcancgtctgggggctcctnccgtggctcagtgancgtggcanaggacaggtctacacgggccaggcgctgtgttgctctttcctcctggggtagggactcctgtggctgcacaggttgcccccgcccacctgcttgtgttttctcagcccttcttgttccaggtcaggatcctggccacctgcaagggctgtcctttgccttagccatgagtgatggccctggccggtttctggggcatagaccttgggaagcaagtccagtatggggacccagggcagcctgggggggtgtttttatttggantnaa

SEQ ID NO: 528625 - DNA, 110 bp, Homo sapiens
agttatgtatcatcacacgaatagcgtacattagccattaggtaatttctattttcttttctttttttcctgaaactgatttatcatgtctttcacccaatcctagggat

SEQ ID NO: 528626 - DNA, 172 bp, Homo sapiens
agtctccggatcttacgccgtacagttgcgctgcctcagagttaaatgagtactgcggcttacgtacgagcgtgtgtgcagagacagctgggtttgactggctcagagacactacactgggtccatcacacaatcagcaactgaccacccaatacgcaactggtacggcggg

SEQ ID NO: 528627 - DNA, 451 bp, Homo sapiens
tcacagacttctccgcgctgagtccagctgcaggacactcaagatcctgtgcaggcatggatgtaatccgggttagtgcttagcctcctcctcctccttccagcctgttcccggaaagaatacttctcgtcgtccacctgcttgagcttggtgcgcaggctcagcttctggcggttctcctcctgcagcaactcctgaatgttctgcagctgggactccagcgcggagacattccttggtgagcttgttggacttgctcgtcggatctgggtaacactcctcggtcacgttgtccagctccacctgcagcttggtgaccttgtcgggcagctctgtgcgcacgcgctctccctcgttgaacttgagctgcagctcctgcagctgcgcctccactttcttgcgctcgtgctccgagtcccctttgccctgcagctcgcccctgagttgggta

SEQ ID NO: 528628 - DNA, 410 bp, Homo sapiens
  misc_feature (5)..(5): n is a, c, g, or t
catgnaagtacatggtgatggcggtggttgcctgaatctgcatgcctggcaggatgctcaggattatttggcctggatcgtggagtccggtcagatggagcaggcgctgtatcaggcactgcaagtatttggagtgccctggattgaagaccgctttgagcgtctggaaggccataccatcgtcacagccgggcaaaagcgcatcagcgctgatttgttcgtgggggcggatggtgcccgttccggcctgcgttctgcggccggcattgagcatcaggggcgcgagtacggggatgccgggctggtggcccacttcaacgtagaacgcccgcaccagcaagttgccttgcagtggttcacgggtgattcgattcttggtcgacgcggccgcgaatttagtagtagtaggc

SEQ ID NO: 528629 - DNA, 193 bp, Homo sapiens
attgccactgcgaaccagccggctatcgataaggaatggaacgattgcgacgagccgctgcttggacgcggggattgtatgacggctgaagggcactgggaagcagccttagcggaccgcaccgctaagcaggcgacgaaggacgacgaggacggtaaggaggttgttcctccggggtacacggtcgttgatg

SEQ ID NO: 528630 - DNA, 107 bp, Homo sapiens
atgtacaagtctcaggcagctccatacctctcatgtgtctcattagtatattattattatctaagttagccattaacttgaatttcactactaaatattataagagg

SEQ ID NO: 528631 - DNA, 273 bp, Homo sapiens
ttatgtctctgctagtgatgtacagcacgcatggtgctggtcatctgctcagcttccagggtaggccttcaggtagcttatgaccatgcaaaaggtgaagggggatcagacatgtcacgtggtgaaagcaggagcaagaagggggcaggcggaggtgccacacaattttaaatgaccgtatcttgcaataattcaccatcaagaaaacagcaccaagccaagccacggtcaacccacaagccacggtcaggccacaagccacggtcaacccac

SEQ ID NO: 528632 - DNA, 426 bp, Homo sapiens
tgctagctccctcttcacagaccctggcagccgccattctactttctagtctctatgaatttgattactctagtaatcatataagtggaacactagtatctgtccttttgggaatggcttaattcaattaagcatcatgtcttcaaagttcatgcatgttgtagcgtgtgtcagaatttccttcctttttaaggctgaataatactccattgtgggtagataccaccttttgtttatccattcacccatcaatagacacttgggttgcctccacctcttggctcttgtgaatagtgctgtgatgaacaatagatgtgtaactatctctaggagagcctgctttcaattattttgggcatatacccagaagtggcatttaatgagattttcttaaaagtaattagcagatgaattcacctgcagcag

SEQ ID NO: 528633 - DNA, 295 bp, Homo sapiens
ctgcggtgactctagaggttcccgattttgacgcgttctcctccatgataggagcagatggttttcgagaaaaatgtcttcaacaagaccagcggactgagagtgagattgcttttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgcaggagaacgcgtcaaaatcg

SEQ ID NO: 528634 - DNA, 343 bp, Homo sapiens
ggatgggttggggaacggggagtcccggcttggctttttctggtttttgaaagggacatttttatccctactccccttggtccccaaccccagttctggtgaaaatgtggatgataatggggccttgatttccaaatgaaaacagctttattggttaactttattggacataggaaacacgttcagtgtaaaagtgtaaaggggaattcagggttaatgctgcccctaaaaataaatgctaatgaaacttgggtttataaccttttgatcctttatttttgcatataaatataaatataaacaaatatttttggtataacaataaaccgtttccatccttgga

SEQ ID NO: 528635 - DNA, 199 bp, Homo sapiens
tctactttgatcaccaccctagctgttcctttctccagaccaccttacttttcaaacttgattcttgctatcacagctctctgtaacatcagttaaaatcagctgcctcaactctttgaggatgtttgtgcataggccggctttgtaaaacttaccgctaatggcagtcttctagcaaaaccagcatatctctggccaa

SEQ ID NO: 528636 - DNA, 412 bp, Homo sapiens
acgacaggaaagtgcatgcagttacattgagttgtgatggctgtctgtttgaaaacaaacaagcaaatagtactgtcatttgaagagtataatcttcggtaacacatatattttgttgaaggtctacgctgtgcaagacactatgtgtgaataatacttccgaagatagtagttaccttttgaacttttctgtggcggtaaaaaggaaaaagtctcactgtgctgagcttgaaagccctctttaaaatcgcaaaactgagttcaaagcctgtatcatacagaaaaggtgtgcctaaaagaacacatgttctcatatgtgtccaaaatacaagaagatctggcttttgtagtcttgtaatattcatactgtgagcctgtgtttttgaataaaaatgctttctaatctccaaaa

SEQ ID NO: 528637 - DNA, 215 bp, Homo sapiens
  misc_feature (35)..(35): n is a, c, g, or t
gagtgttcctgccatgtgggtccagtgttggtctncttttcagcatcattcctgtctctaatagaaagtgcatattcaaaatggtcttcaccagtgggtctgctcactcgctactgaaagtctctctagatgaatatgtttgtttatagtcagtaattattttatatttactagttcttttttaaaaagttttcctagtgttaatataatcatgt

SEQ ID NO: 528638 - DNA, 128 bp, Homo sapiens
cactatagacatctgattagaaagactgaatattctgaagagaaagagaacaaagaaaaacatactcgagaattcctaatagaacacttcagctgaacctaaaatggtgagcgagagtcaccatgagg

SEQ ID NO: 528639 - DNA, 755 bp, Homo sapiens
aattagccccctattaaaaattaattaaccactcatacatcgacctccccatccccatccaacatctccgcatgatgaaagcttcggctcttactcctatggcgcctgcctgatcctccaaatcatccatcaggaactattcctagccatgcgctactcaccagacgcctcatccgccttttcatcaatcgccctacaatcactcgagacgtaaagattatggctgaattctatgccggcgtacctgtcacgccgatggcgcctcagtattactttatcgtgcctcttcctacacatcgtggcagaggcctatatttacggatcgatttctctactcgagacaacctgaaacatcgggattatcctcctgcttgcaaccatagcaacagccttcagtaggctatgtcctcccgttgaggccatatatattcattctagaggggccacatgatgaattacaaacttactatcgcgccatcccatatcattgggacaagatcctagttcaatgactctgaggaggctactcagtagacagtcccaccctcacactgattctttaccttttcacgttctatcttgtcccttcattcattggcagccctagcagcaatgtccacctgcctatttcttgcacgacaacggggatcaaacgaatcccctaggaatcacctcccattccgataaaatcaccttccaccttactacacaatcaaagacgccctcggtttacttctcttccttctctccttaag

SEQ ID NO: 528640 - DNA, 225 bp, Homo sapiens
  misc_feature (3)..(3): n is a, c, g, or t
gcngttttggtgctgctgtgcctgggtgcatgatatgtctgaaacccacactgtgctttctgagtgctgcttccactccacacccctgctcatcctgcgaaacctgtgtgtgggaggcttttccactccctcaggcaccgcagcccaaacctctggctcacaccagcaccaatgtcattaggctggcagccaactccatcccctaggtctcaggcactatttttt

SEQ ID NO: 528641 - DNA, 1334 bp, Homo sapiens
  misc_feature (362)..(362): n is a, c, g, or t
  misc_feature (375)..(375): n is a, c, g, or t
  misc_feature (663)..(663): n is a, c, g, or t
tagattagctcacaggagaccttagcattccaccgcataagcctgatgacaggtcccctttcctctgagcccagtctagcgaatagcggaggggaacgcggcttgatacacgccgacgagttccgcgatcgcgcaaagaagctggaaagaggacgctggcacaagctcagtcagcagagattggttggcatctcaatgtccggatgttcagagtctcacacatgcatgaattaccaacacgctcctaggcatagacatcgatgtgcagtgtgattacacagatcagatgtaattctcaccaccagaatgattcgatacctcagaagagtcgaatcgttcagtgcgggctcgctcaggtcggngcccccgtgaggngacacacctccatgacagagacatgtacagacgacaccggacgatgtcaatgtggctcacaggaggtgtaatgagatcctggtggtgacaacggggtctgatgacgaacgaaggggaacggattgggccgcaatagagcatggccggagacatagttagcgcaagcgagatacgatgcagcctgagttcacatgcccatgtgattaacttgcccgaatgaccaatggcaggaacgtcgaaacacagggctagggagaacatgcatgcaggacaacgagtccatcgaangcaggggataattcgacgacctccatgagtgataccaggaaatgagatcatacggacagaatgcagagttcgggaagattgtggtacgcttaacagtgggagcaccattcgggaaggaccgaataagaagggatgtcttaaaggaccccgtgagcacgcacgctccaaaagaacccagcaagcaatttaccgaactacccacaagggggtggtacgcaagttgttcggcagtgtggcttgggacaacatgtggcttccgcgacatggtccatgttccaaaacggccctgggtgaatccatcgaagtcaagggctcagcgcttcaaacaccggattggcgtaccgcaaattgtgtgtgacccttcattgggttgagctctggggtgacaggcaccttgtgccacagcccaattctagcgggggggcccaacgcatagggaggcgctgttgagccaaaaggcccccggggacaacaggcaggcatgcaccaggatagacccgcggaaaaaaagcgacctcacagcaggagacccaaggttacgcacaccgaggggacacacggggaaaacatagacagagaaacaaggaccaccaagagatacagagaggggataggagccacaaagccacaagtggagcgacaagaccgagggcgaacagcgcagagaagaa

SEQ ID NO: 528642 - DNA, 604 bp, Homo sapiens
  misc_feature (227)..(227): n is a, c, g, or t
ggggggagggcggaagaaccctgaggtttttcctcacatttctgtcccatttttggaacctctggatttaaagaaatgaaaacctcaagtttgtggagattttaagaaatggttattccaatggaaacagctggagaacttatatttccgtgagaaaaaatttgctgttgaagttcatgatccacgaaggatttcagtttcaagaagaacctttgggcaaagtggcntgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggaggcgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggct

SEQ ID NO: 528643 - DNA, 708 bp, Homo sapiens
  misc_feature (35)..(35): n is a, c, g, or t
  misc_feature (331)..(331): n is a, c, g, or t
tactgtgaggacagggtaattgagcattatttganaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcntgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggaggcgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggct

SEQ ID NO: 528644 - DNA, 126 bp, Homo sapiens
ctccggatctgacacgtcgcacagctcatccagaaatcattattatttaatacaaaagatttctggaatgagggaaatgatcagtccattttagcccagattagcagttggcagtgctgatacttt

SEQ ID NO: 528645 - DNA, 120 bp, Homo sapiens
  misc_feature (39)..(39): n is a, c, g, or t
gtgcagactgctgtattccaaactgggcactgggcgtgnttacatgtggcaagagtgaatcaatccttggcagggcatcgagtaccagaaatcagaacacatgatccgacaagcataaat

SEQ ID NO: 528646 - DNA, 1412 bp, Homo sapiens
  misc_feature (1053)..(1053): n is a, c, g, or t
cggtgctggccgccgccgggagagcccggggcagagcagaggtgctcattcagcactgtaggcccggaagattgtgtggtcccgttcctgacccggtcctaatggtcccttgatcttgcagctggactacgcggcaacctacctcttcttccacttagttgcatatcatgccgtatatctctattttattggtctatctcggctgggagcaagaatgacctccacctaaccagatgggctggaagtgtggtaagcagcacagtagcttgcgacctcaagacatctgtgctctgctatgctccgtgatacgtcagtttcagagtgcgttccacaggcccaagtaagcgtgggcaagaattgcttcatgtgagtttcaagcgtgcagagaacacagtccacgtgacactatcactgagtttgcacaacacagactctatgacacgtttcgtatcaaaagacaacgtgtatccctgttttcgcgtgagtacatggtggagcagatacaaagaacactcttccatagcctcggcgacctattgtggtctctgtggctgggtggagagcctccctaatcacccctgaaatcactgtgccagagtactccgcggcccctacgctatctcctgtgagaggtcagcgtgaagtgtgcgcccgtgtccaactagactctgcgtttaccctgggttacccacgtgcgagtctcacccgcggcgatagaccccttgtttccgaggcgaaagggcttgttcagagagaagcggtgggttccgtgggacacccctcccgcacgaggggttgccttctcggtgcgcccgtcctacgcgtgtcccttatacacacaccccattacaaacgcctacgtacacccccatgccaccccagggctcacttccgactgagatgcggaggacagggggcgtcgtagtccaagctcgaaaataggaatgccgcttaggaacgggagagggacggcgaacgccttgggggcttaacccctggtatgtctaaagaagggtacaggcgaaaataattgttgccaatcaaagttggccnttcgcggttataccatttggccactgtgaggacgaccgtagcatgggggggcccacttaggggacaataccggattatgttggcaccccgccctcggcctctgtgacggtggccccccccctaggccgatggatagatatccccccaagagttgtgtttatgccccttggagatgtcgcatgtttggtgccaagcgaacaaacaggggatagcattctgtgtgtgtcctaccaattgtcccagcccaggaggtgttgtcccccagtcacccaattgtaaccggtgcgacacggagacgtgggtatccccccccacccactattggggtgtgacaaccacatcacatattggtgcagatg

SEQ ID NO: 528647 - DNA, 149 bp, Homo sapiens
ggatgcatgatgtgtgcacgagtgtggatatacttgcctgttctgggggtgtacgtgtgttgtgtgcacacaggtgaacctgtacagtgatgcatgcgtgcccagggagtgtggatatacttgcctgttctggggttgtacatgtgtgt

SEQ ID NO: 528648 - DNA, 105 bp, Homo sapiens
ggagagagaaacaggtcagactcattcctagtacatttactaacatatattgagacatgaccatgatgtactggactaatcttaacttcgtctacagtctagata

SEQ ID NO: 528649 - DNA, 196 bp, Homo sapiens
tctagctgatcccttaggatactcctgctgctactcctgctgtacagaatatacaaaaccacaatggagcatgtgtatatgtggccaatgtcttcatctacattggtactgagataaaccatactcattgtctaacatgctgacgaaatcatctgagggggagggagctggatgctcagttgtcccatcacacgga

SEQ ID NO: 528650 - DNA, 576 bp, Homo sapiens
atgaacttgacccatatctctcatcatatacaaaaatcaaatcaaaatggattcaagacttaagtagaagacttcaaactatgaaactactaaaagaaaacagtggaaaaccactccagaacattggactgggtagagtactagagtaataccccacaagcacaggcaaccaatgcaaaaatggacaaatgggatcacatcaagttaagatgcttctgcagagcaaaggaaacaacacagtgaagagaaaacccacagaatgagagaaaatatttgcaaactatccatctgataagagattaatatccagaatatataagaagctcaaacaaatctatatgaaaaaaatctaataatccaatttaaaaatgggcgaaagatctgagtaggtattactcaaaagaagacatacaaatggcagacagcataagaaaaggtgccaacatcactgagcatcagaaaaatgcaaatgaaaactacaatgagggccgggcccgttggatcatgcctgtaaacccagctactcagaaggctgaggtgggaggactgcttgatgccaggagttctcgagacccg

SEQ ID NO: 528651 - DNA, 86 bp, Homo sapiens
  misc_feature (47)..(47): n is a, c, g, or t
attcaacgcttctaacagatgtacggggaccatgtcttatatgaagntttgaatgttaaataaattgtatattcactttaaaaaaa

SEQ ID NO: 528652 - DNA, 318 bp, Homo sapiens
ggcccgggctttcctcagacctccccagacctgttttttcatcagcccccgctgtttttttttgccggacgatgggtgcatctttcgggcccagtggaccccctccccagccctccctgaaccgttttcctgagtccctgagggcagacccagctccaggggccccgggcagatgccccccccccgaccctcctgctgtcccctggccttaggtcctgccagttccccagggtccgcccctgttcccttccctggcctcccctttctggggtttgtggctggctggggattaaaattaaagccattgtggccccttga

SEQ ID NO: 528653 - DNA, 287 bp, Homo sapiens
cacgaggccaaagtagactccttcgactgtatttagtttggccttttcagctttcttcttgcccagctctgtcgaattcatgggtgtgtgtgcacatgttggtttcacacacccatagtgattttgcgcacatgtcagtgctttttaatttctgcttgaatgttatgtcctgctgtgttgcagcatctaaagacattgtcaccgagtgtgtgtgactcaacgataatgagtgaggctagactgcgaacccaacatcacctccatcatggtaaggtgttggcgctgat

SEQ ID NO: 528654 - DNA, 388 bp, Homo sapiens
  misc_feature (19)..(19): n is a, c, g, or t
  misc_feature (59)..(59): n is a, c, g, or t
atagggaccctgtaatganttaatgcctttaaaaagaggttcctgttttggatgtgttncccagtatttgtttggaagatttaagagccccctttcagcagtttttgtggtggtggtttggtaatggctgattctctcagcatttgtcagaaaacgactgtatctttccttcatatatgatacttagtttcactggatacaaaattattggctgataattgttttgcttgaggaggcgaaagatagggccccaatccattctagcttgtagggtttctgctgagaaatctgctgttgatctgataggttttcctttataggtaaccttgtgcttctgtctcacagctgttaagattctttctacctctggaccagcctgctagcccac

SEQ ID NO: 528655 - DNA, 307 bp, Homo sapiens
aatgtatccgtatcttcatacctggttctggtgtgtagatttctttactggcgtctgtacctcacaccaacatgcaggaataccttattgctgataatctgctagccctcgacagctgctgatttgcttgcagcacgtgcacctctgcgtgtaccaccttggcttttcatgctatcgtcattcacatcgtccgttgttcatgcacatccatccatatccccacaatctttcacacatcatttccattaatatcccataatcatccagcttccaaggttgcctgcatagcacagcattctctctccat

SEQ ID NO: 528656 - DNA, 939 bp, Homo sapiens
agcccccgtgactgcacctggccatggcgcgctggggcccctgtggctgctgttgctcggggtcctgctggctggctgcacccattgatgcccagtgcggagtgtgcgcttgtctgtacccccgctggtggatggtgatgcgaggaaatgtctgtcattctggactgcacccctacgggaacccacgaccattatatgctggaatggttccttacctgaccgctcgggagctcgcccccgcctagcctcggctgagatgcagggctctgagctccaggtcacaaattgcactgacacccggggccgcagtcccccatagccatgctggactcccagggacgcctggttgctgggctgagtgcccagtgtgggctgacaggatgctgagactacgtgtgcgtggtgaggggcaggggctggcaaggcaacttgcttgaggccacctgcgcggggtcacacgtgttctgcaaagccagaggccactgaggtctcccccaacaaaagggacactgtctgtgatggaaggacttctgccccaggacatcgccacctggaaacatgccggaaccgggaacccgggcccccaagatcacgttggtatcggaaaccgtagcagtgagccttgagagtggtgcccgttaacaggactaaacccacagatggggctacattgaccaaacagcaacggctccagggaaggtcaatcggagacattgcttcttccccctcaaaccaagtaaccacatcttaaccttgcgtggacttccaggcaaatgggattagacccgaagaacgtagcaagggcttacccaacttgagtagccggaccaacgtaaacacggacctagcacatgataggacaccgagacacagtgacctaggcctgtggacagagcacacaaacctattccaagccttagcaccatgacaactaatccg

SEQ ID NO: 528657 - DNA, 112 bp, Homo sapiens
gaaggagggttcttgcttgttgccaaaaaacctttaagaaaaagcggagggattttcgcagagctgtaagatcaagcgccttagaaagaggtttgcccaaaagatgcttcga

SEQ ID NO: 528658 - DNA, 333 bp, Homo sapiens
tctgtgtggacatcagctcctgctttggtatactgatggcagcagagactctgactgaactggaggcggccattgagactgtggtctctactttcttcacctttgcagggcgggaaggacgcaaaggcagcctgaacatcaatgaatttaaggaactggccactcagcaactgcctcatttgctcaaggacgtgggctctctagatgaaaagatgaagaccttggatgtgaatcaggactcagagctgaggttcagtgaatactggagactgattggggagctggcaaaggaagtcaggaaggagaaggccctggagatccggaagaagtaaa

SEQ ID NO: 528659 - DNA, 759 bp, Homo sapiens
  misc_feature (39)..(39): n is a, c, g, or t
  misc_feature (64)..(65): n is a, c, g, or t
  misc_feature (67)..(69): n is a, c, g, or t
  misc_feature (81)..(81): n is a, c, g, or t
  misc_feature (116)..(116): n is a, c, g, or t
  misc_feature (130)..(130): n is a, c, g, or t
  misc_feature (137)..(137): n is a, c, g, or t
  misc_feature (140)..(140): n is a, c, g, or t
  misc_feature (151)..(151): n is a, c, g, or t
  misc_feature (210)..(210): n is a, c, g, or t
  misc_feature (214)..(214): n is a, c, g, or t
  misc_feature (568)..(568): n is a, c, g, or t
  misc_feature (577)..(577): n is a, c, g, or t
  misc_feature (608)..(608): n is a, c, g, or t
  misc_feature (646)..(646): n is a, c, g, or t
  misc_feature (667)..(667): n is a, c, g, or t
  misc_feature (741)..(741): n is a, c, g, or t
atacaatccactgttgcatgtagcctgaaaataacactntttgtcaaaaaaaaaaaaaaaaaanncnnnccaagaagagcncaaacactcttagagccccagggagcccggcactnacccgccaaaaggnaaaaggnaanagcggcgaggnccgggggaggggggcgggaaaaaacaggcgcaaacggggcggggcggggcgagcgaganaggngcgtcctgggacaggatgaggccctggtggacgcccaaagccacgtgtccaagagccgaggcctctccagcaagccctgcagtgggagaccttgcctgcgggccctgcccccaaggatggtgaggggcgccccgacaccgatcagcctgggcctctgggcacaggtgacacctgggggttcctcaggccagaggtggcgggcttgggctctcccacctagccctgtggagagccgagcaggggcctggtgccatgccccccgtgcaccaggcctcacgtggactccagcgtattgagtgggaacaggttgtggttggtgggcgtggaaaagtagagctgctcactcgacgcgtngttgtcgcncgggctgcttagccccagcgtccgctcaaantccagcagctgccccatgaagttgaagttgggcgagangttggactttttcctcttganaaagtcgtaggcgtcgttgagtgacaggttcatctcctgcatcagataggccacagtgaccgtcactgagcggnttatgcctgccaggcagt

SEQ ID NO: 528660 - DNA, 439 bp, Homo sapiens
agccccgaggatgtggagatcagagtttgtgtgacagagagggcttgagtttccagggcagtgaccagagaggagagaacagcacagagaggctgcagagcacgccctgagatcttcaggtgacaactcatctgcatatgaacatgagaaacgtacccaaagccaggaaaagaatcaaagaaagaaaggattagtgctaccagtggccaggataccacaccagctggaaatagtgcctgttcccaccagccagacggaaaaattgcagaaatcaccaggcattgagtaatctacacaggaccttgcctctgtagtggtcagactgagcactgttccaatttcacccaacagagctcaaaaacaacactcaagagtcaaactatttctgattaatttatctttgtcccagaacaaagcttaagaatatttataggaatac

SEQ ID NO: 528661 - DNA, 278 bp, Homo sapiens
aggtcggtccttctctcctccacctcatatgaatagtatgtaaacgaatactggttggccgggcggggtagctcacacctgtaatgcagtgctttgggaggccgaggcaggcggatcacccgaggtcaggatattgagactggccaacacagtgaaaccccgtctctaccaaaaacacaaaaatttagccaggcatagtggcacacgcctgcagtcccagccacctgggaggctgaggcagaagaatcacccgaacctgggaggtgggaggagaggaa

SEQ ID NO: 528662 - DNA, 223 bp, Homo sapiens
ctacctcctcctcctggcagattccgggaagcctttaggatgatatttcttcaactttatccatagttgtgccaactggaatggcatttgtttatgcgttcacaggacagagccagctcaagaaatctttaatctcactgtaggaggagtgaaaagaaaaacaagctctgtatgaactctctccagtcctcacaattacatttgtttttctgctcctttctcc

SEQ ID NO: 528663 - DNA, 572 bp, Homo sapiens
  misc_feature (28)..(28): n is a, c, g, or t
  misc_feature (33)..(33): n is a, c, g, or t
ggcccgtaaattcccaaatgaaaggccngcaanccaaagggggccgcattccccggggcccggggttgggtcccatccggcccattgtgggttgccccacggtttggtcccacaaaaaggtgggccccggccccggtttcagcttgaaggagttcagggtggccggcattcacaaaaaggtggcccggaccatcggcatttttgtggatccaaggagggggaacaagtccccggagtccctgcaaaccaaggtgcagggggtgaaggagtaccgctccaaatttatctttttccccaggaagccctgggcccccaaaaagggaaacagttttgttgaaaaattgaaattggccccccagttgaccggaccggttatgcccgtccggaaggtttataaaaaggagaaagctcgagttttccttgaggaaaaaaaaaatttcaaagcctttgttagtttccgtatggcccgtgccaacgcccggttttttggcaaaggggcaaaaaaagccaaggaacccccagaacaggatgtttaaaaaaaaaaataaagccctcttgggggtttggaatca

SEQ ID NO: 528664 - DNA, 181 bp, Homo sapiens
acaacagaggaagtctaaatcacacatcgacaaagcaaacttcaacactgaaacaagtcatcttgaagttggattactcagacttccaaattgtacaataatggcctgaatttaagttttctaacgataaactcagtggtttgttttttattattaatagagatagaactattgtgtgttc

SEQ ID NO: 528665 - DNA, 121 bp, Homo sapiens
cacgaggttttttgaggaattaacagtctttattgggctcagaccacccgtccgtgggtcttgaggacctctgtgtacttggcaattttcttctccacgttcttctcggcctgtttccgta

SEQ ID NO: 528666 - DNA, 1030 bp, Homo sapiens
  misc_feature (288)..(288): n is a, c, g, or t
  misc_feature (767)..(767): n is a, c, g, or t
ggacgcgtggggtaaaacccagcccatgaccccttaacaggggccctctcagccctcctatgtgaccttccggccttagccatgtgttgattttcacttctccacttccattaacgctctccttcattacttaggccttacttaaccaacacacttaaccattattaccaattgatgtggccgcgatgtgttaccacgagaaagcgcacattaccaagggccaccacacacccacctgtgtccaaaaaggcgccttctcagattacggggattaattccttattttantatacctctcaagaaggtttttttctcttctcggcaggagatttttctcttgaaccctttttaccaacttccagaggccttgagcccccttaccccccaaacttgaggaagggccactgtggcccccaaacagaggcttcaccccggcttaaattccccttagaagagtctcccacttcctataaaccacattccgttatttacttcgccaattcgaggagagtttctcaatctaaccttgaagccttcaccaattagtctctataattagaaaacacaaccgataaaccaaattaattctcaagcactgtgctttatttcacaattttatactgtgggtctcctctatattttatacccctctccttatacaaagccctctaagagagttcactttcgggagttcttccccttttcacccaatttttcccgaagcgggcctatcttcacggcttcaacactattctcttgggtgagcnccacgggggctttccccacggacactttccacggctcctttcttgtggctctcaactttttccttcaacttatcgtggtttcatccgcccaaatctaatttttttcccactttttacattccagagacttcacttttggggctttccgaaggccgccgcccgtgattacctggcgcattttggttcccattgttggtttggcctaatttcctggtttgttcttcgtctattgggctgcggggtccttaaccctcccaaagggg

SEQ ID NO: 528667 - DNA, 352 bp, Homo sapiens
  misc_feature (44)..(44): n is a, c, g, or t
  misc_feature (51)..(51): n is a, c, g, or t
agcctcaaattttgggttcaagggagcctccccctcagcctccngagtagntgagactacaggtgtgcaccaccatgcctggctaattttttatttttggtagaaacaaggtcttactaaattgctcacacgggtctggaactccgggactcaagggatcctcctgccttggcctcctaagtgtggggattacagatatgaacccccaggccgggcctttgtcctagattgtatagggtaaggagacatactcagtaacggtttgaacccccatgtgggttccgtggggactattagggtaggaaggaccaaaagaaagccccagaaactagcccccactttttttcctcca

SEQ ID NO: 528668 - DNA, 367 bp, Homo sapiens
cccccccaaggtttaaaaagggctttttgggcccccccctttttaaaaggggtttagggggtttaaaaaattttttttccggggcccccccccgttaaaaggaaatttttttccccctgggccccttgcccggggaaaaaaaccccccgggggggaaattgggggcccaattttcccaaaaaaaggcctttttggggggggggggttccctgggggggggttaaagggcttttttttgggggggattgggggcccccttaaaagggtttttttcccccctttcccttatggggccttttaagccccccaaatccttttcgggggccttacccaaaaaaaaaaaaagcccaggttttggggtttttta

SEQ ID NO: 528669 - DNA, 892 bp, Homo sapiens
  misc_feature (578)..(578): n is a, c, g, or t
gagcttatcaatatggttaaccccgtccctgtgccccttaccagggcccttttcagcccttcttatggactttcgggcctagccatgtgatttcaagtcccagttcattaccctgctgcgagtactaggccctacttaccgacctcccttgcccatatacccatgatggcgcgatgtaacaccgagaaagcacataccaaggccaccacacaccacctgtcccaaaaggccttcgatacgggataatcctatgttatgacctcagaagtttttttcttcgcaggaatttttctgagccttttaccaactccagcctatgcccctatcccccccattatggagggcaactggcccccaaacaggcatcaaccccgctaaaatcccctagaagtcccacctcctaaaacacaatccgtatttaactcgcaatcacggaagtattcacatcaccctgaggctgcacccacataagtttaaatagaaaacacacccgaaaccacaataatttcaagcacttggttcattacaaatgttaactgggttcttctgatttgtgagcccctcgctatacaaagccntctcacgaggtgaactcttcgaagtgtctcccgctgtgcaccactatttccgacggcattttacgggtcaacacttttttgtagccacacacggcttccaccggagcttcaccgtcacattaattggctcaaactttcctcacctatctgcttcaatccgccaactaaatatttcacctttaacaatccacaacaatcacctttggggcttctgaagaccgcgccgcccgtgagtacgtgacacttgttgtagaatagtggtgttgagctatattcttgtatagtctcccactctattgatagaagggtcttta

SEQ ID NO: 528670 - DNA, 256 bp, Homo sapiens
tataaggcgggacggtgagatatgaactctgtttctacaagaaccacactacgggtcttcggtttaagggctaacaattaatcttttattctcttcttctgttgagtatacgctgtattttttaaaacggtagtgtttgacttgctatgtacatatccctcaagcagagcttcactacggatgagactctctttttaacaaacaagcaatttgtcatcagattccaagcacccaaatgttcacctccagaacaccg

SEQ ID NO: 528671 - DNA, 209 bp, Homo sapiens
tgagcttcagacacacttgcacccatccgttccctcctgaattttctgacctccttggttcattcgcttcttccttatctctaacttcttctgtccatcggtcttctcgggacaagacagaattatggggactactgtatgccaggcaattaacatccctcctatatcctacctctttgtggtgcccctctgctctccagcttatccct

SEQ ID NO: 528672 - DNA, 614 bp, Homo sapiens
gtcggagtcaagtactgcctctggagtcgactcccacctcaaacctcactcgaatgatggcggtccagtcctctctcagaagacgtccatcagcaacgtgattctgtcctcccagccaagctggcagctcccggagcccctgccctatcgctggtctcccgggctgtgcaggccctgcagggactgtgagccctcctcacgcggaggaagcagagggggctggacctgccggcctggcacatgcacgtggagaggccgactgttgtgcacactcacgcaggcacacacacacttgctcacacacacactgaactcatgctcacacatgcctgtcaggctcacactcacactcgctcatccgtgcactgacactcatacacggccagcgtcctaaggcggaagagtgaaggagaaaggcctgcactccaaggctgggctgcaagtgcagcgggggtgaggggtgggggatcgccggagcagaaataaattacagccaacccggtcaacacgtttccaaattttccaagacgtttgctgacgtcgttagctggtgacatcctcttcttcacatttttaaagcttaaaaataaaagtcctggatccaaaaaaaaaaa

SEQ ID NO: 528673 - DNA, 300 bp, Homo sapiens
tagccgagatcgcgctacgcactccagatagaatggacgatagagactccatctcaaaaaaaaaaaaaaaaagaaaaaaagaaaaaaacagtggtggaagtgacccccaaaggatcctgtgggtgtcctcgaaacttaacaggtcttctcttctctgcccttaaaacccatttggaagctccattattgctaaccgaacagttccacaaagaaaggtggagacacttattattttctctcaagttacagggacctcaaatggtatcccagggagacctcaaatgtactggatcattattt

SEQ ID NO: 528674 - DNA, 263 bp, Homo sapiens
tgagacagagtcttcctctgttgcccaggctgaagtgcagtggcgtgatcttggctgactgcaggctccgcctcctgggctcaagcaattctcgtgcttcagcctcctgaatcgctgggattacaggcgtgagccaccgcgcccggcctccttcaagacttttaatagtacaatcttatcagtggatgaggagaataattaatatatagaacattaccaattataaatacatatttacgtatcatttagtgttttctggagag

SEQ ID NO: 528675 - DNA, 1282 bp, Homo sapiens
ggagagaggttgaaaacaatccagagagcttcacactctcatgctgaagctccgagagcaccttgcctcttccaagatgaacggttatctgcaggcagctttctgttgccatgcttgctcaatgtgtcatgcacagcattacatgctcgctactagagggactttgcgtcagcgcgaggctaagatcctcgtctccttgtatcacaggggagatggacgctaacaatgacgcggagattcatgcaagcagcgcgattactcgtccactagcttcattgtagtgcatacgatacacactcagacacttacgcagggctcaaaggggtacaacttgtaagagcatggggatatccccggatgcattcatttatccactgcaacgcgcacatgatttgtgtgcgggaccgagtgaggacctatgcgtgagcacgacccggactttagccaagtggatagcaataacactcatgcacgcgaatgtggttctacggcgcggagcaaactgactactattccgaaggggaaagctgcatatggaacatcctttggtcaattcatttcccaaccctatgttgggtcgaaggtcggatttgaagaacaggtcgcaatcccccttgtctacttctaaaagaggtcccccggtttgaacgtgctagcgcgcaccgcaacggcgcgtcaagcgtaccaaatcccttgaaataagcggtgccccgttgcgacaaaggccctcttcccatcaggcatttatctcgggggcgcatatcagacttggtggcatatgccataggttgaattacacacattcttacccaagcaacctcctaacggcgtgggggctcttgacctcgctattacacatactggacacggcgggagtatcgtacgtacggtaagccccacccaaggacaacggcggcaccgctttcctttccgaacgtgcgctgaagttacgcttgacggaccgtcttaagtgggccccttaccggcccctatcccactacagacgacgggctgccgcacattgtccaggctgtcagtgggcttaccaatcgcgcgatctgtgtacgcgccaacagcgccctaacgagggagattcatttcttgggagctaggaccatcctcgactcggctatttccgccccgcaacggtctgggcctccccgcagatccatgtaggctctaaccttctacgggcaccgatctcggacggctattacatcgtccaacgccgaacagggagcgacaatcctatctacagttcccattatcgagctacacataa

SEQ ID NO: 528676 - DNA, 905 bp, Homo sapiens
agcggaatacgcgcaggcgcagcgggttgggtggcagcagcatcgagtagcggccgtttaggcagcaacatccgcaacaagtgtagacaaggtcccgcctgactccgctctggaaagtccttttgaagaatatggccctggtgaggggcggctggctgtggagacagagctccatcctccgtcgctggacgcggaactggtttgccctgtggctggacgggaccctgggatactaccacgatgagacagcgcaggacgaggaggaccgtgtgctcatccacttcaatgtccagtgacgtaaagatcgggccagagtgccatgatgtgcagcccccagagggccgtgagccgatgatggcctgctgactgtgaacctacgggaagtgcggcgcactggacctctgttgcggagagcacgggattgatgccctatgcatggaatgactagcactgctggaggcaaaatgtccagcccggtgtcgcgtctacacggcgtaccaagactactacgagagtggtgccccgcctaagtgcacagcgagggccacgtatgttccgcaagctacctaccggaacgccactacgcaggccctggacgttgacgcaccgtgatagtgcgggaggatcactgctacagacagccggacgcccctctggccatgggggatgccttgccggtagccagcactggcggcggcgcctgggctcgcttcatgttggtccgcccatgcttggttctgagccctgggactcggcagcatttgatcccctgcgcttggatggctgactccctcttcctccgggaacccatcctctagcatccaagcctgtccccattttggcctatcttctccatttgctccttccgggttggaccattccccccaatccttaacgttatccca

SEQ ID NO: 528677 - DNA, 304 bp, Homo sapiens
ctggatctgatcgtcattcggtggcgtgtagtgctcggcatcgtgtgctgtcgcgagattgctcacagtacattcgcagtgctggcactcagtctgttcccacgagatccattctggctcctggagtcatctcaccctcccccattctacctgattctcccgctccgagagtctttggggaccccaaggagagagtcaggtggaggaccaaacatgaacctcgattactgcttcctcatgatgtacgcgcaagtccaaaggcatctactacgtgcagctggaggatgacaaaccctggaaggta

SEQ ID NO: 528678 - DNA, 110 bp, Homo sapiens
cctggtgctcaggtctgcttctgttttaatctgttgtgatgtgttattttggtagagtggggttttttttttgagacagagttttgctctgtcacccaggctggagtgca

SEQ ID NO: 528679 - DNA, 1485 bp, Homo sapiens
  misc_feature (700)..(700): n is a, c, g, or t
gacagcttcgatgacatgacacctctcgtgagttccgcgtatcgtgcgcagaggctatctacgcgctatggttctagagaacgacccgtctgaccagtccaagcatgcgagaccattctacgctctgataagtactaagggagcttgaatgactagtgatatggcatacaataggccgcgctagaatctagggcactggggaagaacgggccaacattctgccgaatacttcggagtatcttgcagctacgcatctcgtagattgagcatgcataacacacgactcatccagcgcctatggtgcacttaccacgatcgcgcatccttcgcatgaaagtaaggtctactaggcaagagtgactaggagaggttgggtcagtggccactgagggagtactactatgggcgtcctgccatgtgcacgcctgtaatcgccggggcaccacatgtgcgttggctggagcgttgggcaggaaacactggccttattgggagacgtgtcgcacgcagcgagtacgagtcgtggggggtgaccccgcgtgggcgcggtgctggtgtagatgtgagtgcttgaagccaggaggagtaccgtgtcctcctcaacatacagtgcgggcagtgctcaggtacctaggtgagtgcacacgccgtgtacgtacagatgttcacacgtcgcgggtgcattgcaaggcatcgcggnactcttatggaccataattccccaaagaggcctctaaagagagagagcagacgcagggctagttattttaggcttgtccaagcccaataaaatgcacttgtctcgtattggtcgcttatgggagggtggatacacattgataggttgtcacttgacgggtgaacccccaagttccgggaatttcttctggtcaacactggaaaggaaccgaagtcttgaacccgttgggcaccggggtattccggggcaagtttccttagccattccacagcggtgggggacacgcatgagcgcacgtgtggcaagcgctgggaacaccactctcatgtcgacagtctggtcattcgaaaggacccctgtgaccaatgacagccagggggcagggacaactcttcgaatcaaaagaccccggggcagggaacgggcggcgcggggacacaccgcggacacaattcttggctcgacgagaatttcacagggaaatccggcccccgggtaagtgggacaaattggcgccaaagggggaccgcagaacggggtcacttagaggggagagataagacggacgccccaaccaccaaaatcaaaaccaacacaagcccgctggtgccaaccagaaacacagaagctaaagcgatgcgtatccacaccacaagcgacaggccgccccaccacgggaggcactcttccacacacacgcagcaggaagcgcccgcaacaacagctctgacagacgagcaagcaaccagccgaactgaactaacacccgaacaccgacaacccgc

SEQ ID NO: 528680 - DNA, 318 bp, Homo sapiens
cacctggacatagtacaggcactaccacagacagcctgtgggcagtagttccagtagcaggtacagaggacgatgctctgctccccgcggaagctctaatcaggcctcgctgctgcggagcatgcgaagaagatagcacactacctaaccctaccttgcgtaccgcacatgcctataaccctctacccctatccttccctacctatctatcctacctaccttaccctcccttacctttacttaccttccatctgtacacttagtataacctcccttccacttactccctgcctcttaccttccctccttctctacctt

SEQ ID NO: 528681 - DNA, 418 bp, Homo sapiens
tcctcttctaccatgcccacttccgcagtactgtctacctcgacacgcatcttcgactgtcaattgctacgtataggacaaaaccgatcccccgcagtgactctctgctcccagtcccgtgatgattggaagctccaaactgcactccaggcgtactactgccctatggtcgccgagtcctctgaggactctgacgaggagtcaaaggggctgggcaaggagaatgggattggtacgattgtgagctcccactctcccggccaagatgccgaagatgaggaggccactccgcacgagctccaagaacccatgaccctaaacggtgctaatagtgcagacagtataccacctctataccacctctataccacctctacccaccttcaccattttacagtataagaaagggtaccgagct

SEQ ID NO: 528682 - DNA, 289 bp, Homo sapiens
taatgaagagtcatcaacaggtcagttgctgaacaccgccaccagagggcttgggaggggcaactgccaccccatcatggcaaagtcaccaagaactgaccaggccagagaggtggagtggctgtttactgggcagacctcatgctgtgtttgccagttcccctgggcacattgattcatgggcccagaagccagggatgctgctgaaaaagcaagcactgaatcagcaccgcaactgcaaggctgttagagctgcttggctttagggacagatgttttatgctgaaga

SEQ ID NO: 528683 - DNA, 218 bp, Homo sapiens
aaggcatcccgttttgccggcagcagcagtgccgctcctcccagtggcggcgccgaggtccctgctggtgtgtggatcggatggacacgtccctgccacggtctccagctggcaatggacagctcctcctgccccaatggaagtagcggataaagctgggggatagagaggcatgaagggccaatgaaaagaaacatggagcagtcatcactcaacaa

SEQ ID NO: 528684 - DNA, 406 bp, Homo sapiens
gctcactcatagcacccatgacaggaacgtagaatctattcggtgagtattaagagttggggcagcacattggaagccctctatgagtgcagcgactcgcctatgtagttccagcagcggccacgctctgggcgatgttcttaaccccgatagccactctgggatgagccgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagc

SEQ ID NO: 528685 - DNA, 474 bp, Homo sapiens
  misc_feature (37)..(37): n is a, c, g, or t
  misc_feature (141)..(142): n is a, c, g, or t
  misc_feature (311)..(311): n is a, c, g, or t
  misc_feature (361)..(362): n is a, c, g, or t
tccgcggcgctggggaggtcgccccgtggcacaaaanccccagagggccaggtggcgtctcccgggtcagagttgggatcaaggggccccccccatgagaagggagggctagacggaaaggcccaaaaagcctcccccccnnacgcttttcgttggaaggccccaagtaccaccttggtagaggtctcagctctggcatggctgcccccggatgtggccgaggggggcttcaaaccctgtgtccttaggagggggtggccttgaggcagagccggtgcctcacttaacccccccagggcctctattcctcnccatgaatgggctgtatgtcctgccccaacttggcccgcagcaggccagnncccccccccccccgcccagagctcagtagccagcctgggtcctgccagggcttctcgagggcttgggggaagaatagatttagtaaagcaggaagatctgttgttacttaac

SEQ ID NO: 528686 - DNA, 236 bp, Homo sapiens
ctgagtgagtggtgtgatcgtactcactgcatcctcagctcctgagtgatcttcacgcctcagcctccagagtagctaggtctgctggtgcatgccaccacatctagctcattcaaaaatttttttttgcagagacagggtttcgctacattacctaggctggtctcaaactcctggcctcaagcaatactcccatctcagcttcccaaagtgctggaagataagcacaagccagg

SEQ ID NO: 528687 - DNA, 310 bp, Homo sapiens
  misc_feature (28)..(28): n is a, c, g, or t
ttccctatcatattcatggggggaaatnaaaattttttttcccccaacattttttgggccatcgggaaggccccggggttattgggattccccccgaggcaaacccccacatgaaacatcctatctttgggggggtcttttttttttttaacagcggtaaaattaaaaattttcatgatttgagaagccttggttttgaagggaaaagtcttaatagtagaagacccccccataaactggggggggttatagggaggcccccccccctcccccccattggaagaaccggtaaaaataaattttagcccca

SEQ ID NO: 528688 - DNA, 1338 bp, Homo sapiens
gtgggggcccgtgacgggacgacgggacggacgactcacggacggacgacacctgacaacgccacgtacgactttaacacggtgtgacacaccattatataatactaaactttacttactttactttactttaataactatatactaattaatacttgacctcactatcttgagtgattgtatcaactacgcacgaacggggagacttatctaggcacgaggtcaatacgagaccaacataccgatgagcaggagacagtgatcagcaagactaaccctcgaaaagtgacaacaacaagagtatatcaaggatatataccatacggcacgaagagaccacctgcagagacattccagcacactgatatagtagtcaccatgagagtaaccttatgacagccataaacacgagtgtcagatgcgatatgacattgtcacttactatccacaacgacgacaatagactagacactaataccacaggacaactactagattaatacaaccaacacagccacacaataatttatggacaacccaaaacacacatagtaaccataacacaatatatacaccacacactaagaaacatgggacacacaacaaagaaccacaccattagcattatacaaagaaaggaaagaaccacacaagagggaatttaggaggacggagaacacaacagggatcaccattcaaaacctggacccaccagcacaaatcccacaaaaagaggcacccgaaaagacacacatcacgaaataacactcacaagcataacaccagacaccaaaacaaaacatagcggaagaaatcccatacacacaaaatgaatcacaacaacagtaaacaatacataccaaacaacaacaagaaaacaaaaaagccacaaacaacacaaacacactggacctaatcgatccgtcaatcaccctaataacaacaaccaaaacaataataaccacacacgccatatacaaacctagcaaacccacagacaaaacaaagaggacccaaaatcagataccactcaaactagagaacaacagacaacacaaacaccaatagcaacaacaatcgaaatagaggagaaatgtcaaaacaccatacacaccaaagacaacatgaaggcagaacaggaacaagcgacaccgagaaaccaacacaaacacaacaacaccaaccacacaccacacatataccccacagaaaaaagagacgagcagaagacaccgaaagaaacaaacaaaagaccgaaaccacacacaaaacacaaaatcaaaagacaaaacgaagcaacaaagagaaaacaacgaacaagaagacaagaaaaagaga

SEQ ID NO: 528689 - DNA, 911 bp, Homo sapiens
taaaacccggtcctggggtgggggtgggtataatactaagtggaaatgattatcatttacgggggaaggcgcttggtgaagtaggccttatttctctggtcctttcgtacagggaggaatttgaagtagatagaaaccgaccgggattactcgggtctggaactcagatcacgtaggactttaatcgtggaacaaacgaacctttaatagcggctgcaccatggggatgtcctgatccaacatcgaggtcgtaaaccctatggtttgatatggactctagaataggatggcgctgtatccctagggtaactggttccgtgggtcaagttatgggatcaatggagtatagtagtcgcttgacgggggaagtctaagcatgtactggctcggaggtggggttctgctccgaggtcgccccaaccgaaatttttaatggcaggttgggaagtaaggacctgggggttggtaaggtacggttggcattaataacttaaagctccatagggtcttctcgtctgctgtgtacatgcccgctcttcacgggacaggtcaatttcactggttaacagtaagagacagctgaaccctcggggaagccattcaatacaggtccctaattaaggaacacgtgataatgctaccttggaggggtttaggtacggggccggtaaaaatgtgtcctgtgaggggggacccaaaaacgggagggcacagggatgttttgcaccccggggggaaaaattgcgagggactataacttgtaatactagcaataagcaccggataggtaaacagaggataaatactggtgatagcttcatcatcaccgcgagggaaggaggaaaataggcaaagtgagagataaaacaattatagaagagtcaaggtatgaaatatataataacaagcag

SEQ ID NO: 528690 - DNA, 207 bp, Homo sapiens
  misc_feature (143)..(143): n is a, c, g, or t
tcagaggattccaactaagcagctatccaagtgtcctatcagtcaaaggacctcttgattacagcgcaggaacttgatcgttggggaacccagccccttgaacttggaagacccgtgtttcctggaccgcgaatcagtgtgtngggcatcagtgtattctgcaagggttgtgacctgaaactttttaaaaccaaccacctttgggaa

SEQ ID NO: 528691 - DNA, 151 bp, Homo sapiens
  misc_feature (17)..(17): n is a, c, g, or t
  misc_feature (55)..(55): n is a, c, g, or t
ggatcgcgaggtatgcntgcacaaggacaaggctttgagagcagattggacctantgattatgtgtatataaaaaacaagacatcttttaaagcaaagtctgggcaaattctctatggaaagggcgccactggcactttgattttgacttt

SEQ ID NO: 528692 - DNA, 385 bp, Homo sapiens
  misc_feature (206)..(206): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (246)..(246): n is a, c, g, or t
  misc_feature (252)..(252): n is a, c, g, or t
  misc_feature (257)..(257): n is a, c, g, or t
  misc_feature (263)..(263): n is a, c, g, or t
  misc_feature (272)..(272): n is a, c, g, or t
  misc_feature (287)..(288): n is a, c, g, or t
  misc_feature (328)..(328): n is a, c, g, or t
  misc_feature (347)..(347): n is a, c, g, or t
tgtgaaaggaccagtttcttaaagttcagtgttcccacggctggatacctgtgtgtctccataaaagtcctgtcaccaagaacgttaaaggcattttataccagcgtcttctaaaaaactaagtgaaaaacaaaaaaaggagaaaaaaaaaactttcataaaaaatccagtgctaaccacaaaaataaacctgaaacttatatttnacatactncantgnctgttgttnaccnaccgnagcttttnaccgtncactncccctnccaactatntccagatgtgcaggnncctcctctctggactttctccaaaggcactgaccctcggnctctactttgtcccctcanctccaccccctcctgtcaccggccttgtgacattcact

SEQ ID NO: 528693 - DNA, 145 bp, Homo sapiens
tcggctctaccttgttccttgaacatttccagacaactagcagactggcaacttgggtgaaagacaaggtagagccgagggtagagccgagagacaaggtagagccgagagacaaggtagaggcgagagacaaggtagagccgag

SEQ ID NO: 528694 - DNA, 294 bp, Homo sapiens
ccacgcatgggtcaagcctgcagatatcttacagtggctatgcaggctctgactttggattgctggggtcttagtcctgaaccccgagcgcagtaatttccagatgtcctcacatgttcgatcgtgaggttattaaaggttaaaatgacttaatggtgtgacacaagctaaatgctacaaaaaacattagttcttgcaaatttttttttttcagagacaagttctcactctgtcaccggggctgaagtcgagtgccgtaatcataactcactgcagcttcaaactcctgggctg

SEQ ID NO: 528695 - DNA, 188 bp, Homo sapiens
tttttttcactgtactttactgccacttcactgtacacttaaagacattattaaaatggtaaaatgtatgtaacatgctatttaccacaataaaaaaaaacattttgaaaaggaagtagtatagtgtagaccctattaaataggaggaggtgcagtattttgggattttatactaaggttcccctagg

SEQ ID NO: 528696 - DNA, 473 bp, Homo sapiens
  misc_feature (18)..(18): n is a, c, g, or t
agcaaggtggaattaacncacaagcccccggctgtggaaatttggacgaacagcgggtgtagtctggagcatttgtgggggggggagacgcgcgcgaaaccggcggcggggaaccctaaaaggtttgctttttgtcgggggaagacccgccttctccgcccggaagacccggggcggggcaaggccctgtctgcttataggtggcagagcccacagagggggccacaccccgaggcagactaagcgggggggttttcccccagcgcgcaaagcgacaagagcctttcggcaccttgagccccccaagagaaaagcgctttatgaggaaaacttgaaaaacagagttatcagctttaaactgccacaaatcgaaaagaaaggctttaattgagtgagctgggaacacccaagtgggttgattcttaaagaaaaagaaaccccaaactttttgcgtataaaccttttttccagag

SEQ ID NO: 528697 - DNA, 248 bp, Homo sapiens
  misc_feature (69)..(69): n is a, c, g, or t
  misc_feature (77)..(77): n is a, c, g, or t
  misc_feature (80)..(80): n is a, c, g, or t
  misc_feature (83)..(83): n is a, c, g, or t
  misc_feature (92)..(92): n is a, c, g, or t
  misc_feature (96)..(96): n is a, c, g, or t
  misc_feature (101)..(101): n is a, c, g, or t
  misc_feature (109)..(109): n is a, c, g, or t
  misc_feature (115)..(115): n is a, c, g, or t
  misc_feature (120)..(120): n is a, c, g, or t
  misc_feature (126)..(126): n is a, c, g, or t
  misc_feature (135)..(135): n is a, c, g, or t
  misc_feature (150)..(151): n is a, c, g, or t
  misc_feature (191)..(191): n is a, c, g, or t
  misc_feature (210)..(210): n is a, c, g, or t
ccggtgtccgctgtctgcggggcaacgggattcagtgcttccgcggagaaaagcctgtgcttatatttnacatactncantgnctgttgttnaccnaccgnagcttttnaccgtncactncccctnccaactatntccagatgtgcaggnncctcctctctggactttctccaaaggcactgaccctcggnctctactttgtcccctcanctccaccccctcctgtcaccggccttgtgacattcact

SEQ ID NO: 528698 - DNA, 701 bp, Homo sapiens
acagagaaaacccgagggaagtacccgcatgcaaaggacctgacgcatctcaaggaatactggaacgaccctgagtggatgaaggggagcggttcctgcgggattacactcctcaacaaagcgctatgaggaggaggaccgaggaggaggaacgatgaagaggaaaatggaggaccgaggagggggtccacggatcccccaggtccagactggctgtggacgactccatcagacgaaggggagctgctttcggaagaaagcaggaggcacttttgacacagcaagtacaattctccgtttctcgaggcagccggactcagcgatcggtctacacacctaaccctacgccagcgatcgccgtcctccgctgcgccgtccacggcatgcagcgctagcaacgcgcagcacacagggcacgccagcactcccggcaggcgcaccgcagcagggcaccaacagcccacagcaaagcgagggaccccggctccccctccgtctgacccgatacccttgaccccgacccgagaccgcgccgatctccctcgcgccccacgccctggcgaccgacaccccctgacgcgaccccgctccccccgggcctccccgaaccgatctctgcttggcggcccctctaacccgcccgcgcctaccccctcctccctcacccctacccttttccaacgccctgagaaaaagaagga

SEQ ID NO: 528699 - DNA, 635 bp, Homo sapiens
tgaatactgaccctgaaatcaataacatgacttgcccatattatcatgtatggtattgtggcatgaggcgacacgatcactacccattaccccgaactcggactactagctgcctgccctgatcactcgtgtgttgccagtggaagcaaggttcagatgattgattgtccttacttgatcgtgcaggacttggccagctccagaagggtcactcatcaagtcctgcaaatgtctgtatccttaagcagtgtcatcagtgtcctcagaagacactagcagagtccagggtgatgcgttcagccacaagcacaaagactgctttttctaaagagcaggatgaggtgaatgtgggaacggaaagcagttgtcacgaaggctgtgtggctctgctgggggagaggcatccacagtctgtgccaaggaggtacctcaccctgtgcagcaggagcgttaaggccaaaaaacaaaaggggccaacagaaaacagctcaggtgatggggggaggagcagcaagaaaaaacgacaaccgagaccaactgaaggttcggtcaggaatgcaggctcttccgtctatacagtgtttaaaaagatccaatgtgactgagatcatccagcctgcacttttatttgtagg

SEQ ID NO: 528700 - DNA, 765 bp, Homo sapiens
gtctaaccattgttctatatgtgcatgtgactgaatatggtgtattaaacgcgatgaaagtcttaatgctcaaagtatgttaacaatccatgtagtatatcagtccctttgtcgaaattcgtgctcctggtgcaatttttcatagaacggacttgtgccatctgtgcgagttagacctttaggttagctccacccctttgggaagcttagaacaatcctggatactcactacgcggggcatgcgtgcgtagatcaggggcagcataatagcgaagcgtgtggaagggggagagggctctttggcttagtaatctccgatatctaagaaccgatagatcattaggatgactaaccacgggatctactaggagcgctttttagtcaagctgcctgtgttcactttgtggacgataatttattcattaggcagacagtcataaagctgatacagaagtggggtgactaatcttagtgagtaaacatcggtaggagctagttgacacttctcctattttgtcacactaccgttgtaataatgcgatgagagatacaatcttggaacatggaatggtgtgaagggcagcctactgaacaggtgtatgtcagactagttcattcatcgtcggcaagccgaggggcccgaagggatcactacaggtaggagatgtatgccgcatgtgtacgtctctgtccatatgacccactctgaagccagcgacgtatgatcgtctgggtgactattggacccatgttcacggcctcgta

SEQ ID NO: 528701 - DNA, 443 bp, Homo sapiens
cccgctgtatatggaagtttctgtgccagggactgaatctgagctgcagctgctacctatcctgcagctgtgcgtcataccagacccttttaattcactgcactggaccgggactgatatctgtgcctctgtcagcaacccaagctgctgtagtcaatgttcttaacccactgtgccatcactaggaattcctgaggtgtagtacttttatgcctggctcataaaaccctcttctgtgcctctctgtgctctcccccatctgctagttggatataaatgactgcatgactttggtcggtgagagagccataggatcgaagagccaatattaccctgcatcccttaacatatggagaagagccatcccactagcaagaaatacaggccaagttcgacgccacatttttaagtaaatggaacaacagtctcacggggggatcctc

SEQ ID NO: 528702 - DNA, 469 bp, Homo sapiens
  misc_feature (199)..(199): n is a, c, g, or t
ccccggcttcaggaattcggcacgaggcccaataaacaagctatttaaaggggaaaaaaaagttgaaaaaaaggaaagctttgtcaaaaacttggaatgcaaatacattaacagatattgtggcaaaaaaacacaaaattcatttaaacatatttaaaaagataattttggaggcagaaaaaataaaaaaaaaaaaaancccactgggggggtcttcctccccccactccctttataggcggggttttttaaaagaggcgccgggttctattaaccccgataaaaaaaaaaaaactcctttcccccaaaaattatttttctttaaaaatattcttttttctcggggggggaaaaaaaaaaaaaaaccccccccaaatttttttcccccataattttcaatttatttatttggggcgcccaaatttgcgccccaatttttttttaaaaaccccccttttcattttttttt

SEQ ID NO: 528703 - DNA, 559 bp, Homo sapiens
aaatctaatacatggcagcacaactgaattccttccctaaagaaaaagtcctgccatggtaacatcataattaaaacactttttgggaagaagatttaaaatattggcccatgctacaggaagagaggtattaaaaatggtatacacaaggtcagtggacactatgaagctcaagcttacaaaaagaaggtggcaatatatggactcaggatctcaaagctgggggtcccagcattacggggcgtcaacagccttggcaagggcacagcacagtgcacgcacaaatcaagcgtgcaaatccggtccccagcatcaccaactctcgtgcaaacacagcgggccggtccccaccacactaagcaatcgcacagggccagttcccaaattcggcaacgtaactcacatctctcaacatcagcacaaagccagacttcggtcgggcgcgccctttcacttgcgacattgggcttacccactcggcctcttcggtacatactggtcaaaaacttcgtgaagctaagcaccttctcgcggtcccctttctgatccctcaccctaa

SEQ ID NO: 528704 - DNA, 345 bp, Homo sapiens
aaaaaaaaaaaaaaaatttgtgggccgcccggcccccaaaaatttttaaaaccatccgtggggggcggggccccaggtagggataagtgtaaccatgttgcaataaatgtgtggtcccctaaagaggagaatctcctggcggcaatgagatatacgtggctgggagtttcttcccccaaataaaaaaagcgcgcccgggaggcacacacacaggcgcgtgtccttgagaacaaatccccaagatgcggatttttcggagggatcatacaaggatgtctcctatcaaccaggagtggtcacaaggagatgcttctgatattcactatttaccgccgcaggctccgg

SEQ ID NO: 528705 - DNA, 573 bp, Homo sapiens
ccagcagcggacacagttcaggcagaagagccggcaggtttaagaactgctcatcaacttgtcttctgtctattgatagacctatctttacgaaagcaaaagtaatggtaactgaccgcgtattgtgctaccacattgtcattccttccctggtcagtgtctgtgtagaagacaccatcacttcaaggcctagtgtccgaggacgccaagcaggtgcctctcccttcccatctcatcgaaatagcacgacttgtctgtagacaatgacacagatgtggggctcattcacctggcgggccaagaacggcacgaagatctcgatgcctgcccgctgggcttcctgcacggccttctccatggcagcgggcgtggcaccctgcgagttggcatctgagaatatcggcagcctcttcttggcagcgccggacgaagtctcgcggttgtaggcgggttccttagcccatggcatcgctgacgtcggtggcgtcgttggtaaagtccttggctcgacggcactggccatgccgtgtattctgcggaacggcgcgacgcccgtctggcgctgtggcttgc

SEQ ID NO: 528706 - DNA, 170 bp, Homo sapiens
catcgaggtgatcatcatggttacggttgaaatagaccacgtgggattcctgggtgtcgggggagagaggaccaatgctgacctgtctatagagtcagcccaatggctgccccctctggtcactcctgtcccctgccctccgtctgagtgagcttcaatgccaaccaagg

SEQ ID NO: 528707 - DNA, 143 bp, Homo sapiens
ctcttcaacactgggtagggggcgtggcctgatgcgaacgtgctgccagatggcacggtctgggtgcgggtgttccctgtgagcccgagtccgcttcagtgatgggagcctagcatgtgcctggctgtgtgatgggattgacg

SEQ ID NO: 528708 - DNA, 659 bp, Homo sapiens
caacagcacgcaacttcattattattctatagtattacaaatacattgatacccttaaagctaatttagtgtccaaggatgttttcctgtattatctatgacttattcagttgtgtgtgtgtgtgtgtgtgtgtatatatgccacaaattctttatctgttcatcttaggacagacacttaggttgtttccataatctaggctattgtgaataatgctgcaatgaatatgtgaaagcatatatctctatgaggtgctgatttcagtttctttgggtgtatacccagcagagggattgctggatcataggcagttctatttttaatgttttgaggaacttctataccattttccgtaatgtctgtgtagcaatttacattttcaacaacagtgtacaagggtttccttttctccacacttgggccaacacttgtgtctttttgataatagccatccaaacaggtgtgaggtgatagctcattgtggtttcgatttgcttttccctgataattagtgatgttttcagtgctttttcatatacctgtgggccctttgtatgtcttctttggaaaagtgtctctttaggttctgtgcccattttttagttgggttatcgcgtggagtagggtattggctgttgagtagtgagagtccttatgt

SEQ ID NO: 528709 - DNA, 761 bp, Homo sapiens
tcccctactgagaaagctctcaagctctgggcgttgccttcctccctcagtttgcgcccagtggaggacggacagcccgagaccaggcgggcttggccacatgcttttcgccaggtcccctcagagtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctggaaaaaa

SEQ ID NO: 528710 - DNA, 156 bp, Homo sapiens
ctcgactctaccggatcttatacaccctgcgcggaggatcgtaacggggtaagctagtacaccgaagctgcggatatccttttaggatatggtaggagagcgttctgtaagacctagcgaaggtgacttgtaaaggttagctggtggtatcagaga

SEQ ID NO: 528711 - DNA, 582 bp, Homo sapiens
tcccctactgagaaagctctcaagctctgggcgttgccttcctccctcagtttgcgcccagtggaggacggacagcccgagaccaggcgggcttggccacatgcttttcgccaggtcccctcagagtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctggaaaaaa

SEQ ID NO: 528712 - DNA, 117 bp, Homo sapiens
  misc_feature (48)..(48): n is a, c, g, or t
atcagctcgtaccacatcagccagtgtcttccgttatggaggacttcnttgatgagaccaggatgcacaatggcagcgagctttggattatcttgtgtgccatctcatgagctgggt

SEQ ID NO: 528713 - DNA, 140 bp, Homo sapiens
gggagggcagggggtttcccgaagatcgcactggaagattttattaaaagaattttttttgggtcggggggaacaattaaacttcctgggccacgtgggtccttcaaggagtttttcaagcaagtttttccccttttttt

SEQ ID NO: 528714 - DNA, 960 bp, Homo sapiens
gggcggcggggctatggagctcaaggatggagcaaatgtcaacaggcacagatgatgggaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtaggggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctgggcagccccctccccttaggctccgtcactggacctcgccgggacacagcctccttggtctccccatgggctcctggtacgcaacggtcttcgccggcctcgcccagccagtcacccggccagctagccagcgtgtgagggcgcactcgtgctggacccgagaaaactcgggcaagcgcggaagagtggcgaaaggtgccgaccaaggggagacagcgagaaccgcgggcagagacgcacaaagggccccagtgggcccaagattaaacgtgcagcgcccgccctgtagaggaggacacaaaaacacaggtaaggggcgatgagaaagacaggaaagcgccacagaaaggtccacgagacgaagagaccg

SEQ ID NO: 528715 - DNA, 149 bp, Homo sapiens
agttcagattgcgggagccatcccccattcagcctataatcctatagaacttctccaatgacatcatgctactgcagctggagagaaaggccaagcggaccagagctgtgtagcccctcaggctacctagcaacaaggcccaggtgaag

SEQ ID NO: 528716 - DNA, 183 bp, Homo sapiens
ttaccaaagatctttgagcataccttaagatctgtaacactcaccgcgagggtccgtggcttcattcttgaagtcagtgagaccaagaacccaccaattccagacacagtagtaagctttaaacttttcagtgggacatttgacagcttagcaagcattgggtgatgctcacaagatcttgtg

SEQ ID NO: 528717 - DNA, 107 bp, Homo sapiens
tcgggcgcttacctgcagctctctctgatgtggtggtactcagagcctgtagaacagcagccagcccttctcgatcacatactggcagcgcttcaagtcatggtccc

SEQ ID NO: 528718 - DNA, 260 bp, Homo sapiens
  misc_feature (200)..(200): n is a, c, g, or t
ggcgcccagcttctccggccgccacagcttctccccgctgctattagaatgcattgtgaaacgactggagtatgattaaaagttgtgttccccaagtgcttggacgtagtgattcgttgaacggaaaaaatccagctgacgtgataaacggctgacgtgttgacggaaatttctcgcagttttacagcagtcgtatttgntgattgaagctgacgtacatttctgctggtgtatttttaaggtaaaatcgcttttatgtt

SEQ ID NO: 528719 - DNA, 752 bp, Homo sapiens
gccccacttccctgcagggacctggcctgggctggggcccaagtacacccttggcttccatcagcccccagaatttcggcgtccccttcagcttggtggcacacatggcagctttgtgccctacgcccttctcccacggattctctccctcatgccgtggagtcctggcgtggacccccgcacgcgctccctctttgccgcctatgcctgtggtggagtggagttctatgagaagcttcttctgggcaacctggccctgcgcccgtctcttgggccaagagggggagaagactgtatacaccccgcggggacatcgtcccccgacacttgttccgagatccaaccatttaccctaccaccaccccccgggactctgtgctgcagatgtggagggggatgctccatccgggccgctcctgatgggctcatcaccaggacacttcccgcttgtgccgacacccccctgcccttgagtctggagggccctgttggagcccttggacctatagctccaggcccgaaaaatcactggctttggaattaaatagcttagattgtactataacccctacttatgtactccgggactatgagggactattcacggggctatgaatctgagcccttgtttcttgaactgtaaagtggagatgatgtaacccccctgccagattgtagagttgggtaaggtcatgaacataagggcctggcaccaagggtgccctgtaaataaacccacatccctccttcca

SEQ ID NO: 528720 - DNA, 173 bp, Homo sapiens
aaaaaaaaaaaaaaaagaaaagaaaagagaagaaaattagccaagtgtggtgggacacacctgtagtcccaactacttgggagactaaggtgggaggattgcttgagcctggaggtggaggccacagcagttcagcctgggggacaaaatgagatcttatctcaaaaaaaaaa

SEQ ID NO: 528721 - DNA, 136 bp, Homo sapiens
catgaagcgtaataggcgagtgttacatgatgtggcaatgtcttgcagtcgtcaatgccgctgtggggcggcctatgtgtgcaggctgaggccctgtgtatgtctagaagtccattcttgggccagcagcaccacg

SEQ ID NO: 528722 - DNA, 318 bp, Homo sapiens
caagagaatggaaagtcaatctcctgaattgctatgtgtctgggtttcatccatccgacattgaagttgacttactgatgggagcaagatgcgccatcttgctcccatcaggagttgtctattgaagaatcagaattctgcaactaaacaaaagcctccatttttcctcttctctcaccatactttttgaagtttatagaagcaaggcttgtactataaattaacattacttgctgattaatctatttcttcccttaaaaatctctcactgatacttttaaataatttgctgataaaagagacgctgatgggacgaag

SEQ ID NO: 528723 - DNA, 249 bp, Homo sapiens
  misc_feature (2)..(2): n is a, c, g, or t
  misc_feature (83)..(83): n is a, c, g, or t
  misc_feature (88)..(88): n is a, c, g, or t
  misc_feature (100)..(100): n is a, c, g, or t
  misc_feature (135)..(135): n is a, c, g, or t
  misc_feature (140)..(140): n is a, c, g, or t
  misc_feature (144)..(144): n is a, c, g, or t
  misc_feature (160)..(160): n is a, c, g, or t
  misc_feature (170)..(170): n is a, c, g, or t
  misc_feature (173)..(173): n is a, c, g, or t
  misc_feature (177)..(177): n is a, c, g, or t
anagtccctgccccaggcgtgcagagtagggtcctggggttttgtgctgggcaggggctgcttttttttggggaatttttttnggggnactttaggacancccttaggctgtggagggtgtcagctgggcctttnaagcnactnaccactggttcccatnatggagatcnctntttngggcacccaagggggtttcctcctggaagggcccccaacccaagtgtcagagaagctggcaagatctgaggg

SEQ ID NO: 528724 - DNA, 127 bp, Homo sapiens
cgtgcctaggggaggataagcaccgtggcttgtggcgatagaccgaagtctagtgggttgtaccgtggctagtagggttgaccgtggtctagtagggtacgaccgtggtctagtagggtaagaccgt

SEQ ID NO: 528725 - DNA, 632 bp, Homo sapiens
ggccggtggaagctttgtttggcgcttttttattcatttccatcggtccttacagccgctcggtagactccagcagccaagatggtgaagcagatccagagcatgactgcttttcaggaagccttggacgctgcaggtgataaacttgtagtagttgacttctcagccacggggtgtgggccttgcaaaaagatcaagccttcctttcattccctctctgaaaagtactccaacgtgatattccttgaagtagatggggatgactgtcacgatgttgcttcagagcgcgaagccaaatgcatgccaacattccagtgttttaagaagggacacaaggtgggtgaattttctggagccaatacggaaaagcttgaagccaccattaaggaatttagcttaaccatgatttcctgaaaacataaccagccattgggtatctaaaacttgctatattctttaatctacaattaaagctaacactttttagaaccaaatgcctccttctttctacctaaccgggtctgctcgcttgccccagctgaattttaaattcgactaacctttatcatgcggcccgatattcgagcttattcgggcaaatctcctcaaagggagccttatacaattcacgc

SEQ ID NO: 528726 - DNA, 491 bp, Homo sapiens
ttttttttttggtcaaacattagctatagactcactccagtttatttagagtctttctaaatatgttttaaaatacctgaagttctacaaaaagtggggagcctttcaaatgcatgataaactagggtcagtaggttttggagagttgaaagacatttgaaaatatggtagtggcaatggcaggggtatgggctgataatgagacggatagaaatgaaggatgctacaccattcaggattaaaattcaacattagttcaagttttaagacttttactcctatggaaagagtggggaattggagtaaaatccaagagagcaggaactgtctagaagaaaattagcctgcccaatctctttggcttgtttcctcctcctcatggatccctctctattgataaattttaagtagtgcctataccacacataggctccattttccatcccatgccacatctcgagggaagagctataggaataatacacataaac

SEQ ID NO: 528727 - DNA, 665 bp, Homo sapiens
  misc_feature (16)..(16): n is a, c, g, or t
  misc_feature (135)..(135): n is a, c, g, or t
  misc_feature (170)..(170): n is a, c, g, or t
  misc_feature (210)..(210): n is a, c, g, or t
  misc_feature (223)..(223): n is a, c, g, or t
  misc_feature (247)..(248): n is a, c, g, or t
  misc_feature (257)..(257): n is a, c, g, or t
  misc_feature (259)..(259): n is a, c, g, or t
  misc_feature (271)..(271): n is a, c, g, or t
  misc_feature (274)..(274): n is a, c, g, or t
  misc_feature (280)..(280): n is a, c, g, or t
  misc_feature (286)..(286): n is a, c, g, or t
  misc_feature (298)..(299): n is a, c, g, or t
  misc_feature (303)..(303): n is a, c, g, or t
  misc_feature (308)..(308): n is a, c, g, or t
  misc_feature (311)..(311): n is a, c, g, or t
gagtgaagtttatatncaagttcagactcaaaggcattattatgatttgcttcttcccatgtcttccatgtcctgcttctcaaagtttttctcatacatcacactcctgccttaactgctctgagtatgcattgntttcaattcatctttatttcaatctgtttaacttntgaatcgcatgggaatacgcacattaagttcctttctaanataaggttttatnaagctgagtttcacgataagttcnngcttttttnanatgttttatggncanagaaanctttanagatttatatgnntttnctgcnccngtaaatggaccattaactaggtgacctttaacagagcacccctttgaaagttttataggtatgaaatatatgtagatattgtaaagggttttaatttttttttgatggggtgctgtgtaaatctgtgtatttataaatgtaatgaaggtattgacagaaaaaaatatattttcttttaaatgtattcagtcagtacacaatcctttataaaagttgtatactgactgaatacatttaaaagaaaatatatttgtgaaacctgttctgctatgaacagagataacatatctttttactatgctatgggttttataggttaagcttcctaatgcataataaatttacagttggttc

SEQ ID NO: 528728 - DNA, 127 bp, Homo sapiens
  misc_feature (103)..(103): n is a, c, g, or t
gactctcgagaccaaaatgaatttctccaaccttcagggcttcaacaagaggctctttacctattttgggaaaaatcattttggtcttgagagtcattaaaanggacccattggaggacatttacga

SEQ ID NO: 528729 - DNA, 1139 bp, Homo sapiens
gagcactaatcatgaagcttcagagccaaggacgtgcctgtggtaagcaggaggtcacgcgctctctttgcgtggggagctgaatcgcagatggcccccaaggccctataagaaggttccagtccccgaaggacctggacctggatcgcctgggatctagagtgatccgactctcggagcagcggagtctgagaggactgagatgccccacgggccgtctatccacgaggaggagccagcggcgtgcccaagcactcggctcggtcggagagcggaggaggtaagagctggctcggcgccgagagtgcccggaatcagtgagcagtgtgcaagtagatcgcggcttcatagcgatcaaagagctcgtcgattcgccatagaagcggtaccaggacagcccttgggtgtggaggcacattcccgtggtgcagattgacctctccgttcgcttgaaaggttccagggctgccctattgtcagtatcacgtatgtgaacgctggtacggaggacgcggcggcacctggtaggaagctggagaacgtgacatatgaggcaggcatgaacatgaggcaaggaagaacggtaaggaacgaacgtgtctacatggcggcctttcacccataactcgggttgtgccccgggcacgaagcccagcggatggaacacatcgtacccgatgtgccccaaggcaaggtgggcaaattcgttacagcacgtacgggtacaattgccctacagcacactgcgacgtgagcgcacaattgacctgcagggaatttgaccaaatgcatccgcgaatggatagcgccattaacgatgtggggcttctggcgcaattacttggaaccttgggacatacagcgccctttatgtccggaacacaggtgtaggaaacacttggccgttagtttcaatgacagaccgcgtaggaaagacgagcacggatgaaaccattgcaaaactagtttccccccttgaagcaaatgcgaccgtttccccgcatgtggttagacacacagggcaatgcatgcccatatggatacaccccaaaatacagaccacagctcagcagcaccaaaaagatatcccaagtggagccttcttcataagtcctgcagagctcgcgcggccagaaatt

SEQ ID NO: 528730 - DNA, 283 bp, Homo sapiens
gtatgtctgctggaaaaggggaggaggactcgccaggaatactggggcctcatatttgacataagttttggaatctgggcttatcctctcaaaagcggctgtataagtttccctggtaagatcacaggtggtggtgccgcattgttgtaaatgccagttcctgagcctcttggcatcacatgggccaaagtcctgaaggctgcctgatccaggtgcacaggactccggtcacggttattttcaagctgaggcttccactgacgtccatatgggcgtacgggga

SEQ ID NO: 528731 - DNA, 931 bp, Homo sapiens
aataaaccgcccaccccccatcaagaggccgagcgaagcagttcagggcaacatacatatgggtaaagctattgacacagatctcggaaaatggtaactgaagatcaaagtttagcaacagaggaatgtacttctacctaataactttctaaaattcaaatatgtataataaaataaatgttttaaatctaaaagacacacacacaactcaaagtgacaattctacacatatctaaaaaaaaaacacaaaacacagcaaaacaaccctcttttccccccccgtgcaagcgccacactaaaatcatcttatatcttattaacccacccatctaccattccattccaccctcttcttcttacccgttaaccgttcgatccgacctcactataaatcaaacaactttctcacaacaacaaattcatagcatatatatcaaaaatcagtattacccgtatgtccgcatcacctccattacaagaatactaacgtacacaaaacaccacctcgatactgctatcacccaaacactaataccgcttccactcctgtatgcgaagatccagataacactcagactcattcgtccgggcgagcaagtgcgttatttggcacttacacccctaatgtaatcaaacgtgctgccttacaaggatatattattctcaaaatcatactccaccaaaggaccgccctcacctcaaccgacaaccaacgtgtaagaaacgaacggacaactacagacgccaaccctgtttcttccttatcctttatcttcttttcatatccttatgctcatcatcagatagtaccacatccccctcccaccacactatacactgcactccgacgcgtaccactcagaaataccccacaccacctctcacctcccgtctaatcagagatacacaggtccgaactctccgtcctccg

SEQ ID NO: 528732 - DNA, 419 bp, Homo sapiens
tttccaaagcggatgctggtggtggctgcacaagcatgtgggtgtgcttgctgccactaaactgtgtgctgaaagatggtcgagatggtaaattcacagttaaaaaaatcaaggtcaagaaagtctaaaacagactgagagacttctttagattaaggtaggctacacagacacgaccaccaaatgcaacgtgtgatcctgggtgacgggcggggcataatgagggcattgctgggcaggcagcaacacctgaccttctgaactacagagggccgggagcacatatccatgatacaggtcctgactctcacaactgcactgtgcttacgtaagaaaatggcctcctctaaggagacagacacggtgtttaggagtagaagggggacagcatctccgctttggaaagggtaccgagctcg

SEQ ID NO: 528733 - DNA, 1095 bp, Homo sapiens
agcgggggcgcgccccgtccctcgcgcgcgatgctcccctggacggcgctcgtgcctgggccctgagcttgctggctggcgctggcgcggagcggcgcggagcgcgggtccaccagtcactcagccccccgatggggaccttgatgttcctgctggacaggctcagccagcgtctctcacttaatcgaggttctcccgggttcgggcagtgtgtggggcagctggtggcctccactgcccgctgggcaccagtgggccctgcgttgcctagtctggtgcacggtgggcagttctggcgcatactacgcgtagttctccgctttcggctcagtcacaagctcggggtgagggcctgccacatggtatgcgggtgcgtgcttcttgcacctaggcgcattggtgttgactaccactaccatcgtgggccgtgagcggcgtgggtactgagttgctccaaaggcaaaccatgcttagttgtcgtctagtagaaggtcagtctatggtggtccccggagctcaatgcggagatgcacgccaaaatgatagacttgggcttgttgtgggttagactaggtaattggtcgggccctcaccaagacgtatcccacttggtagtgtggcaccccacaccactagttgtctacgtgaatgcatcgaaagggaaccaccttaccgcgctgatacgagcccaggcatgggaaaacaacttctgtatcgagggcgatcgcgggttccggaatgtgcgccaaaacggtgtacccatggggaacgacgtgtccaaaagataccggtaatgtaccaattcatagtcgccccccatggtgccccgtcaagcaacagacaactcgtggacactttttgtgtgggtacccggttgggcaattgaaccccaatgccaccatgttcaaatggtgttcactacacaacaggcccttgaatggggggctgtcccaaatttccttcgcaactggcggaaatggcaggagccaggcactagcaagggaatacatagtggccccaacgggaagaactccacccgttctccaacgcgcgaacttttcccgggccctgatggacccatgtgaccaacacact

SEQ ID NO: 528734 - DNA, 471 bp, Homo sapiens
tgatgggcacggtagtcccagcggcttgggagactgaggcacacgaatagcttgaccagaggaggcagaggttgcagtgagtccagatagtgccactgcactccagccggggtgacagagcaagactccatctaaaacagtaaataagtaaataaaaaagaaaagaaaagtggttagagcagacatcctggtatactggtcctggttctacatcttaggggaaaaacattcagtcttaccattcagtatgatattagtggtgagtcttgggtagatacccttcatcaggtcaaggtaattcctttccattcctcattgtaagcgcgtgctgtccggacagcacgcgctaaataattacccacatccgcaggtacaggggaagtgtgaggagagcagcacccctaggaaccaccgcagccagcattgcccccgtctgacgaatgacaggaagactgttgaaagccatgaggg

SEQ ID NO: 528735 - DNA, 1701 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 528736 - DNA, 133 bp, Homo sapiens
tcatcgcgtatgagcatcatttctcgtagcagtcaccttcctcggtgttgatgaagatactgcctgggtgatggtcagggtttcatactagacacatagtgtgttcagcttccactcctctcgttccacgttg

SEQ ID NO: 528737 - DNA, 1981 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcccacagcctgtgaccactgccctctcagacgcagggaggcatgagccggggcaggtgcggttggggccagtgggggcttctgaacaacaggatacatctaaatgaaggcagcatctgggtagacaaaagtgggggcttaggtcccctccccacctcccctaggcgcctccataggcaagtggccaaagcctccgggagcttcggatgcctcacagccttggaagcaccgcctgcgaggccacagtggctgctgctgggggctgttgaatctga

SEQ ID NO: 528738 - DNA, 2060 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaaggtgagtgggttccggctgcaagccaccaaggcttcagctttgggggtgggcagggtggtctctgcactgcttggggtggcaggtctggtgcccgcccagctgggtttgcaacgtggctcaaggtggcatggatgcctcaggacggccccttgcttccagccaagcccctgcccaggcctggaggggaagagagtctgggtgggttggggtgagggagaggcatctggcttgggagcagttcccagggctgcatccaggccgtgggcatctggcagaggcttccccagtggggagcaggccccaggctggacctgccctgtcctcagcacgcgtgtgcaaaagtgaacaataaatcatttcaaagatgcgagagcccacagcctgtgaccactgccctctcagacgcagggaggcatgagccggggcaggtgcggttggggccagtgggggcttctgaacaacaggatacatctaaatgaaggcagcatctgggtagacaaaagtgggggcttaggtcccctccccacctcccctaggcgcctccataggcaagtggccaaagcctccgggagcttcggatgcctcacagccttggaagcaccgcctgcgaggccacagtggctgctgctgggggctgttgaatctga

SEQ ID NO: 528739 - DNA, 701 bp, Homo sapiens
  misc_feature (1)..(1): n is a, c, g, or t
  misc_feature (104)..(104): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (129)..(129): n is a, c, g, or t
  misc_feature (137)..(137): n is a, c, g, or t
  misc_feature (222)..(223): n is a, c, g, or t
  misc_feature (225)..(225): n is a, c, g, or t
  misc_feature (227)..(227): n is a, c, g, or t
  misc_feature (233)..(233): n is a, c, g, or t
  misc_feature (247)..(247): n is a, c, g, or t
  misc_feature (254)..(254): n is a, c, g, or t
  misc_feature (312)..(312): n is a, c, g, or t
  misc_feature (351)..(351): n is a, c, g, or t
  misc_feature (356)..(356): n is a, c, g, or t
  misc_feature (377)..(377): n is a, c, g, or t
  misc_feature (424)..(425): n is a, c, g, or t
  misc_feature (453)..(453): n is a, c, g, or t
  misc_feature (456)..(456): n is a, c, g, or t
  misc_feature (474)..(474): n is a, c, g, or t
  misc_feature (476)..(476): n is a, c, g, or t
  misc_feature (492)..(493): n is a, c, g, or t
  misc_feature (531)..(531): n is a, c, g, or t
  misc_feature (604)..(606): n is a, c, g, or t
  misc_feature (682)..(682): n is a, c, g, or t
nagttaaacttagcattaaataaaaatctttaaatggtacacctatgtagcaagagttaaatataaacccagtctaatcctgtacacttgtgattaattgtganaatcttaagtggntnanttctttcncatttacnaattcagagaaagcccgtttcctgtttaaacctcaccactttgccttggcatcacaccaaccctgcctcgggcttcagctgcagnncngncccagnccctcctcccagcngggctgnctccagtcccagccccagtctccaccaactgagcagcgtacgcggggttgtgtctggnttccagcatctaccaccccttcagagcaacttccaacangggangggggaggaagctcgcattgnttgggctgaacagatttgggggggttttatcacaagggcctgaaaanntcctaagcatgcgttctccttgcacagnggngggggggcaatggggggngnggggggggggggtggnnggggcggcaggggctctcaactaagggctctgaatcanagaggggacagatgctgccttagtccttcttgcctcccagggccaggcttcttgtgaggagctttcctgggcnnnagggggtcagtgtggagactgtgggggcttccagcttcactctgtctaagagggtcttcttaagggcagcaggggngatcttttcttggtcggcc

SEQ ID NO: 528740 - DNA, 672 bp, Homo sapiens
cgtatagatgtcatagcatgcccttcggcagatgtgcattcttatcccttatatggtgccttaagaatcacagggggtgcttcatcctctaattggagacagaaaattatgacacgtcacaaggtggatatatatttcggtacctgtgcttgccacagccctgttcctcaaagctgaattgatagatttctctttgtctccgaagaccaagcggttataaggcaccttagaataaatttctccatgaatgtatgtagggtccaagcgctacctgatcatttaaggtcattgctggatatcgttaacgtttccagtgcaggccatgccattccattcatcagattcttagcacttagctgtagtcttgtccatcaatgacccgttagaatagattggcacctactgcatatccagcaagtgagcctcagcagtatagtttcgtccctacccctcatgcctgtgtagtcctgttcacgtatatgtgagtgtgtgtgcgagtgtgtgtgttaacacagacagccatagcacaatgtctgtatttcacatgtatgctaaggtagtgaatgaatcagtaatgcaatattgtgggtccagccgctctgtgcagcactttatttgcagtagtcaatacaatcatttttagtcaattcatgaaaaaaaaaaaagaactcg

SEQ ID NO: 528741 - DNA, 808 bp, Homo sapiens
cccctggaccgtggcaggaactccccctgtctgcctgggtaggacagaaagctgctcgtcctgcgcggcccaccagcccacatgcttcctatccgtttcctgcaggatggtgcccccggcatcccctcacacattgctcacggaaggaaaagcagacgtggccagcctgcatcctctgccctccctgagcctccttggcctggctggccacagctggcatggacgccatcagcaggctccgtgcaggcggacggggcagcccccacaaccagggcaaccctggccctcactcaccagcacccttttgttcttttcctagcaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 528742 - DNA, 1209 bp, Homo sapiens
gctgcccgagctgcggactccatctcagaggccccggactccctagtgacgagtcctgaatgggctgcccgagggaaaggagggcactcctcacagcagcggcactcgccacggccgcctggcccctcacccagactcagacccgtgtggctgtggctgctgggcccctctcacagtgtccttgggctctgcccgctgccctcccctcaggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaaggtgagtgggttccggctgcaagccaccaaggcttcagctttgggggtgggcagggtggtctctgcactgcttggggtggcaggtctggtgcccgcccagctgggtttgcaacgtggctcaaggtggcatggatgcctcaggacggccccttgcttccagccaagcccctgcccaggcctggaggggaagagagtctgggtgggttggggtgagggagaggcatctggcttgggagcagttcccagggctgcatccaggccgtgggcatctggcagaggcttccccagtggggctgctcccctgctggccagcctggccccgggagtggtgctggccacaggctcccgagatttcctgtgcccagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 528743 - DNA, 1208 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagcaaaatatgcaaggtgcccggtggaacccaagggcaagatggggtccaccgtgcccgggtgtgaaaagagcccaaaaatggggag

SEQ ID NO: 528744 - DNA, 429 bp, Homo sapiens
ggatttcaccatgttggccaggtctcaaactcctgacccagtgatccgcccgcctcggcctcccaaagtgttgagattacaggcgtgagccactgcgcccagccgggtctctggaatcttagctgcaggtacccctccttttaggggtttggaggaatagtctggtctctctagctcagtgacattgccagcactggtcctctgcgaaatgctgccttttctgtgcttgccactcagggttctgctttcagctccgccttttctcttcgcccctccccacccccactgatttcctttgcttctatgtaccaagcaatataatttgaaaattctgttttacacagaatctagttgtgtgatagagaggaccctgcaagtatctcacccaccatactgaagtctctgctttcatccattatcgaattttat

SEQ ID NO: 528745 - DNA, 1187 bp, Homo sapiens
  misc_feature (1029)..(1029): n is a, c, g, or t
  misc_feature (1105)..(1105): n is a, c, g, or t
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcacgacgggcataccatgcgcaaccccagccactgtgttctagggcccgcgtgcccctgccgtgctgggacgctggcctgaagcgcacgtatcttggaccatcagttgcaggcgatgctaactccctngcactcgcctgtctcttaccgtaccaggcgccccactctgctttcaatgtcttgtagggcagtccaacagctgctngcgggtgttgcagcccagggatgcttcgcgatgaagcgatgcttgtgcccacaggttgcaagaaccccgtggacgcggcata

SEQ ID NO: 528746 - DNA, 1050 bp, Homo sapiens
  misc_feature (952)..(952): n is a, c, g, or t
  misc_feature (954)..(954): n is a, c, g, or t
  misc_feature (990)..(990): n is a, c, g, or t
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggctgcccacagatgatagccaagagaggtcactatggcgcctttntncaggacgagtgggacctgctccaaagaatgattttnctggcccacgagaaactctctgttcctgtcacgtgcaaaatccgtgtcttcccggagatt

SEQ ID NO: 528747 - DNA, 117 bp, Homo sapiens
agcagtgtgtggaatacggttcagagtcaaaagtgcctaaactgtggtcatccactaatgtcttctcacatctccatcattttattacaatgaatgtatatataaataggtctcaca

SEQ ID NO: 528748 - DNA, 267 bp, Homo sapiens
aataatgtacttatttattttgagacagagtcttgctttgttggacaggctggaatgcagtggtgggatctctgctcaccgcaacctctgcctcctgggttcaagtgattcttgtgcctcagcctccctggtagctgggattatgggtgagtgcctcactcccggctgatttttgtatttttgaagagactgggtttcgccattgtgtctattctagttgtcaaagtcctcattttatgtgatcttgtcctttttttatttcttttt

SEQ ID NO: 528749 - DNA, 82 bp, Homo sapiens
aatagtcaggctggtacggcccgggagttaggatgagaagtggatccgccgcttgcgccgcatggagtccgaatcggaaagc

SEQ ID NO: 528750 - DNA, 980 bp, Homo sapiens
atatccaactttagctcaatactgttaaagctttttaatctttgcaaattaacatgttctgggcctgctgtgacggatggcttatgtctggtaatcccaagcactgtgggatgccagtgcgggtggactcactgtgatgtccacgagtttgagaccgagcctgacgcgaacatggtgaatatccgcgtctctactaaaaatacaaaatttatccgaggtgtggtggcatgctcctgtaatcccatgcatagcttgggggacgcgctgagtgcatggagaaattgcttgaacctgggaggcagtaggttgcagttgagcccaagtatcgtgccactgctctccagcctgggtcgagcaagagtgagactctggtcttcataataaacccaagaaggcagatgttccagtgcccaccgtgcaggggggtcaaaagaggcaagccggttatggcccctacaactctaataaaggcgaagcgcaagagttttatcgtgcggggcctctttttcacattactctggataagccgagggtaaccctttcgtgttccagggtaaatatttcagaccctgtttttcccaccatcaggaggaagggtgcaggtgccagcacggtggttaaaggggagaagtcctcttcctgttttgtggtggcccctgttcggtatcccttcggccgaggttccccagggagtggtgtcctccggggatgatcatgtagacgataattttggcccggggaagtggataacaacccatttcttcggcggcttacgggagtgtgttggagcggccacatagatttactaagaccccggggccctcgggtaccgacaaacttgtgagcctgttccctaacaggtgcggattaagaccgagagagcaaaacgtcgggggggatgcgagatatatggtggtcctgaaagccaaaatgcgttgctccgagagaggggccccggatcactttgtgcatcatcaggg

SEQ ID NO: 528751 - DNA, 2013 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccgggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528752 - DNA, 2422 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggtgcggctgccccccacccgcgtcgccgccatggaggtgctgcggctgctcctcggtcttcgccgccgagatacatggacgcctttgacctgctctgcccacagacaatggagcttggtggcccagtgccaatggctgcttgggcctgggagtactgttgcactgctgctggctagctagctgctgcctggcctcgtccttggagctgctgccctgagctgttgccgctgcctggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccgggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528753 - DNA, 259 bp, Homo sapiens
atcctagccacgtgacgtagcacctgacgtaccccagctgctgcctcgtactttgcagatattaaagaggagcctgaaactgttccttggacatcttatgaatgtcagaaaatacctttggcagggttagaatgatcatggggacagtggttgttcacaatttgcatgccacgtgaacaggcgccagatcttcacgttggaaaacatgaatcacagccttgtgaaagacgatcatccgctaagcagtgtgggctacgga

SEQ ID NO: 528754 - DNA, 1345 bp, Homo sapiens
gcctgaaccccaggtgaaggggcccggaacacctgctctcacctgagaccccaggtgaatgggtgccgggaacacctgctctcacctgagccccaggtgaaggggcccgggaacacctgctctcacctgaaccccaggtgaaggggcccgggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528755 - DNA, 1976 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggtgcggctgccccccacccgcgtcgccgccatggaggtgctgcggctgctcctcggtcttcgccgccgagatacatggacgcctttgacctgctctgcccacagacaatggagcttggtggcccagtgccaatggctgcttgggcctgggagtactgttgcactgctgctggctagctagctgctgcctggcctcgtccttggagctgctgccctgagctgttgccgctgcctggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528756 - DNA, 262 bp, Homo sapiens
  misc_feature (139)..(139): n is a, c, g, or t
  misc_feature (224)..(224): n is a, c, g, or t
tagaggatcctcaataaattgttggtcattgatgatggttcctcagatgtcaaatgtctttttgagaaatggttgaatgaagaaaatagctttccaattcattatcatgttaaagaaaatggcggtaaacatactgcanttaatgttgctttagaaaaagcaagaggtgaattgttctttactgcagactcggatgattatttgacagcagatgccttgcaaanagtaaataattgggtgatcaatgaccaacaatttattg

SEQ ID NO: 528757 - DNA, 1012 bp, Homo sapiens
acaaaacaccaaatgtgctggatgactgccagtgtgcatgctgggggtgggccctggggtgccctggtggccctgggatggggaaccgctggtggcttccgcggaggtttcggcagtggcatcctggggtcggggtcgcggctgtggactgctgtggcctggtggccgagtgccagcggagctcgcggaggcaaggccgaggataacggagtgtatgcccgtcaccaagtagggccgcattggtcaaggacatgaaggatcaagtccctggaggagatctatctcttctccctgccattaaggaatcagagatcaattgatttctacctgaggggacatctctcaaggattgaggtcctgaaggatccatgccacgtgcacaaagcagacccgtgccgggccaagcgcaccaaggttcaacggcaatattgtatgactatacgagggactacaaatatgtccaaacgatcagagtcatagggtagataaacgtagcttcgaagatggaacgagttggccacacagcaaaatcccgatggaggagcccaaacaacttccaatgtgcacaaagcttccaccattacagatcacaccgactacgccaagaaggacaaactaggaggcagaaacccaggacatcagacaaaagaccacaacaaccaagatgaaccaccaaatggtaaaataggatagaacataggaccacaattaaaggaagataatagatgccttgcgatactgccaatacatacacactagaaaacccaaaagatgacgcaaccactgagcaatcaaggcatcaagcaacagctaggacgcacaataaaggaaaaggctgggcaacaatagggcaatggagaaatacagaagagaaacatagagaagtaaccaatcaacgacccgacagacgtaacacatgtacaacacacaagagtgcgcaatataagcgccacacgaaccaacacaaaacgaaacacaaagaaactaaacgaacctaaacaataatacacag

SEQ ID NO: 528758 - DNA, 1509 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528759 - DNA, 542 bp, Homo sapiens
  misc_feature (6)..(6): n is a, c, g, or t
  misc_feature (11)..(11): n is a, c, g, or t
  misc_feature (13)..(13): n is a, c, g, or t
  misc_feature (18)..(18): n is a, c, g, or t
  misc_feature (22)..(22): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (40)..(40): n is a, c, g, or t
  misc_feature (45)..(45): n is a, c, g, or t
  misc_feature (50)..(50): n is a, c, g, or t
  misc_feature (73)..(73): n is a, c, g, or t
  misc_feature (80)..(80): n is a, c, g, or t
  misc_feature (85)..(85): n is a, c, g, or t
  misc_feature (117)..(117): n is a, c, g, or t
  misc_feature (133)..(133): n is a, c, g, or t
  misc_feature (145)..(145): n is a, c, g, or t
  misc_feature (147)..(147): n is a, c, g, or t
  misc_feature (155)..(155): n is a, c, g, or t
  misc_feature (157)..(157): n is a, c, g, or t
  misc_feature (188)..(190): n is a, c, g, or t
  misc_feature (207)..(207): n is a, c, g, or t
  misc_feature (223)..(223): n is a, c, g, or t
  misc_feature (232)..(232): n is a, c, g, or t
  misc_feature (240)..(240): n is a, c, g, or t
  misc_feature (244)..(244): n is a, c, g, or t
  misc_feature (250)..(250): n is a, c, g, or t
  misc_feature (254)..(254): n is a, c, g, or t
  misc_feature (263)..(263): n is a, c, g, or t
  misc_feature (265)..(265): n is a, c, g, or t
  misc_feature (300)..(300): n is a, c, g, or t
  misc_feature (304)..(304): n is a, c, g, or t
  misc_feature (312)..(312): n is a, c, g, or t
  misc_feature (320)..(320): n is a, c, g, or t
  misc_feature (330)..(330): n is a, c, g, or t
  misc_feature (348)..(348): n is a, c, g, or t
  misc_feature (356)..(356): n is a, c, g, or t
  misc_feature (362)..(362): n is a, c, g, or t
  misc_feature (402)..(402): n is a, c, g, or t
  misc_feature (408)..(408): n is a, c, g, or t
  misc_feature (447)..(447): n is a, c, g, or t
  misc_feature (452)..(452): n is a, c, g, or t
  misc_feature (456)..(456): n is a, c, g, or t
  misc_feature (474)..(474): n is a, c, g, or t
  misc_feature (541)..(541): n is a, c, g, or t
taaaancagcnanttttnaaanaancnaancccaaaaaanaaaanagggngtagcagttgccttaatggtganaaaattntaaanaaaaactttttcttcccccaaaaacccgagtnaaaggaagcgtttcanaaaaaggaaaananatttgaancnattttttaaaaaacaccccgaaaacaaacannnttgttgtcgtttaaaanggtccccaaaaacccntacccccanccaacccnccangtttancaantcaaaatcnanaactttcttgacccaaaaaattttgtaggaaaaanttcncttttcanaaattcancacgcaaggntcatttttcttggttttnttgctgancttgcngaacttcccaacaaaggctgagggaggaagcttgcatgantcttangagttcttctgaggcactttgactgtgacagttttcacntcagngtangcccgccgcccgtccccncccaacccccggccaccccccgacaacttgtagccaccaaagggggactgggctccaaacacatcana

SEQ ID NO: 528760 - DNA, 1758 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccgggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttaaaaaaaaaa

SEQ ID NO: 528761 - DNA, 148 bp, Homo sapiens
cagggactgaacagagcaccatatttcctccagctgtcagaacaacctttttatgcatttatctttctatttactttatttgaagatggagtttcactccttattgcccagagctggatgtgcaagtggctgtgcatctcatgctaaa

SEQ ID NO: 528762 - DNA, 1481 bp, Homo sapiens
  misc_feature (28)..(28): n is a, c, g, or t
gaagggtctgaggtcgtcgtcggtgtgngagcagatcctgaagccagaactccaccccggcgcccgcgccatgcggcgggagaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccgggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccactggagggtaggggtggtaatacttctcccgatcgctgtcattttagacg

SEQ ID NO: 528763 - DNA, 178 bp, Homo sapiens
aaagttttgccccgtttttgagcaaaaacttcaatttcaaaataaaggttttcaggggttcccttaagtgtttccccatccccccccgacgggatttttttactatcagatttttggaaatgtaaaaccctttttgtgtaactttttttgatattaaacttgatttttgagcctgtta

SEQ ID NO: 528764 - DNA, 537 bp, Homo sapiens
  misc_feature (34)..(34): n is a, c, g, or t
  misc_feature (57)..(57): n is a, c, g, or t
  misc_feature (88)..(88): n is a, c, g, or t
  misc_feature (105)..(105): n is a, c, g, or t
  misc_feature (144)..(144): n is a, c, g, or t
  misc_feature (186)..(186): n is a, c, g, or t
  misc_feature (250)..(250): n is a, c, g, or t
  misc_feature (306)..(306): n is a, c, g, or t
  misc_feature (341)..(341): n is a, c, g, or t
  misc_feature (385)..(385): n is a, c, g, or t
  misc_feature (445)..(445): n is a, c, g, or t
  misc_feature (454)..(454): n is a, c, g, or t
atcggaccgcgtgagctggggctggggaaggcanaatatgcacctactggggtggangggacccaaaactcccaatgggagctggcangaagtcctgggaacacnccatgaaaggatcctaccaggaaagcggctctagggcanaacataaattacgaaggtcctcccaaggagcgcggacctgantgggaatgagtgacccgcgtgcaatctcgaccctgacaggacaggactggcctcagccgaccangctcaattctttccattcctgatatttgacggaaggaggcacccagttccttgaangaactgaggggcatggaaggaacaaaggtacttangctcataagggccaccaggcatccgttaacaagggaaacaaaangacgcccatctatgcctgtacccaagcgttagtcatactttccaccagaagtggggacancaccctcanggcacaggaatggccctctctggcctctctggccccgtggcctccaggaactcaccttgtctgaaagacttcctcccgggaaa

SEQ ID NO: 528765 - DNA, 239 bp, Homo sapiens
ccttatgagaatctaatgcctgatgatcggaagtggaagtttcattctgaaaccagccccagaccccgtccgtggaaaacttgtcttccacaaaaccagtccctggtggcaaagaggttggggactgctggtttaaaggagctggcacctccccctctctggcttgctctgacgatgtgacaggcctgcgcctcctgttgctcctgtgttgagtggaagcttgctgaggtctccccaga

SEQ ID NO: 528766 - DNA, 326 bp, Homo sapiens
cactgatggcggacgttgctcagcgtgtcttccacgtacttttggatctcagcgatcagtagggggaaacgagcttttttcagtgcagaggggtcgctgccggcctccttggcaacgttgttctgacttacgggcgtccccttcggcagtcgttcgggcttgttgctcttcagccgctcgaacgctgcgcgatactgctcgccggcactcattcgcttagccgggtcagcggattcatgtttgccggatgacatggcgataattctccacactacgtttctgggcttccaacgaagtccttagcggactgtctacctcggtagcgg

SEQ ID NO: 528767 - DNA, 440 bp, Homo sapiens
tatagccgtcgttacagactgctgccgagcgggaggtggcgactgtggactctgggcgcgtttgactttcagccatggtcttatgattgggcagcttccgtccggttgctgccccctctgccccttgggcatacgcccagtggagcttggacctgactcatagctctctacagtcgacaaaaggaaaatgtttcagtttgggtaaatcagccacagctggagccagggagaggcccatgggctggtgacttttcagggtggtggtgtttgttcagcgtgttgttttgctctgtgactttggagagtgcatcaaaggctcggcggacgcccacttgccgaggagccacggccctggctggtggccaggcaagcacctcccaggtaggcgtcaggggaagcatccaaactagtaaataaaacggcttctggcagtgacgttc

SEQ ID NO: 528768 - DNA, 239 bp, Homo sapiens
agttgtgaggtgatctagaggatcccggacggagatgtctgaggtgggaggactcgtgggcccaggagctggacgttgcagtgagccgagatggtcccgctgcactctgtgtttttaacaaagaaaatggatcaaaacaaagtgaaatgtcattggattggtgtcatctggttggatgactttttttttttttttttttttttttttttttttttttttttttttttttgtgtggggtg

SEQ ID NO: 528769 - DNA, 999 bp, Homo sapiens
  misc_feature (32)..(32): n is a, c, g, or t
tccggcgggggggcgagaggaaacagcagtgngtatgccccaacatcgcgctaggtgactggcacatgtccatcagtgattactccgaccatacagaggatgccgctgtacaaaacgctggacgacccgcccatgtggtggggcaagatattaagtgggacataaaaacgcggcggtaaagaatctgccccccacgcggcgcaggtcgtggccctgctgaaacccccggcggattgttcccaacagagaagcgcccgtgaacgctcgctctggcccccccccccccttggtccccgcccctgacgaacctctcgccctggccgcaagacggctagaccaacgcgctctggtttcgggaagagtgcaaagaggcccgccaacaccaggggtgtttcacaacccgcggtggaaacaaacaaatgggccgccttggggaacacgcagtactaggtggccgccacaaggagccctgtcacaacacaagccaacaccgcctcagacggaatagtgaaagagccgatgacccgcagtgaaaagagatgtttgaacagcccatcatgggcttcaacacaaagacgccagcggcccacaggttcacccctaatatcccggcgagtgggaatcgcgcataacacaggggaccccgcctcccacaaggatcgccgtctgttccacgcgcccggttcttgacaaacaccggcagcaccgtgtgacaggtaggcacccgcgcaagcatgcgggctccggggaagacgaactcaaagaaacaccggggggagacaagacaggggctcggggaataaaagaccggagccccttgacatctccgggacggccaccgcgcgcaagacttagcccactgcggctgtgcccagcggggaagagcaaagaggcgctgcaacgacctgtgttaatgtcgatgagaaccagcgcgctccggcccgtgcctgaagatagaaaggtttaaaaaacttccctaaaaaacgagcaaaaaaaaca
